(12) United States Patent
Bare et al.

(10) Patent No.: US 8,071,291 B2
(45) Date of Patent: Dec. 6, 2011

(54) GENETIC POLYMORPHISMS ASSOCIATED WITH VENOUS THROMBOSIS, METHODS OF DETECTION AND USES THEREOF

(75) Inventors: Lance Bare, Walnut Creek, CA (US); James J. Devlin, Lafayette, CA (US); Frits R. Rosendaal, Alameda, CA (US); Pieter H. Reitsma, Alameda, CA (US); Irene D. Bezemer, Alameda, CA (US)

(73) Assignee: Celera Corporation, Alameda, CA (US)

( * ) Notice: Subject to any disclaimer, the term of this patent is extended or adjusted under 35 U.S.C. 154(b) by 261 days.

(21) Appl. No.: 12/403,552

(22) Filed: Mar. 13, 2009

(65) Prior Publication Data

US 2009/0270332 A1 Oct. 29, 2009

Related U.S. Application Data

(60) Provisional application No. 61/069,687, filed on Mar. 13, 2008.

(51) Int. Cl.
*C12Q 1/68* (2006.01)
*C12P 19/34* (2006.01)
*C07H 21/02* (2006.01)
*C07H 21/04* (2006.01)

(52) U.S. Cl. .......... 435/6; 435/91.2; 536/23.1; 536/24.3

(58) Field of Classification Search .................. None
See application file for complete search history.

(56) References Cited

U.S. PATENT DOCUMENTS
2007/0269827 A1 11/2007 Harley

FOREIGN PATENT DOCUMENTS
WO 2005056837 A2 6/2005

OTHER PUBLICATIONS

Wilmanns C. et al. Superficial thrombophlebitis in varicose vein disease: the particular role of methylenetetrahydrofolate reductase. Phlebology (2011) vol. 26, No. 4. pp. 135-139.*
Arellano, A., et al., "Gene Variants Associated with Venous Thrombosis: Confirmation in the MEGA Study," Journal of Thrombosis and Haemostasis, Jan. 25, 2010, Letter to the Editor.
Bezemer, I., et al., "Gene Variants Associated with Deep Vein Thrombosis," Journal of the American Medical Association, Mar. 19, 2008, vol. 299, No. 11, pp. 1306-1314 and Supplementary Online eTable Entitled, "48 SNPs in CYP4V2 Region Genotyped in the Leiden Thrombophilia Study".
Li, Y., et al., "Gene Variants Associated with Deep Vein Thrombosis: the F11 Locus," Journal of Thrombosis and Haemostasis, 2009, vol. 7, pp. 1802-1808.
Reiner, A., et al., "Common Hemostasis and Inflammation Gene Variants and Venous Thrombosis in Older Adults from the Cardiovascular Health Study," Journal of Thrombosis and Haemostasis, 2009, vol. 7, pp. 1499-1505.
Smith, N., et al., "Replication of Findings on the Association of Genetic Variation in 24 Hemostasis Genes and Risk of Incident Venous Thrombosis," Journal of Thrombosis and Haemostasis, 2009, vol. 7, pp. 1743-1746.
International Preliminary Report on Patentability, issued for PCT/US09/37069, dated Sep. 23, 2010.
Dilley, A., et al., "Relation of Three Genetic Traits to Venous Thrombosis in an African-American Population," American Journal of Epidemiology, 1998, vol. 147, No. 1, pp. 30-35.
Pan, M., et al., "Angiotensin-Converting Enzyme Gene 2350 G/A Polymorphism is Associated with Left Ventricular Hypertrophy but not Essential Hypertension," Hypertension Research, 2007, vol. 30, pp. 31-37.
International Search Report and Written Opinion, issued for PCT/US09/37069, dated Apr. 9, 2010.

* cited by examiner

*Primary Examiner* — Stephen Kapushoc

(57) ABSTRACT

The present invention is based on the discovery of genetic polymorphisms that are associated with venous thrombosis. In particular, the present invention relates to nucleic acid molecules containing the polymorphisms, variant proteins encoded by such nucleic acid molecules, reagents for detecting the polymorphic nucleic acid molecules and proteins, and methods of using the nucleic acid and proteins as well as methods of using reagents for their detection.

44 Claims, 2 Drawing Sheets

GENETIC POLYMORPHISMS ASSOCIATED WITH VENOUS THROMBOSIS, METHODS OF DETECTION AND USES THEREOF

FIELD OF THE INVENTION

The present invention is in the field of thrombosis diagnosis and therapy. In particular, the present invention relates to specific single nucleotide polymorphisms (SNPs) in the human genome, and their association with venous thrombosis (VT) and related pathologies. Based on differences in allele frequencies in the patient population relative to normal individuals, the naturally-occurring SNPs disclosed herein can be used as targets for the design of diagnostic reagents and the development of therapeutic agents, as well as for disease association and linkage analyses. In particular, the SNPs of the present invention are useful for identifying an individual who is at an increased or decreased risk of developing venous thrombosis and for early detection of the disease, for providing clinically important information for the prevention and/or treatment of venous thrombosis, for screening and selecting therapeutic agents, and for predicting a patient's response to therapeutic agents. The SNPs disclosed herein are also useful for human identification applications. Methods, assays, kits, and reagents for detecting the presence of these polymorphisms and their encoded products are provided.

BACKGROUND OF THE INVENTION

Venous Thrombosis (VT)

The development of a blood clot is known as thrombosis. Venous thrombosis (VT) is the formation of a blood clot in the veins. VT may also be referred to as venous thromboembolism (VTE). Over 200,000 new cases of VT occur annually. Of these, 30 percent of patients die within three days; one in five suffer sudden death due to pulmonary embolism (PE) (*Seminars in Thrombosis and Hemostasis*, 2002, Vol. 28, Suppl. 2) (Stein et al., *Chest* 2002; 122(3):960-962, further describes PE). Caucasians and African-Americans have a significantly higher incidence than Hispanics, Asians or Pacific Islanders (White, *Circulation* 107(23 Suppl 1):I4-8 Review, 2003).

Several conditions can lead to an increased tendency to develop blood clots in the veins or arteries (National Hemophilia Foundation, *HemAware* newsletter, Vol. 6 (5), 2001), and such conditions may be inherited (genetic) or acquired. Examples of acquired conditions are surgery and trauma, prolonged immobilization, cancer, myeloproliferative disorders, age, hormone therapy, and even pregnancy, all of which may result in thrombosis (Seligsohn et al., *New Eng J Med* 344(16):1222-1231, 2001 and Heit et al., *Thromb Haemost* 2001; 86(1):452-463). Family and twin studies indicate that inherited (genetic) causes account for about 60% of the risk for DVT (Souto et al., *Am J Hum Genet.* 2000; 67(6): 1452-1459; Larsen et al., *Epidemiology* 2003; 14(3):328-332). Inherited causes include polymorphisms in any of several different clotting, anticoagulant, or thrombolytic factors, such as the factor V gene (the factor V Leiden (FVL) variant), prothrombin gene (factor II), and methylenetetrahydrofolate reductase gene (MTHFR). Other likely inherited causes are an increase in the expression levels of the factors VIII, IX or XI, or fibrinogen genes (Seligsohn et al., *New Eng J Med* 344(16): 1222-1231, 2001). Deficiencies of natural anticoagulants antithrombin, protein C and protein S are strong risk factors for DVT; however, the variants causing these deficiencies are rare, and explain only about 1% of all DVTs (Rosendaal et al., *Lancet* 1999; 353(9159): 1167-1173). The factor V Leiden (FVL) and prothrombin G20210A genetic variants have been consistently found to be associated with DVT (Bertina et al., *Nature* 1994; 369(6475):64-67 and Poort et al., *Blood* 1996; 88(10):3698-3703) but still only explain a fraction of the DVT events (Rosendaal, *Lancet* 1999; 353 (9159):1167-1173; Bertina et al., *Nature* 1994; 369(6475): 64-67; Poort et al., *Blood* 1996; 88(10):3698-3703). Elevated plasma concentrations of coagulation factors (e.g., VIII, IX, X, and XI) have also been shown to be important risk factors for DVT (Kyrle et al., *N Engl J Med.* 2000; 343:457-462; van Hylckama Vlieg et al., *Blood.* 2000; 95:3678-3682; de Visser et al., *Thromb Haemost.* 2001; 85:1011-1017; and Meijers et al., *N Engl J Med.* 2000; 342:696-701, respectively).

About one-third of patients with symptomatic VT manifest pulmonary embolism (PE), whereas two-thirds manifest deep vein thrombosis (DVT) (White, *Circulation* 107(23 Suppl 1):I4-8 Review, 2003). DVT is an acute VT in a deep vein, usually in the thigh, legs, or pelvis, and it is a serious and potentially fatal disorder that can arise as a complication for hospital patients, but may also affect otherwise healthy people (Lensing et al., *Lancet* 353:479-485, 1999). Large blood clots in VT may interfere with blood circulation and impede normal blood flow. In some instances, blood clots may break off and travel to distant major organs such as the brain, heart or lungs as in PE and result in fatality. There is evidence to suggest that patients with a first episode of VT be treated with anticoagulant agents (Kearon et al., *New Engl J Med* 340:901-907, 1999).

VT is a chronic disease with episodic recurrence; about 30% of patients develop recurrence within 10 years after a first occurrence of VT (Heit et al., *Arch Intern Med.* 2000; 160: 761-768; Heit et al., *Thromb Haemost* 2001; 86(1):452-463; and Schulman et al., *J Thromb Haemost.* 2006; 4: 732-742). Recurrence of VT may be referred to herein as recurrent VT. The hazard of recurrence varies with the time since the incident event and is highest within the first 6 to 12 months. Although anticoagulation is effective in preventing recurrence, the duration of anticoagulation does not affect the risk of recurrence once primary therapy for the incident event is stopped (Schulman et al., *J Thromb Haemost.* 2006; 4: 732-742 and van Dongen et al., *Arch Intern Med.* 2003; 163: 1285-1293). Independent predictors of recurrence include male gender (McRae et al., *Lancet.* 2006; 368: 371-378), increasing patient age and body mass index, neurological disease with leg paresis, and active cancer (Cushman et al., *Am J Med.* 2004; 117: 19-25; Heit et al., *Arch Intern Med.* 2000; 160: 761-768; Schulman et al., *J Thromb Haemost.* 2006; 4: 732-742; and Baglin et al., *Lancet.* 2003; 362: 523-526). Additional predictors include "idiopathic" venous thrombosis (Baglin et al., *Lancet.* 2003; 362: 523-526), a lupus anticoagulant or antiphospholipid antibody (Kearon et al., *N Engl J Med.* 1999; 340: 901-907 and Schulman et al., *Am J Med.* 1998; 104: 332-338), antithrombin, protein C or protein S deficiency (van den Belt et al., *Arch Intern Med.* 1997; 157: 227-232), and possibly persistently increased plasma fibrin D-dimer (Palareti et al., *N Engl J Med.* 2006; 355: 1780-1789) and residual venous thrombosis (Prandoni et al., *Ann Intern Med.* 2002; 137: 955-960).

VT and cancer can be coincident. According to clinical data prospectively collected on the population of Olmsted County, Minnesota, since 1966, the annual incidence of a first episode of DVT or PE in the general population is 117 of 100,000. Cancer alone was associated with a 4.1-fold risk of thrombosis, whereas chemotherapy increased the risk 6.5-fold. Combining these estimates yields an approximate annual incidence of VT in cancer patients of 1 in 200 cancer patients (Lee et al., *Circulation.* 2003; 107:I-17-I-21). Extrinsic factors such as surgery, hormonal therapy, chemotherapy, and long-term use of central venous catheters increase the cancer-associated prethrombotic state. Post-operative thrombosis occurs more frequently in patients with cancer as compared to non-neoplastic patients (Rarh et al., *Blood coagulation and fibrinolysis* 1992; 3:451).

Thus, there is an urgent need for novel genetic markers that are predictive of predisposition to VT, particularly for individuals who are unrecognized as having a predisposition to developing the disease based on conventional risk factors. Such genetic markers may enable screening of VT in much larger populations compared with the populations that can currently be evaluated by using existing risk factors and biomarkers. The availability of a genetic test may allow, for example, appropriate preventive treatments for acute venous thrombotic events to be provided for high risk individuals (such preventive treatments may include, for example, anticoagulant agents). Moreover, the discovery of genetic markers associated with VT may provide novel targets for therapeutic intervention or preventive treatments.

SNPs

The genomes of all organisms undergo spontaneous mutation in the course of their continuing evolution, generating variant forms of progenitor genetic sequences (Gusella, *Ann. Rev. Biochem.* 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all genetic polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than 1/100 or 1/1000 members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms," *Am J Hum Genet* 2002 October; 71(4):854-62).

A synonymous codon change, or silent mutation/SNP (terms such as "SNP," "polymorphism," "mutation," "mutant," "variation," and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers," or "di-allelic markers."

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. *Science* 293, 489-493, 20 Jul. 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as VT, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to VT. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. (Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16: 3).

SUMMARY OF THE INVENTION

The present invention relates to the identification of novel SNPs, unique combinations of such SNPs, and haplotypes of SNPs that are associated with VT. The polymorphisms disclosed herein are directly useful as targets for the design of diagnostic reagents and the development of therapeutic agents for use in the diagnosis and treatment of VT.

Based on the identification of SNPs associated with VT, the present invention also provides methods of detecting these variants as well as the design and preparation of detection reagents needed to accomplish this task. The invention specifically provides, for example, novel SNPs in genetic sequences involved in VT, isolated nucleic acid molecules (including, for example, DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing VT based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment (or more or less likely to experience undesirable side effects from a treatment, etc.), methods of screening for compounds useful in the treatment of a disorder associated with a variant gene/protein, compounds identified by these methods, methods of treating disorders mediated by a variant gene/protein, methods of using the novel SNPs of the present invention for human identification, etc.

In Tables 1-2, the present invention provides gene information, references to the identification of transcript sequences (SEQ ID NOS: 1-125), encoded amino acid sequences (SEQ ID NOS: 126-250), genomic sequences (SEQ ID NOS: 404-601), transcript-based context sequences (SEQ ID NOS: 251-403) and genomic-based context sequences (SEQ ID NOS: 602-1587) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The actual transcript sequences (SEQ ID NOS: 1-125), amino acid sequences (SEQ ID NOS: 126-250), genomic sequences (SEQ ID NOS: 404-601), transcript-based SNP context sequences (SEQ ID NOS: 251-403), and genomic-based SNP context sequences (SEQ ID NOS: 602-1587, as well as SEQ ID NOS: 2557-2580), together with primer sequences (SEQ ID NOS: 1588-2556) are provided in the Sequence Listing.

In one embodiment of the invention, applicants teach a method for identifying an individual who has an altered risk for developing VT, comprising detecting a single nucleotide polymorphism (SNP) in, or a SNP that is in linkage disequilibrium (LD) with, any one of the nucleotide sequences of SEQ ID NOS: 1-125, SEQ ID NOS: 126-250, SEQ ID NOS: 251-403, and SEQ ID NOS: 404-601 in said individual's nucleic acids, wherein the SNP is as specified in Table 1 and Table 2, respectively, and the presence of the SNP is correlated with an altered risk for VT in said individual. In a specific embodiment of the present invention, SNPs that occur naturally in the human genome are provided as isolated nucleic acid molecules. These SNPs are associated with VT, such that they can have a variety of uses in the diagnosis and/or treatment of VT and related pathologies. In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of developing VT by detecting the presence or absence of one or more SNP alleles disclosed herein. In another embodiment, a method for diagnosis of VT by detecting the presence or absence of one or more SNP alleles disclosed herein is provided.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of VT.

An aspect of this invention is a method for treating VT in a human subject wherein said human subject harbors a SNP, gene, transcript, and/or encoded protein identified in Tables 1-2, which method comprises administering to said human subject a therapeutically or prophylactically effective amount of one or more agents counteracting the effects of the disease, such as by inhibiting (or stimulating) the activity of the gene, transcript, and/or encoded protein identified in Tables 1-2.

Certain embodiments of the invention provide methods for reducing risk of VT (either a first VT or recurrent VT) in a human who has been identified as having an increased risk for VT due to the presence or absence of a SNP disclosed herein, in which the methods comprise administering to the human an effective amount of a therapeutic agent to reduce the risk for VT. In certain embodiments, the methods include testing nucleic acid from said human for the presence or absence of the SNP. In certain embodiments, the therapeutic agent is at least one of an anticoagulant agent and an antiplatelet agent.

Certain embodiments of the invention provide methods for determining whether a human should be administered a therapeutic agent for reducing their risk for VT (which can be either a first VT or a recurrent VT) based on the presence or absence of a SNP disclosed herein. In certain embodiments, the therapeutic agent is at least one of an anticoagulant agent and an antiplatelet agent.

Examples of anticoagulant agents include, but are not limited to, coumarines (vitamin K antagonists) such as warfarin (coumadin), acenocoumarol, phenprocoumon, and phenindione; heparin and derivative substances such as low molecular weight heparin; factor Xa inhibitors such as Fondaparinux, Idraparinux, and other synthetic pentasaccharide inhibitors of factor Xa; and thrombin inhibitors such as argatroban, lepirudin, bivalirudin, and dabigatran. Examples of antiplatelet agents include, but are not limited to, cyclooxygenase inhibitors such as aspirin, and adenosine diphosphate (ADP) receptor inhibitors such as clopidogrel (Plavix) and prasugrel (Effient).

Certain embodiments of the invention provide methods for conducting a clinical trial of a therapeutic agent in which a human is selected for inclusion in the clinical trial and/or assigned to a particular group (e.g., an "arm" or "cohort" of the trial) within a clinical trial based on the presence or absence of a SNP disclosed herein. In certain embodiments, the therapeutic agent is at least one of an anticoagulant agent and an antiplatelet agent.

Another aspect of this invention is a method for identifying an agent useful in therapeutically or prophylactically treating VT in a human subject wherein said human subject harbors a SNP, gene, transcript, and/or encoded protein identified in Tables 1-2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating VT in a human subject, which method comprises:
(i) determining that said human subject harbors a SNP, gene, transcript, and/or encoded protein identified in Tables 1-2, and
(ii) administering to said subject a therapeutically or prophylactically effective amount of one or more agents counteracting the effects of the disease such as anticoagulant or antiplatelet agents.

Many other uses and advantages of the present invention will be apparent to those skilled in the art upon review of the detailed description of the preferred embodiments herein. Solely for clarity of discussion, the invention is described in the sections below by way of non-limiting examples.

DESCRIPTION OF THE TEXT (ASCII) FILES SUBMITTED ELECTRONICALLY VIA EFS-WEB

The following three text (ASCII) files are submitted electronically via EFS-Web as part of the instant application:

1) File SEQLIST_CD000023.txt provides the Sequence Listing. The Sequence Listing provides the transcript sequences (SEQ ID NOS: 1-125) and protein sequences (SEQ ID NOS: 126-250) as referred to in Table 1, and genomic sequences (SEQ ID NOS: 404-601) as referred to in Table 2, for each VT-associated gene or genomic region (for intergenic SNPs) that contains one or more SNPs of the present invention. Also provided in the Sequence Listing are context sequences flanking each SNP, including both transcript-based context sequences as referred to in Table 1 (SEQ ID NOS: 251-403) and genomic-based context sequences as referred to in Table 2 (SEQ ID NOS: 602-1587). In addition, the Sequence Listing provides the primer sequences from Table 3 (SEQ ID NOS: 1588-2556), which are oligonucleotides that have been synthesized and used in the laboratory to assay the SNPs disclosed in Tables 5-13 during the course of association studies to verify the association of these SNPs with VT. The context sequences generally provide 100 bp upstream (5') and 100 bp downstream (3') of each SNP, with the SNP in the middle of the context sequence, for a total of 200 bp of context sequence surrounding each SNP. The Sequence Listing also provides SEQ ID NOS: 2557-2580, which are exemplary genomic context sequences for certain SNPs presented in Table 8 and Table 17.

File SEQLIST_CD000023.txt is 24,327 KB in size, and was created on Mar. 12, 2009.

2) File TABLE1_CD000023.txt provides Table 1. File Table1_CD000023.txt is 175 KB in size, and was created on Mar. 11, 2009.

3) File TABLE2_CD000023.txt provides Table 2. File Table2_CD000023.txt is 739 KB in size, and was created on Mar. 11, 2009.

These three files are hereby incorporated by reference pursuant to 37 CFR 1.77(b)(4).

LENGTHY TABLES

The patent contains a lengthy table section. A copy of the table is available in electronic form from the USPTO web site (http://seqdata.uspto.gov/?pageRequest=docDetail&DocID=US08071291B2). An electronic copy of the table will also be available from the USPTO upon request and payment of the fee set forth in 37 CFR 1.19(b)(3).

Description of Table 1 and Table 2

Table 1 and Table 2 (both of which are ASCII text files submitted electronically via EFS-Web) disclose the SNP and associated gene/transcript/protein information of the present invention. For each gene, Table 1 provides a header containing gene, transcript and protein information, followed by a transcript and protein sequence identifier (SEQ ID), and then SNP information regarding each SNP found in that gene/transcript including the transcript context sequence. For each gene in Table 2, a header is provided that contains gene and genomic information, followed by a genomic sequence identifier (SEQ ID) and then SNP information regarding each SNP found in that gene, including the genomic context sequence.

Note that SNP markers may be included in both Table 1 and Table 2; Table 1 presents the SNPs relative to their transcript sequences and encoded protein sequences, whereas Table 2 presents the SNPs relative to their genomic sequences. In some instances Table 2 may also include, after the last gene sequence, genomic sequences of one or more intergenic regions, as well as SNP context sequences and other SNP information for any SNPs that lie within these intergenic regions. Additionally, in either Table 1 or 2 a "Related Interrogated SNP" may be listed following a SNP which is determined to be in LD with that interrogated SNP according to the given Power value. SNPs can readily be cross-referenced between all Tables based on their Celera hCV (or, in some instances, hDV) identification numbers, and to the Sequence Listing based on their corresponding SEQ ID NOS.

The gene/transcript/protein information includes:
a gene number (1 through n, where n=the total number of genes in the Table)
a Celera hCG and UID internal identification numbers for the gene
a Celera hCT and UID internal identification numbers for the transcript (Table 1 only)
a public Genbank accession number (e.g., RefSeq NM number) for the transcript (Table 1 only)
a Celera hCP and UID internal identification numbers for the protein encoded by the hCT transcript (Table 1 only)
a public Genbank accession number (e.g., RefSeq NP number) for the protein (Table 1 only)
an art-known gene symbol
an art-known gene/protein name
Celera genomic axis position (indicating start nucleotide position-stop nucleotide position)
the chromosome number of the chromosome on which the gene is located
an OVTM (Online Mendelian Inheritance in Man; Johns Hopkins University/NCBI) public reference number for obtaining further information regarding the medical significance of each gene
alternative gene/protein name(s) and/or symbol(s) in the OVTEM entry Note that, due to the presence of alternative splice forms, multiple transcript/protein entries may be provided for a single gene entry in Table 1; i.e., for a single Gene Number, multiple entries may be provided in series that differ in their transcript/protein information and sequences.

Following the gene/transcript/protein information is a transcript context sequence and (Table 1), or a genomic context sequence (Table 2), for each SNP within that gene.

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (such SNPs are identified as "INTERGENIC" for SNP type).

Note that the transcript, protein, and transcript-based SNP context sequences are all provided in the Sequence Listing. The transcript-based SNP context sequences are provided in both Table 1 and also in the Sequence Listing. The genomic and genomic-based SNP context sequences are provided in the Sequence Listing. The genomic-based SNP context sequences are provided in both Table 2 and in the Sequence Listing. SEQ ID NOS are indicated in Table 1 for the transcript-based context sequences (SEQ ID NOS: 251-403); SEQ ID NOS are indicated in Table 2 for the genomic-based context sequences (SEQ ID NOS: 602-1587).

The SNP information includes:
context sequence (taken from the transcript sequence in Table 1, the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS: 251-403; the genomic-based SNP context sequences in Table 2 are provided in the Sequence Listing as SEQ ID NOS: 602-1587).
Celera hCV internal identification number for the SNP (in some instances, an "hDV" number is given instead of an "hCV" number).
The corresponding public identification number for the SNP, the RS number.
SNP position (position of the SNP within the given transcript sequence (Table 1) or within the given genomic sequence (Table 2)).
"Related Interrogated SNP" is as the interrogated SNP with which the listed SNP is in LD at the given value of Power.
SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs)). Note that multiple "Applera" source entries for a single SNP indicate that the same SNP was covered by multiple overlapping amplification products and the re-sequencing results (e.g., observed allele counts) from each of these amplification products is being provided.

For the following SNPs provided in Table 1 and/or Table 2, the SNP source falls into one of the following three categories: 1) SNPs for which the SNP source is only "Applera" and none other, 2) SNPs for which the SNP source is only "Celera Diagnostics" and none other, and 3) SNPs for which the SNP source is both "Applera" and "Celera Diagnostics" but none other (the hCV identification number and SEQ ID NO for the SNP's genomic context sequence in Table 2 are indicated): hCV22275299 (SEQ ID NO:482), hCV25615822 (SEQ ID NO:639), hCV25651109 (SEQ ID NO:840), hCV25951678 (SEQ ID NO:1013), and hCV25615822 (SEQ ID NO:1375). These SNPs have not been observed in any of the public databases (dbSNP, HGBASE, and HGMD), and were also not observed during shotgun sequencing and assembly of the Celera human genome sequence (i.e., "Celera" SNP source).

Population/allele/allele count information in the format of [population1(first_allele,count|second_allele,count) population2(first_allele,count|second_allele,count)total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["−" in the allele field represents a deletion allele of an insertion/deletion ("indel") polymorphism (in which case the corresponding insertion allele, which may be comprised of one or more nucleotides, is indicated in the allele field on the opposite side of the "|"); "−" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC1"=human individual DNA (anonymized samples) from 24 individuals of self-described PACIFIC RIM heritage; "CAUC1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library. Six male and 6 female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians-12 DNAs from Corielle cell repositories that are from the CEPH/UTAH library.

Note that for SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

Note that semicolons separate population/allele/count information corresponding to each indicated SNP source; i.e., if four SNP sources are indicated, such as "Celera," "dbSNP," "HGBASE," and "HGMD," then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information.

SNP type (e.g., location within gene/transcript and/or predicted functional effect) ["VTES-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary].

Protein coding information (Table 1 only), where relevant, in the format of [protein SEQ ID NO: #, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3

Table 3 provides sequences (SEQ ID NOS: 1588-2556) of oligonucleotides that have been synthesized and used in the laboratory to assay the SNPs disclosed in Tables 5-13 during the course of association studies to verify the association of these SNPs with VT. The experiments that were conducted using these primers are explained in detail in Example 1, below.

Table 3 provides the following:

the column labeled "Marker" lists the Celera identifier hCV number for each SNP marker.

the column labeled "Alleles" designates the two alternative alleles at the SNP site identified by the hCV identification number that are targeted by the allele-specific oligonucleotides.

allele-specific oligonucleotides with their respective SEQ ID numbers are shown in the next two columns, "Sequence A (allele-specific primer)" and "Sequence B (allele-specific primer)." These two primers were used in conjunction with a common primer in each PCR assay to genotype DNA samples for each SNP marker. Note that alleles may be presented in Table 3 based on a different orientation (i.e., the reverse complement) relative to how the same alleles are presented in Tables 1 and 2.

common oligonucleotides with their respective SEQ ID numbers are shown in the column, "Sequence C (common primer)." Each common primer was used in conjunction with the two allele-specific primers to genotype DNA samples for each SNP marker.

All sequences are given in the 5' to 3' direction.

Description of Table 4

Table 4 provides a list of the sample LD SNPs that are related to and derived from an interrogated SNP. These LD SNPs are provided as an example of the groups of SNPs which can also serve as markers for disease association based on their being in LD with the interrogated SNP. The criteria and process of selecting such LD SNPs, including the calculation of the $r^2$ value and the $r^2$ threshold value, are described in Example Ten, below.

In Table 4, the column labeled "Interrogated SNP" presents each marker as identified by its unique identifier, the hCV number. The column labeled "Interrogated rs" presents the publicly known identifier rs number for the corresponding hCV number. The column labeled "LD SNP" presents the hCV numbers of the LD SNPs that are derived from their corresponding interrogated SNPs. The column labeled "LD SNP rs" presents the publicly known rs number for the corresponding hCV number. The column labeled "Power (T)" presents the level of power where the $r^2$ threshold is set. For example, when power is set at 51%, the threshold $r^2$ value calculated therefrom is the minimum $r^2$ that an LD SNP must have in reference to an interrogated SNP, in order for the LD SNP to be classified as a marker capable of being associated with a disease phenotype at greater than 51% probability. The column labeled "Threshold $r_T^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

Description of Other Tables

Tables 3-4, 20-23, and 25-27 are provided following the Examples section (before the claims) of the instant specification. Tables 1-2 are provided as separate ASCII text files. Tables 1-4 are described above. Tables 5-19, 24, and 28-29 are provided within the Examples section of the instant specification below and are described there. Thus, this section describes Tables 20-23 and 25-27.

Table 20 provides unadjusted additive and genotypic association with DVT for 149 SNPs that were tested in both MEGA-1 and LETS, and were associated with DVT in both of these sample sets (p-value cutoff <=0.05 in MEGA-1 and p-value cutoff <=0.1 in LETS, in at least one model).

Table 21 provides unadjusted association of 92 SNPs with DVT in LETS (p<=0.05) that have not yet been tested in the MEGA-1 sample set.

Table 22 provides unadjusted association of 9 SNPs with DVT in MEGA-1 (p<=0.05) that have not yet been tested in the LETS sample set.

Table 23 provides age- and sex-adjusted association with DVT for 41 SNPs that were tested in the three sample sets LETS, MEGA-1, and MEGA-2.

See Example Five below regarding Tables 20-23.

Table 25 provides age- and sex-adjusted association with isolated pulmonary embolism (PE) for 52 SNPs in MEGA-1 and MEGA-2 combined (p-value cutoff <=0.05). See Example Seven below.

Table 26 provides age- and sex-adjusted association with cancer-related DVT for 31 SNPs in MEGA-1 and MEGA-2 combined (p-value cutoff <=0.05). The SNPs provided in Table 26 had a p-value cutoff <=0.05 when comparing individuals (cases) in the MEGA-1 and MEGA-2 studies who had both cancer (of any type) and DVT compared with individuals (controls) who had neither cancer nor DVT. See Example Eight below.

Table 27 provides additive association with DVT for 123 SNPs in LETS (p-value cutoff <=0.1 in LETS). Linkage disequilibrium data from Hapmap is also provided for each SNP. The SNPs in Table 27 are based on fine-mapping/linkage disequilibrium analysis around the following target genes and SNPs (as indicated in Table 27): gene AKT3 (SNP hCV233148), gene SERPINC1 (SNP hCV16180170), gene RGS7 (SNP hCV916107), gene NR1I2 (SNP hCV263841), gene FGG (SNP hCV11503469), gene CYP4V2 (SNP hCV25990131), gene GP6 (SNP hCV8717873), and gene F9 (SNP hCV596331). See Example Nine below.

The following abbreviations may be used throughout the tables: "cnt"=count, "frq"=frequency, "dom"=dominant, "rec"=recessive, "gen"=genotypic, "add"=additive, "annot"=annotation (description), "genot"=genotype, and "Control RAF"=risk allele frequency in controls.

Throughout the tables, "HR" or "HRR" refers to the hazard ratio, "OR" refers to the odds ratio, terms such as "90% CI" or "95% CI" refer to the 90% or 95% confidence interval (respectively) for the hazard ratio or odds ratio, and terms such as "OR95l" and "OR95u" refer to the lower and upper 95% confidence intervals (respectively) for the odds ratio ("CI"/ "confidence interval" and "CL"/"confidence limit" may be used herein interchangeably). Hazard ratios ("HR" or "HRR") or odds ratios (OR) that are greater than one indicate that a given allele (or combination of alleles such as a haplotype or diplotype) is a risk allele (which may also be referred to as a susceptibility allele), whereas hazard ratios or odds ratios that are less than one indicate that a given allele is a non-risk allele (which may also be referred to as a protective allele). For a given risk allele, the other alternative allele at the SNP position (which can be derived from the information provided in Tables 1-2, for example) may be considered a non-risk allele. For a given non-risk allele, the other alternative allele at the SNP position may be considered a risk allele.

Thus, with respect to disease risk (e.g., VT), if the risk estimate (odds ratio or hazard ratio) for a particular allele at a SNP position is greater than one, this indicates that an individual with this particular allele has a higher risk for the disease than an individual who has the other allele at the SNP position. In contrast, if the risk estimate (odds ratio or hazard ratio) for a particular allele is less than one, this indicates that an individual with this particular allele has a reduced risk for the disease compared with an individual who has the other allele at the SNP position.

DETAILED DESCRIPTION OF THE INVENTION

Figure 1:
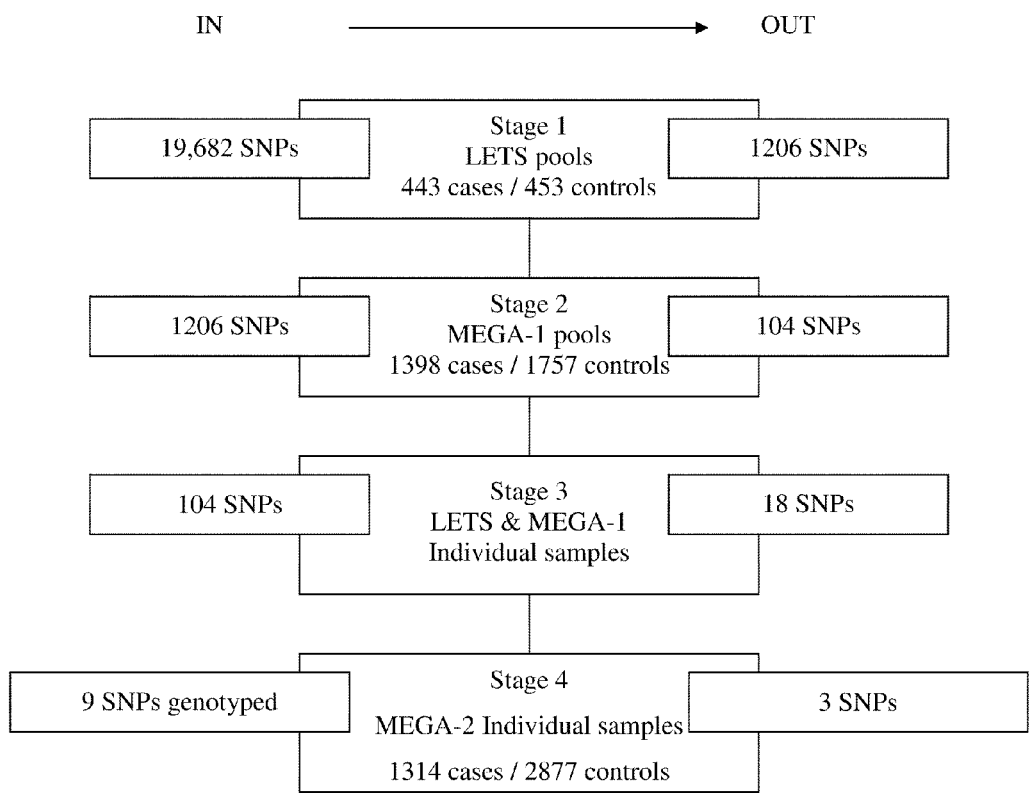
FIG. 1 shows a flowchart of the approach used to identify SNPs associated with DVT. On the left, the "IN" box indicates the number of SNPs genotyped in each stage. On the right, the "OUT" box indicates the number of SNPs associated with DVT in each stage (P<0.05). To conserve MEGA-2 DNA in Stage 4, SNPs were genotyped using multiplexed oligo ligation assays, and assays for only 9 of the 18 Stage 3 SNPs were available in multiplex format at the time of this study.

The present invention provides SNPs associated with VT, nucleic acid molecules containing SNPs, methods and reagents for the detection of the SNPs disclosed herein, uses of these SNPs for the development of detection reagents, and assays or kits that utilize such reagents. The VT-associated SNPs disclosed herein are useful for diagnosing, screening for, and evaluating predisposition to VT and related pathologies in humans. Furthermore, such SNPs and their encoded products are useful targets for the development of therapeutic agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with VT, as well as combinations of SNPs and haplotypes in genetic regions associated with VT, polymorphic/variant transcript sequences (SEQ ID NOS: 1-125) and genomic sequences (SEQ ID NOS: 404-601) containing SNPs, encoded amino acid sequences (SEQ ID NOS: 126-250), and both transcript-based SNP context sequences (SEQ ID NOS: 251-403) and genomic-based SNP context sequences (SEQ ID NOS: 602-1587) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing VT, methods of screening for compounds useful for treating disorders associated with a variant gene/protein such as VT, compounds identified by these screening methods, methods of using the disclosed SNPs to select a treatment strategy, methods of treating a disorder associated with a variant gene/protein (i.e., therapeutic methods), methods of determining if an individual is likely to respond to a specific treatment and methods of using the SNPs of the present invention for human identification.

The present invention provides novel SNPs associated with VT, as well as SNPs that were previously known in the art, but were not previously known to be associated with VT. Accordingly, the present invention provides novel compositions and methods based on the novel SNPs disclosed herein, and also provides novel methods of using the known, but previously unassociated, SNPs in methods relating to VT (e.g., for diagnosing VT, etc.). In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD). Novel SNPs for which the SNP source is only "Applera" and none other, i.e., those that have not been observed in any public databases and which were also not observed during shotgun sequencing and assembly of the Celera human genome sequence (i.e., "Celera" SNP source), are also noted in the tables.

Particular SNP alleles of the present invention can be associated with either an increased risk of having or developing VT, or a decreased risk of having or developing VT. SNP alleles that are associated with a decreased risk of having or developing VT may be referred to as "protective" alleles, and SNP alleles that are associated with an increased risk of having or developing VT may be referred to as "susceptibility" alleles, "risk" alleles, or "risk factors". Thus, whereas certain SNPs (or their encoded products) can be assayed to determine whether an individual possesses a SNP allele that is indicative of an increased risk of having or developing VT (i.e., a susceptibility allele), other SNPs (or their encoded products) can be assayed to determine whether an individual possesses a SNP allele that is indicative of a decreased risk of having or developing VT (i.e., a protective allele). Similarly, particular SNP alleles of the present invention can be associated with either an increased or decreased likelihood of responding to a particular treatment or therapeutic compound, or an increased or decreased likelihood of experiencing toxic effects from a particular treatment or therapeutic compound. The term "altered" may be used herein to encompass either of these two possibilities (e.g., an increased or a decreased risk/likelihood).

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type," "reference," or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e., a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide," "peptide," and "protein" are used interchangeably.

As used herein, an "allele" may refer to a nucleotide at a SNP position (wherein at least two alternative nucleotides exist in the population at the SNP position, in accordance with the inherent definition of a SNP) or may refer to an amino acid residue that is encoded by the codon which contains the SNP position (where the alternative nucleotides that are present in the population at the SNP position form alternative codons that encode different amino acid residues). An "allele" may also be referred to herein as a "variant". Also, an amino acid residue that is encoded by a codon containing a particular SNP may simply be referred to as being encoded by the SNP.

A phrase such as "as represented by", "as shown by", "as symbolized by", or "as designated by" may be used herein to refer to a SNP within a sequence (e.g., a polynucleotide context sequence surrounding a SNP), such as in the context of "a polymorphism as represented by position 101 of SEQ ID NO:X or its complement". Typically, the sequence surrounding a SNP may be recited when referring to a SNP, however the sequence is not intended as a structural limitation beyond the specific SNP position itself. Rather, the sequence is recited merely as a way of referring to the SNP (in this example, "SEQ ID NO:X or its complement" is recited in order to refer to the SNP located at position 101 of SEQ ID NO:X, but SEQ ID NO:X or its complement is not intended as a structural limitation beyond the specific SNP position itself). A SNP is a variation at a single nucleotide position and therefore it is customary to refer to context sequence (e.g., SEQ ID NO:X in this example) surrounding a particular SNP position in order to uniquely identify and refer to the SNP. Alternatively, a SNP can be referred to by a unique identification number such as a public "rs" identification number or an internal "hCV" identification number, such as provided herein for each SNP (e.g., in Tables 1-2).

With respect to an individual's risk for a disease (e.g., based on the presence or absence of one or more SNPs disclosed herein in the individual's nucleic acid), terms such as "assigning" or "designating" may be used herein to characterize the individual's risk for the disease.

As used herein, the term "benefit" (with respect to a preventive or therapeutic drug treatment) is defined as achieving a reduced risk for a disease that the drug is intended to treat or prevent (e.g., VT) by administrating the drug treatment, compared with the risk for the disease in the absence of receiving the drug treatment (or receiving a placebo in lieu of the drug treatment) for the same genotype. The term "benefit" may be used herein interchangeably with terms such as "respond positively" or "positively respond".

As used herein, the terms "drug" and "therapeutic agent" are used interchangeably, and may include, but are not limited to, small molecule compounds, biologics (e.g., antibodies, proteins, protein fragments, fusion proteins, glycoproteins, etc.), nucleic acid agents (e.g., antisense, RNAi/siRNA, and microRNA molecules, etc.), vaccines, etc., which may be used for therapeutic and/or preventive treatment of a disease (e.g., VT).

The various methods described herein, such as correlating the presence or absence of a polymorphism with an altered (e.g., increased or decreased) risk (or no altered risk) for VT, can be carried out by automated methods such as by using a computer (or other apparatus/devices such as biomedical devices, laboratory instrumentation, or other apparatus/devices having a computer processor) programmed to carry out any of the methods described herein. For example, computer software (which may be interchangeably referred to herein as a computer program) can perform the step of correlating the presence or absence of a polymorphism in an individual with an altered (e.g., increased or decreased) risk (or no altered risk) for VT for the individual. Computer software can also perform the step of correlating the presence or absence of a polymorphism in an individual with the predicted response of the individual to a therapeutic agent or other type of treatment. Accordingly, certain embodiments of the invention provide a computer (or other apparatus/device) programmed to carry out any of the methods described herein.

Reports, Programmed Computers, Business Methods, and Systems

The results of a test (e.g., an individual's risk for VT, or an individual's predicted drug responsiveness, based on assaying one or more SNPs disclosed herein, and/or an individual's allele(s)/genotype at one or more SNPs disclosed herein, etc.), and/or any other information pertaining to a test, may be referred to herein as a "report". A tangible report can optionally be generated as part of a testing process (which may be interchangeably referred to herein as "reporting", or as "providing" a report, "producing" a report, or "generating" a report).

Examples of tangible reports may include, but are not limited to, reports in paper (such as computer-generated printouts of test results) or equivalent formats and reports stored on computer readable medium (such as a CD, USB flash drive or other removable storage device, computer hard drive, or computer network server, etc.). Reports, particularly those stored on computer readable medium, can be part of a database, which may optionally be accessible via the internet (such as a database of patient records or genetic information stored on a computer network server, which may be a "secure database" that has security features that limit access to the report, such as to allow only the patient and the patient's medical practioners to view the report while preventing other unauthorized individuals from viewing the report, for example). In addition to, or as an alternative to, generating a tangible report, reports can also be displayed on a computer screen (or the display of another electronic device or instrument).

A report can include, for example, an individual's risk for VT, or may just include the allele(s)/genotype that an individual carries at one or more SNPs disclosed herein, which may optionally be linked to information regarding the significance of having the allele(s)/genotype at the SNP (for example, a report on computer readable medium such as a network server may include hyperlink(s) to one or more journal publications or websites that describe the medical/biological implications, such as increased or decreased disease risk, for individuals having a certain allele/genotype at the SNP). Thus, for example, the report can include disease risk or other medical/biological significance (e.g., drug responsiveness, etc.) as well as optionally also including the allele/genotype information, or the report may just include allele/genotype information without including disease risk or other medical/biological significance (such that an individual viewing the report can use the allele/genotype information to determine the associated disease risk or other medical/biological significance from a source outside of the report itself, such as from a medical practioner, publication, website, etc., which may optionally be linked to the report such as by a hyperlink).

A report can further be "transmitted" or "communicated" (these terms may be used herein interchangeably), such as to the individual who was tested, a medical practitioner (e.g., a doctor, nurse, clinical laboratory practitioner, genetic counselor, etc.), a healthcare organization, a clinical laboratory, and/or any other party or requester intended to view or possess the report. The act of "transmitting" or "communicating" a report can be by any means known in the art, based on the format of the report. Furthermore, "transmitting" or "communicating" a report can include delivering a report ("pushing") and/or retrieving ("pulling") a report. For example, reports can be transmitted/communicated by various means, including being physically transferred between parties (such as for reports in paper format) such as by being physically delivered from one party to another, or by being transmitted electronically or in signal form (e.g., via e-mail or over the internet, by facsimile, and/or by any wired or wireless communication methods known in the art) such as by being retrieved from a database stored on a computer network server, etc.

In certain exemplary embodiments, the invention provides computers (or other apparatus/devices such as biomedical devices or laboratory instrumentation) programmed to carry out the methods described herein. For example, in certain embodiments, the invention provides a computer programmed to receive (i.e., as input) the identity (e.g., the allele(s) or genotype at a SNP) of one or more SNPs disclosed herein and provide (i.e., as output) the disease risk (e.g., an individual's risk for VT) or other result (e.g., disease diagnosis or prognosis, drug responsiveness, etc.) based on the identity of the SNP(s). Such output (e.g., communication of disease risk, disease diagnosis or prognosis, drug responsiveness, etc.) may be, for example, in the form of a report on computer readable medium, printed in paper form, and/or displayed on a computer screen or other display.

In various exemplary embodiments, the invention further provides methods of doing business (with respect to methods of doing business, the terms "individual" and "customer" are used herein interchangeably). For example, exemplary methods of doing business can comprise assaying one or more SNPs disclosed herein and providing a report that includes, for example, a customer's risk for VT (based on which allele(s)/genotype is present at the assayed SNP(s)) and/or that includes the allele(s)/genotype at the assayed SNP(s) which may optionally be linked to information (e.g., journal publications, websites, etc.) pertaining to disease risk or other biological/medical significance such as by means of a hyperlink (the report may be provided, for example, on a computer network server or other computer readable medium that is internet-accessible, and the report may be included in a secure database that allows the customer to access their report while preventing other unauthorized individuals from viewing the report), and optionally transmitting the report. Customers (or another party who is associated with the customer, such as the customer's doctor, for example) can request/order (e.g., purchase) the test online via the internet (or by phone, mail order, at an outlet/store, etc.), for example, and a kit can be sent/delivered (or otherwise provided) to the customer (or another party on behalf of the customer, such as the customer's doctor, for example) for collection of a biological sample from the customer (e.g., a buccal swab for collecting buccal cells), and the customer (or a party who collects the customer's biological sample) can submit their biological samples for assaying (e.g., to a laboratory or party associated with the laboratory such as a party that accepts the customer samples on behalf of the laboratory, a party for whom the laboratory is under the control of (e.g., the laboratory carries out the assays by request of the party or under a contract with the party, for example), and/or a party that receives at least a portion of the customer's payment for the test). The report (e.g., results of the assay including, for example, the customer's disease risk and/or allele(s)/genotype at the assayed SNP(s)) may be provided to the customer by, for example, the laboratory that assays the SNP(s) or a party associated with the laboratory (e.g., a party that receives at least a portion of the customer's payment for the assay, or a party that requests the laboratory to carry out the assays or that contracts with the laboratory for the assays to be carried out) or a doctor or other medical practitioner who is associated with (e.g., employed by or having a consulting or contracting arrangement with) the laboratory or with a party associated with the laboratory, or the report may be provided to a third party (e.g., a doctor, genetic counselor, hospital, etc.) which optionally provides the report to the customer. In further embodiments, the customer may be a doctor or other medical practitioner, or a hospital, laboratory, medical insurance organization, or other medical organization that requests/orders (e.g., purchases) tests for the purposes of having other individuals (e.g., their patients or customers) assayed for one or more SNPs disclosed herein and optionally obtaining a report of the assay results.

In certain exemplary methods of doing business, kits for collecting a biological sample from a customer (e.g., a buccal swab for collecting buccal cells) are provided (e.g., for sale), such as at an outlet (e.g., a drug store, pharmacy, general merchandise store, or any other desirable outlet), online via the internet, by mail order, etc., whereby customers can obtain (e.g., purchase) the kits, collect their own biological samples, and submit (e.g., send/deliver via mail) their samples to a laboratory which assays the samples for one or more SNPs disclosed herein (such as to determine the customer's risk for VT) and optionally provides a report to the customer (of the customer's disease risk based on their SNP genotype(s), for example) or provides the results of the assay to another party (e.g., a doctor, genetic counselor, hospital, etc.) which optionally provides a report to the customer (of the customer's disease risk based on their SNP genotype(s), for example).

Certain further embodiments of the invention provide a system for determining an individual's DVT risk, or whether an individual will benefit from a drug treatment (or other therapy) in reducing DVT risk. Certain exemplary systems comprise an integrated "loop" in which an individual (or their medical practitioner) requests a determination of such individual's VT risk (or drug response, etc.), this determination is carried out by testing a sample from the individual, and then the results of this determination are provided back to the requester. For example, in certain systems, a sample (e.g., blood or buccal cells) is obtained from an individual for testing (the sample may be obtained by the individual or, for example, by a medical practitioner), the sample is submitted to a laboratory (or other facility) for testing (e.g., determining the genotype of one or more SNPs disclosed herein), and then the results of the testing are sent to the patient (which optionally can be done by first sending the results to an intermediary, such as a medical practioner, who then provides or otherwise conveys the results to the individual and/or acts on the results), thereby forming an integrated loop system for determining an individual's DVT risk (or drug response, etc.). The portions of the system in which the results are transmitted (e.g., between any of a testing facility, a medical practitioner, and/or the individual) can be carried out by way of electronic or signal transmission (e.g., by computer such as via e-mail or the internet, by providing the results on a website or computer network server which may optionally be a secure database, by phone or fax, or by any other wired or wireless transmission methods known in the art). Optionally, the system can further include a risk reduction component (i.e., a disease management system) as part of the integrated loop (for an example of a disease management system, see U.S. Pat. No. 6,770,029, "Disease management system and method including correlation assessment"). For example, the results of the test can be used to reduce the risk of the disease in the individual who was tested, such as by implementing a preventive therapy regimen (e.g., administration of a drug regimen such as an anticoagulant and/or antiplatelet agent for reducing DVT risk), modifying the individual's diet, increasing exercise, reducing stress, and/or implementing any other physiological or behavioral modifications in the individual with the goal of reducing disease risk. For reducing DVT risk, this may include any means used in the art for improving cardiovascular health. Thus, in exemplary embodiments, the system is controlled by the individual and/or their medical practioner in that the individual and/or their medical practioner requests the test, receives the test results back, and (optionally) acts on the test results to reduce the individual's disease risk, such as by implementing a disease management component.

Isolated Nucleic Acid Molecules and SNP Detection Reagents & Kits

Tables 1 and 2 provide a variety of information about each SNP of the present invention that is associated with VT, including the transcript sequences (SEQ ID NOS: 1-125), genomic sequences (SEQ ID NOS: 404-601), and protein sequences (SEQ ID NOS: 126-250) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS: 251-403 correspond to transcript-based SNP context sequences disclosed in Table 1, and SEQ ID NOS: 602-1587 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Isolated nucleic acid molecules containing one or more SNPs disclosed in at least one of Tables 1-2 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated". Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are referred to in Table 1 and provided in the Sequence Listing (SEQ ID NOS: 1-125), and polymorphic genomic sequences are referred to in Table 2 and provided in the Sequence Listing (SEQ ID NOS: 404-601). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences as disclosed in Tables 1-2 (transcript sequences are referred to in Table 1 as SEQ ID NOS: 1-125, genomic sequences are referred to in Table 2 as SEQ ID NOS: 404-601, transcript-based SNP context sequences are referred to in Table 1 as SEQ ID NO: 251-403, and genomic-based SNP context sequences are referred to in Table 2 as SEQ ID NO: 602-1587) and their complements. The actual sequences referred to in the tables are provided in the Sequence Listing. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; *PCR Technology: Principles and Applications for DNA Amplification*, ed. H. A. Erlich, Freeman Press, NY, N.Y., 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA) (U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are referred to in Table 1 as SEQ ID NOS: 1-125, genomic sequences are referred to in Table 2 as SEQ ID NOS: 404-601, transcript-based SNP context sequences are referred to in Table 1 as SEQ ID NO: 251-403, and genomic-based SNP context sequences are referred to in Table 2 as SEQ ID NO: 602-1587), or any nucleic acid molecule that encodes any of the variant proteins referred to in Table 1 (SEQ ID NOS: 126-250). The actual sequences referred to in the tables are provided in the Sequence Listing. A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences referred to in Table 1 and/or Table 2 (transcript sequences are referred to in Table 1 as SEQ ID NOS:1-125, genomic sequences are referred to in Table 2 as SEQ ID NOS: 404-601, transcript-based SNP context sequences are referred to in Table 1 as SEQ ID NO: 251-403, and genomic-based SNP context sequences are referred to in Table 2 as SEQ ID NO: 602-1587), or any nucleic acid molecule that encodes any of the variant proteins referred to in Table 1 (SEQ ID NOS: 126-250). The actual sequences referred to in the tables are provided in the Sequence Listing. A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are referred to in Table 1 as SEQ ID NOS: 1-125, genomic sequences are referred to in Table 2 as SEQ ID NOS: 404-601, transcript-based SNP context sequences are referred to in Table 1 as SEQ ID NO: 251-403, and genomic-based SNP context sequences are referred to in Table 2 as SEQ ID NO: 602-1587), or any nucleic acid molecule that encodes any of the variant proteins provided in Table 1 (SEQ ID NOS: 126-250). The actual sequences referred to in the tables are provided in the Sequence Listing. A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol.* 1997 June; 15(6):224-9, and Hyrup et al., "Peptide nucleic acids (PNA): synthesis, properties and potential applications", *Bioorg Med Chem.* 1996 January; 4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences referred to and shown in Tables 1-2, and can encode a polypeptide that varies to some degree from the specific polypeptide sequences referred to in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgap-dna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol. Biol.* 25, 365-389 (1994)) and KERR (Dufresne et al., *Nat Biotechnol* 2002 December; 20(12):1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (referred to in Table 1 as SEQ ID NOS: 1-125), genomic sequences (referred to in Table 2 as SEQ ID NOS: 404-601), and context sequences (transcript-based context sequences are referred to in Table 1 as SEQ ID NOS: 251-403; genomic-based context sequences are provided in Table 2 as SEQ ID NOS: 602-1587), can be used for the design of SNP detection reagents. The actual sequences referred to in the tables are provided in the Sequence Listing. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs referred to in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences referred to in Table 1 and/or Table 2 (transcript-based context sequences are referred to in Table 1 as SEQ ID NOS: 251-403; genomic-based context sequences are referred to in Table 2 as SEQ ID NOS: 602-1587). Another example of a detection reagent is a primer that acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS: 1-125), genomic sequences (SEQ ID NOS: 404-601), and SNP context sequences (transcript-based context sequences are referred to in Table 1 as SEQ ID NOS: 251-403; genomic-based context sequences are referred to in Table 2 as SEQ ID NOS: 602-1587) disclosed in the Sequence Listing and in Tables 1-2. The actual sequences referred to in the tables are provided in the Sequence Listing. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm that starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides that detect single nucleotide variations in target sequences may be referred to by such terms as "allele-specific oligonucleotides", "allele-specific probes", or "allele-specific primers". The design and use of allele-specific probes for analyzing polymorphisms is described in, e.g., *Mutation Detection A Practical Approach*, ed. Cotton et al. Oxford University Press, 1998; Saiki et al., *Nature* 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: prehybridization with a solution containing 5× standard saline phosphate EDTA (SSPE), 0.5% $NaDodSO_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment that is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are limited to, the phosphotriester method described by Narang et al., 1979, Methods in Enzymology 68:90; the phosphodiester method described by Brown et al., 1979, Methods in Enzymology 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118, 801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays," "microarrays," and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; *Nat. Biotech.* 14: 1675-1680) and Schena, M. et al. (1996; *Proc. Natl. Acad. Sci.* 93: 10614-10619), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", *Biotechnol Annu Rev.* 2002; 8:85-101; Sosnowski et al., "Active microelectronic array system for DNA hybridization, genotyping and pharmacogenomic applications", *Psychiatr Genet.* 2002 December; 12(4): 181-92; Heller, "DNA microarray technology: devices, systems, and applications", *Annu Rev Biomed Eng.* 2002; 4:129-53. Epub 2002 Mar. 22; Kolchinsky et al., "Analysis of SNPs and other genomic variations using gel-based chips", *Hum Mutat.* 2002 April; 19(4):343-60; and McGall et al., "High-density gene-chip oligonucleotide probe arrays", *Adv Biochem Eng Biotechnol.* 2002; 77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, Current Protocols in Molecular Biology, John Wiley & Sons, N.Y. (1989), 6.3.1-6.3.6.

In other embodiments, the arrays are used in conjunction with chemiluminescent detection technology. The following patents and patent applications, which are all hereby incorporated by reference, provide additional information pertaining to chemiluminescent detection: U.S. patent application Ser. Nos. 10/620,332 and 10/620,333 describe chemiluminescent approaches for microarray detection; U.S. Pat. Nos. 6,124,478, 6,107,024, 5,994,073, 5,981,768, 5,871,938, 5,843,681, 5,800,999, and 5,773,628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application W095/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", Adv Drug Deliv Rev. 2003 Feb. 24; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. Nos. 6,153,073, Dubrow et al., and 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially in the diagnosis and treatment of VT. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule referred to in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is at risk for VT or has developed early stage VT. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences referred to in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in screening for VT or related pathologies, or determining predisposition thereto, or determining responsiveness to a form of treatment, or in genome mapping or SNP association analysis, etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5(2):43-60; Shi, "Technologies for individual genotyping: detection of genetic polymorphisms in drug targets and disease genes", *Am J Pharmacogenomics.* 2002; 2(3): 197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May; 6(3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al, *Meth. Enzymol.* 217:286-295 (1992)), comparison of the electrophoretic mobility of variant and wild type nucleic acid molecules (Orita et al., *PNAS* 86:2766 (1989); Cotton et al., *Mutat. Res.* 285:125-144 (1993); and Hayashi et al., *Genet. Anal Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in diagnostic assays for VT and related pathologies, and can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6,054,564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array; U.S. application Ser. No. 01/17329 (and Ser. No. 09/584,905) describes OLA (or LDR) followed by PCR, wherein zipcodes are incorporated into OLA probes, and amplified PCR products are determined by electrophoretic or universal zipcode array readout; U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003; 17(11): 1195-202.

The following references provide further information describing mass spectrometry-based methods for SNP genotyping: Bocker, "SNP and mutation discovery using base-specific cleavage and MALDI-TOF mass spectrometry", *Bioinformatics.* 2003 July; 19 Suppl 1:I44-I53; Storm et al., "MALDI-TOF mass spectrometry-based SNP genotyping", *Methods Mol Biol.* 2003; 212:241-62; Jurinke et al., "The use of Mass ARRAY technology for high throughput genotyping", *Adv Biochem Eng Biotechnol.* 2002; 77:57-74; and Jurinke et al., "Automated genotyping using the DNA MassArray technology", *Methods Mol Biol.* 2002; 187:179-92.

SNPs can also be scored by direct DNA sequencing. A variety of automated sequencing procedures can be utilized ((1995) *Biotechniques* 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730x1 DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad*. Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W.H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (*Genetic Data Analysis*, Weir B., Sinauer (1990)).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $r^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score." In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the P value of the tests reaches that level. In an exploratory analysis where positive hits will be followed up in subsequent confirmatory testing, an unadjusted P value<0.2 (a significance level on the lenient side), for example, may be used for generating hypotheses for significant association of a SNP with certain phenotypic characteristics of a disease. It is preferred that a p-value<0.05 (a significance level traditionally used in the art) is achieved in order for a SNP to be considered to have an association with a disease. It is more preferred that a p-value<0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wide error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (*The Elements of Statistical Learning*, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the risk allele(s).

The SNPs of the invention may contribute to the development of VT in an individual in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose," "diagnosis," and "diagnostics" include, but are not limited to any of the following: detection of VT that an individual may presently have, predisposition/susceptibility screening (i.e., determining the increased risk of an individual in developing VT in the future, or determining whether an individual has a decreased risk of developing VT in the future), determining a particular type or subclass of VT in an individual known to have VT, confirming or reinforcing a previously made diagnosis of VT, pharmacogenomic evaluation of an individual to determine which therapeutic strategy that individual is most likely to positively respond to or to predict whether a patient is likely to respond to a particular treatment, predicting whether a patient is likely to experience toxic effects from a particular treatment or therapeutic compound, and evaluating the future prognosis of an individual having VT. Such diagnostic uses are based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium." In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for diagnosing VT (e.g., has a significant statistical association with the condition and/or is recognized as a causative polymorphism for the condition), then the skilled artisan would recognize that other SNP sites which are in LD with this SNP site would also be useful for diagnosing the condition. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., VT) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1-2, for example.

Linkage disequilibrium in the human genome is reviewed in: Wall et al., "Haplotype blocks and linkage disequilibrium in the human genome", *Nat Rev Genet.* 2003 August; 4(8): 587-97; Garner et al., "On selecting markers for association studies: patterns of linkage disequilibrium between two and three diallelic loci", *Genet Epidemiol.* 2003 January; 24(1): 57-67; Ardlie et al., "Patterns of linkage disequilibrium in the human genome", *Nat Rev Genet.* 2002 April; 3(4):299-309 (erratum in *Nat Rev Genet* 2002 July; 3(7):566); and Remm et al., "High-density genotyping and linkage disequilibrium in the human genome using chromosome 22 as a model"; *Curr Opin Chem Biol.* 2002 February; 6(1):24-30; Haldane J B S (1919) The combination of linkage values, and the calculation of distances between the loci of linked factors. J Genet. 8:299-309; Mendel, G. (1866) Versuche über Pflanzen-Hybriden. Verhandlungen des naturforschenden Vereines in Brünn (Proceedings of the Natural History Society of Brünn]; Lewin B (1990) *Genes IV*. Oxford University Press, New York, USA; Hartl D L and Clark A G (1989) *Principles of Population Genetics* 2$^{nd}$ ed. Sinauer Associates, Inc. Sunderland, Mass., USA; Gillespie J H (2004) *Population Genetics: A Concise Guide.* 2$^{nd}$ ed. Johns Hopkins University Press. USA; Lewontin R C (1964). The interaction of selection and linkage. I. General considerations; heterotic models. Genetics 49:49-67; Hoel P G (1954) *Introduction to Mathematical Statistics* 2$^{nd}$ ed. John Wiley & Sons, Inc. New York, USA; Hudson R R (2001) Two-locus sampling distributions and their application. Genetics 159:1805-1817; Dempster A P, Laird N M, Rubin D B (1977) Maximum likelihood from incomplete data via the EM algorithm. J R Stat Soc 39:1-38; Excoffier L, Slatkin M (1995) Maximum-likelihood estimation of molecular haplotype frequencies in a diploid population. Mol Biol Evol 12(5):921-927; Tregouet D A, Escolano S, Tiret L, Mallet A, Golmard J L (2004) A new algorithm for haplotype-based association analysis: the Stochastic-EM algorithm. Ann Hum Genet. 68(Pt 2):165-177; Long A D and Langley C H (1999) The power of association studies to detect the contribution of candidate genetic loci to variation in complex traits. Genome Research 9:720-731; Agresti A (1990) *Categorical Data Analysis*. John Wiley & Sons, Inc. New York, USA; Lange K (1997) *Mathematical and Statistical Methods for Genetic Analysis*. Springer-Verlag New York, Inc. New York, USA; The International HapMap Consortium (2003) The International HapMap Project. Nature 426:789-796; The International HapMap Consortium (2005) A haplotype map of the human genome. Nature 437:1299-1320; Thorisson G A, Smith A V, Krishnan L, Stein L D (2005), The International HapMap Project Web Site. Genome Research 15:1591-1593; McVean G, Spencer C C A, Chaix R (2005) Perspectives on human genetic variation from the HapMap project. PLoS Genetics 1(4):413-418; Hirschhorn J N, Daly M J (2005) Genome-wide association studies for common diseases and complex traits. Nat Genet 6:95-108; Schrodi S J (2005) A probabilistic approach to large-scale association scans: a semi-Bayesian method to detect disease-predisposing alleles. SAGMB 4(1):31; Wang W Y S, Barratt B J, Clayton D G, Todd J A (2005) Genome-wide association studies: theoretical and practical concerns. Nat Rev Genet 6:109-118. Pritchard J K, Przeworski M (2001) Linkage disequilibrium in humans: models and data. Am J Hum Genet 69:1-14.

As discussed above, one aspect of the present invention is the discovery that SNPs which are in certain LD distance with the interrogated SNP can also be used as valid markers for identifying an increased or decreased risks of having or developing VT. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

The $r^2$ value between any two or more SNPs can be obtained from databases such as the HapMap. For instance, if the $r^2$ value between SNP1 and SNP2 is 0.8 (assuming 0.8 is used as a threshold), then these two SNPs are in LD with each other, thus leading one to conclude that if SNP1 is associated with a disease, then SNP2 will be associated with the disease as well.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1, A_1B_2, A_2B_1$ and $A_2B_2$. Denote the frequencies of these four haplotypes with the following notation.

$$P_{11} = \text{freq}(A_1B_1) \quad (1)$$

$$P_{12} = \text{freq}(A_1B_2) \quad (2)$$

$$P_{21} = \text{freq}(A_2B_1) \quad (3)$$

$$P_{22} = \text{freq}(A_2B_2) \quad (4)$$

The allele frequencies at the two markers are then the sum of different haplotype frequencies, it is straightforward to write down a similar set of equations relating single-marker allele frequencies to two-marker haplotype frequencies:

$$p_1 = \text{freq}(A_1) = P_{11} + P_{12} \quad (5)$$

$$p_2 = \text{freq}(A_2) = P_{21} + P_{22} \quad (6)$$

$$q_1 = \text{freq}(B_1) = P_{11} + P_{21} \quad (7)$$

$$q_2 = \text{freq}(B_2) = P_{12} + P_{22} \quad (8)$$

Note that the four haplotype frequencies and the allele frequencies at each marker must sum to a frequency of 1.

$$P_{11} + P_{12} + P_{21} + P_{22} = 1 \quad (9)$$

$$p_1 + p_2 = 1 \quad (10)$$

$$q_1 + q_2 = 1 \quad (11)$$

If there is no correlation between the alleles at the two markers, one would expect that the frequency of the haplotypes would be approximately the product of the composite alleles. Therefore, $$P_{11} \approx p_1 q_1 \quad (12)$$

$$P_{12} \approx p_1 q_2 \quad (13)$$

$$P_{21} \approx p_2 q_1 \quad (14)$$

$$P_{22} \approx p_2 q_2 \quad (15)$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D = P_{11} - p_1 q_1 \quad (16)$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D = P_{11}P_{22} - P_{12}P_{21} \quad (17)$$

If one transforms D by squaring it and subsequently dividing by the product of the allele frequencies of $A_1, A_2, B_1$ and $B_2$, the resulting quantity, called $r^2$, is equivalent to the square of the Pearson's correlation coefficient commonly used in statistics (e.g. Hoel, 1954).

$$r^2 = \frac{D^2}{p_1 p_2 q_1 q_2} \quad (18)$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2 = 1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs} = \text{freq}(A_1 \text{ in cases}) \quad (19)$$

$$p_{2,cs} = \text{freq}(A_2 \text{ in cases}) \quad (20)$$

$$q_{1,cs} = \text{freq}(B_1 \text{ in cases}) \quad (21)$$

$$q_{2,cs} = \text{freq}(B_2 \text{ in cases}) \quad (22)$$

Similarly, $$p_{1,ct} = \text{freq}(A_1 \text{ in controls}) \quad (23)$$

$$p_{2,ct} = \text{freq}(A_2 \text{ in controls}) \quad (24)$$

$$q_{1,ct} = \text{freq}(B_1 \text{ in controls}) \quad (25)$$

$$q_{2,ct} = \text{freq}(B_2 \text{ in controls}) \quad (26)$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al (1977). This algorithm is often used in genetics to infer haplotype frequencies from genotype data (e.g. Excoffier and Slatkin, 1995; Tregouet et al, 2004). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley, 1999). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs} + N_{ct}}; \tag{27}$$

where $N_{cs}$ and $N_{ct}$ are the numbers of diploid cases and controls, respectively. This is necessary to handle situations where the numbers of cases and controls are not equivalent. For equal case and control sample sizes, $N_{cs}=N_{ct}=N$, the value of the effective number of chromosomes is simply $n=2N$—as expected. Let power be calculated for a significance level $\alpha$ (such that traditional P-values below $\alpha$ will be deemed statistically significant). Define the standard Gaussian distribution function as $\Phi(\cdot)$. Mathematically, $$\Phi(x) = \frac{1}{\sqrt{2\pi}} \int_{-\infty}^{x} e^{-\frac{\theta^2}{2}} d\theta \tag{28}$$

Alternatively, the following error function notation (Erf) may also be used, $$\Phi(x) = \frac{1}{2}\left[1 + \text{Erf}\left(\frac{x}{\sqrt{2}}\right)\right] \tag{29}$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by $\beta$ the error rate for not detecting truly disease-associated markers. Therefore, $1-\beta$ is the classical definition of statistical power. Substituting the Pritchard-Pzreworski result into the sample size, the power to detect disease association at a significance level of $\alpha$ is given by the approximation $$1 - \beta \cong \Phi\left[\frac{|q_{1,cs} - q_{1,ct}|}{\sqrt{\frac{q_{1,cs}(1 - q_{1,cs}) + q_{1,ct}(1 - q_{1,ct})}{r^2 n}}} - Z_{1-\alpha/2}\right]; \tag{30}$$

where $Z_u$ is the inverse of the standard normal cumulative distribution evaluated at U ($u\in(0,1)$). $Z_u=\Phi^{-1}(u)$, where $\Phi$ ($\Phi^{-1}(u))=\Phi^{-1}(\Phi(u))=u$. For example, setting $\alpha=0.05$, and therefore $1-\alpha/2=0.975$, $Z_{0.975}=1.95996$ is obtained. Next, setting power equal to a threshold of a minimum power of T, $$T = \Phi\left[\frac{|q_{1,cs} - q_{1,ct}|}{\sqrt{\frac{q_{1,cs}(1 - q_{1,cs}) + q_{1,ct}(1 - q_{1,ct})}{r^2 n}}} - Z_{1-\alpha/2}\right] \tag{31}$$

and solving for $r^2$, the following threshold $r^2$ is obtained:

$$r_T^2 = \frac{[q_{1,cs}(1 - q_{1,cs}) + q_{1,ct}(1 - q_{1,ct})]}{n(q_{1,cs} - q_{1,ct})^2}[\Phi^{-1}(T) + Z_{1-\alpha/2}] \tag{32}$$

Or, $$r_T^2 = \left(\frac{Z_T + Z_{1-\alpha/2}}{n}\right)\left[\frac{q_{1,cs} - (q_{1,cs})^2 + q_{1,ct} - (q_{1,ct})^2}{(q_{1,cs} - q_{1,ct})^2}\right] \tag{33}$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2=0.489$ given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

The contribution or association of particular SNPs and/or SNP haplotypes with disease phenotypes, such as VT, enables the SNPs of the present invention to be used to develop superior diagnostic tests capable of identifying individuals who express a detectable trait, such as VT, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with VT might indicate a probability of 20% that an individual has or is at risk of developing VT, whereas detection of five SNPs, each of which correlates with VT, might indicate a probability of 80% that an individual has or is at risk of developing VT. To further increase the accuracy of diagnosis or predisposition screening, analysis of the SNPs of the present invention can be combined with that of other polymorphisms or other risk factors of VT, such as disease symptoms, pathological characteristics, family history, diet, environmental factors or lifestyle factors.

It will, of course, be understood by practitioners skilled in the treatment or diagnosis of VT that the present invention generally does not intend to provide an absolute identification of individuals who are at risk (or less at risk) of developing VT, and/or pathologies related to VT, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to VT.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, Nature 405, 857-865 (2000); Gould Rothberg, Nature Biotechnology 19, 209-211 (2001); Eichelbaum, Clin. Exp. Pharmacol. Physiol. 23(10-11):983-985 (1996); and Linder, Clin. Chem. 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating VT. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms", *Methods Mol Med.* 2003; 85:225-37. Pharmacogenomics as it relates to Alzheimer's disease and other neurodegenerative disorders is discussed in Cacabelos, "Pharmacogenomics for the treatment of dementia", *Ann Med.* 2002; 34(5):357-79, Maimone et al., "Pharmacogenomics of neurodegenerative diseases", *Eur J. Pharmacol.* 2001 Feb. 9; 413(1): 11-29, and Poirier, "Apolipoprotein E: a pharmacogenetic target for the treatment of Alzheimer's disease", *Mol Diagn.* 1999 December; 4(4):335-41. Pharmacogenomics as it relates to cardiovascular disorders is discussed in Siest et al., "Pharmacogenomics of drugs affecting the cardiovascular system", *Clin Chem Lab Med.* 2003 April; 41(4):590-9, Mukherjee et al., "Pharmacogenomics in cardiovascular diseases", *Prog Cardiovasc Dis.* 2002 May-June; 44(6):479-98, and Mooser et al., "Cardiovascular pharmacogenetics in the SNP era", *J Thromb Haemost.* 2003 July; 1(7):1398-402. Pharmacogenomics as it relates to cancer is discussed in McLeod et al., "Cancer pharmacogenomics: SNPs, chips, and the individual patient", *Cancer Invest.* 2003; 21(4):630-40 and Watters et al., "Cancer pharmacogenomics: current and future applications", *Biochim Biophys Acta.* 2003 Mar. 17; 1603(2):99-111.

The SNPs of the present invention also can be used to identify novel therapeutic targets for VT. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Layery et al., "Antisense and RNAi: powerful tools in drug target discovery and validation", *Curr Opin Drug Discov Devel.* 2003 July; 6(4):561-9; Stephens et al., "Antisense oligonucleotide therapy in cancer", *Curr Opin Mol Ther.* 2003 April; 5(2): 118-22; Kurreck, "Antisense technologies. Improvement through novel chemical modifications", *Eur J Biochem.* 2003 April; 270(8):1628-44; Dias et al., "Antisense oligonucleotides: basic concepts and mechanisms", *Mol Cancer Ther.* 2002 March; 1(5):347-55; Chen, "Clinical development of antisense oligonucleotides as anti-cancer therapeutics", *Methods Mol Med.* 2003; 75:621-36; Wang et al., "Antisense anticancer oligonucleotide therapeutics", *Curr Cancer Drug Targets.* 2001 November; 1(3):177-96; and Bennett, "Efficiency of antisense oligonucleotide drug discovery", *Antisense Nucleic Acid Drug Dev.* 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as VT, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs (Thompson, *Drug Discovery Today*, 7 (17): 912-917 (2002)). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference", *Nat Biotechnol.* 2004 March; 22(3):326-30. Epub 2004 Feb. 1; Chi et al., "Genomewide view of gene silencing by small interfering RNAs", *PNAS* 100(11):6343-6346, 2003; Vickers et al., "Efficient Reduction of Target RNAs by Small Interfering RNA and RNase H-dependent Antisense Agents", *J. Biol. Chem.* 278: 7108-7118, 2003; Agami, "RNAi and related mechanisms and their potential use for therapy", *Curr Opin Chem Biol.* 2002 December; 6(6):829-34; Layery et al., "Antisense and RNAi: powerful tools in drug target discovery and validation", *Curr Opin Drug Discov Devel.* 2003 July; 6(4):561-9; Shi, "Mammalian RNAi for the masses", *Trends Genet* 2003 January; 19(1):9-12), Shuey et al., "RNAi: gene-silencing in therapeutic intervention", *Drug Discovery Today* 2002 October; 7(20): 1040-1046; McManus et al., *Nat Rev Genet* 2002 October; 3(10): 737-47; Xia et al., *Nat Biotechnol* 2002 October; 20(10): 1006-10; Plasterk et al., *Curr Opin Genet Dev* 2000 October; 10(5):562-7; Bosher et al., *Nat Cell Biol* 2000 February; 2(2):E31-6; and Hunter, *Curr Biol* 1999 Jun. 17; 9(12):R440-2).

A subject suffering from a pathological condition, such as VT, ascribed to a SNP may be treated so as to correct the genetic defect (see Kren et al., *Proc. Natl. Acad. Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat VT. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a VT patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as VT that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For instance, an aspect of the present invention includes selecting individuals for clinical trials based on their SNP genotype. For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular VT patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine,* 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine,* 2002 March; S30-S36).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the VT-associated proteins, and encoding nucleic acid molecules, disclosed herein can be used as therapeutic targets (or directly used themselves as therapeutic compounds) for treating VT and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, $18^{th}$ ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of an VT-associated protein can be administered in combination with another agent that inhibits or stimulates the activity of the same or a different VT-associated protein to thereby counteract the affects of VT.

For further information regarding pharmacology, see Current Protocols in Pharmacology, John Wiley & Sons, Inc., N.Y.

Human Identification Applications

In addition to their diagnostic and therapeutic uses in VT and related pathologies, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med.* 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry," *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationally more stable than repeat polymorphisms. SNPs are not susceptible to artifacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June; 20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, *Stanford Technology Law Review* and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found in, for example, *Current Protocols in Human Genetics*, John Wiley & Sons, N.Y. (2002), 14.1-14.7.

VARIANT PROTEINS, ANTIBODIES, VECTORS, HOST CELLS, & USES THEREOF

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are referred to as SEQ ID NOS: 126-250 in Table 1 and provided in the Sequence Listing. These variants will generally be referred to herein as variant proteins/peptides/polypeptides, or polymorphic proteins/peptides/polypeptides of the present invention. The terms "protein," "peptide," and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons that contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol*. 2003 January; 60(5):523-33. Epub 2002 Nov. 7; Graddis et al., "Designing proteins that work using recombinant technologies", *Curr Pharm Biotechnol*. 2002 December; 3(4):285-97; and Nilsson et al., "Affinity fusion strategies for detection, purification, and immobilization of recombinant proteins", *Protein Expr Purif*. 1997 October; 11 (1): 1-16.

The present invention also relates to further obvious variants of the variant polypeptides of the present invention, such as naturally-occurring mature forms (e.g., alleleic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., *Science* 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol.* 224:899-904 (1992); de Vos et al. *Science* 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties*, 2nd Ed., T. E. Creighton, W. H. Freeman and Company, New York (1993); Wold, F., *Posttranslational Covalent Modification of Proteins*, B. C. Johnson, Ed., Academic Press, New York 1-12 (1983); Seifter et al., *Meth. Enzymol.* 182: 626-646 (1990); and Rattan et al., *Ann. N.Y. Acad. Sci.* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS: 126-250. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing VT or for determining predisposition to VT in a human. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with VT that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun. 15; 71(12):294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., *Nature* 354:82-84 (1991); Houghten et al., *Nature* 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., *Cell* 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, *Bio/technology*, 1992, Sep. 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as VT. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc. Natl. Acad. Sci. USA*, 81:6851, 1984; Neuberger et al., *Nature* 312:604, 1984), a humanized antibody (U.S. Pat. Nos. 5,693,762; 5,585,089; and 5,565,332), a single-chain Fv (U.S. Pat. No. 4,946,778; Ward et al., *Nature* 334:544, 1989), a bispecific antibody with two binding specificities (Segal et al., *J. Immunol. Methods* 248:1, 2001; Carter, *J. Immunol. Methods* 248:7, 2001), a diabody, a triabody, and a tetrabody (Todorovska et al., *J. Immunol. Methods*, 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, *Nature*, 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., *J. Immunol.*, 169:595, 2002). Fd phage and Fd phagemid technologies may be used to generate and select recombinant antibodies in vitro (Hoogenboom and Chames, *Immunol. Today* 21:371, 2000; Liu et al., *J. Mol. Biol.* 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Antibodies, particularly the use of antibodies as therapeutic agents, are reviewed in: Morgan, "Antibody therapy for Alzheimer's disease," *Expert Rev Vaccines.* 2003 February; 2(1):53-9; Ross et al., "Anticancer antibodies," *Am J Clin Pathol.* 2003 April; 119(4):472-85; Goldenberg, "Advancing role of radiolabeled antibodies in the therapy of cancer," *Cancer Immunol Immunother.* 2003 May; 52(5):281-96. Epub 2003 Mar. 11; Ross et al., "Antibody-based therapeutics in oncology," *Expert Rev Anticancer Ther.* 2003 February; 3(1): 107-21; Cao et al., "Bispecific antibody conjugates in therapeutics," *Adv Drug Deliv Rev.* 2003 Feb. 10; 55(2):171-97; von Mehren et al., "Monoclonal antibody therapy for cancer," *Annu Rev Med.* 2003; 54:343-69. Epub 2001 Dec. 3; Hudson et al., "Engineered antibodies," *Nat Med.* 2003 January; 9(1):129-34; Brekke et al., "Therapeutic antibodies for human diseases at the dawn of the twenty-first century," *Nat Rev Drug Discov.* 2003 January; 2(1):52-62 (Erratum in: *Nat Rev Drug Discov.* 2003 March; 2(3):240); Houdebine, "Antibody manufacture in transgenic animals and comparisons with other systems," *Curr Opin Biotechnol.* 2002 December; 13(6):625-9; Andreakos et al., "Monoclonal antibodies in immune and inflammatory diseases," *Curr Opin Biotechnol.* 2002 December; 13(6):615-20; Kellermann et al., "Antibody discovery: the use of transgenic mice to generate human monoclonal antibodies for therapeutics," *Curr Opin Biotechnol.* 2002 December; 13(6):593-7; Pini et al., "Phage display and colony filter screening for high-throughput selection of antibody libraries," *Comb Chem High Throughput Screen.* 2002 November; 5(7):503-10; Batra et al., "Pharmacokinetics and biodistribution of genetically engineered antibodies," *Curr Opin Biotechnol.* 2002 December; 13(6):603-8; and Tangri et al., "Rationally engineered proteins or antibodies with absent or reduced immunogenicity," *Curr Med Chem.* 2002 December; 9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as VT. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, particularly VT. Antibodies specific for a variant protein encoded by a SNP-containing nucleic acid molecule of the present invention can be used to assay for the presence of the variant protein, such as to screen for predisposition to VT as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., *Cytokine* 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli*, *Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kurjan et al., Cell 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (Seed, B. *Nature* 329:840 (1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al *PNAS* 89:6232-6236 (1992)). Another example of a recombinase system is the FLP recombinase system of *S. cerevisiae* (O'Gorman et al. *Science* 251: 1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems," *Curr Opin Biotechnol.* 2002 December; 13(6):625-9; Petters et al., "Transgenic animals as models for human disease," *Transgenic Res.* 2000; 9(4-5):347-51; discussion 345-6; Wolf et al., "Use of transgenic animals in understanding molecular mechanisms of toxicity," *J Pharm Pharmacol.* 1998 June; 50(6):567-74; Echelard, "Recombinant protein production in transgenic animals," *Curr Opin Biotechnol.* 1996 October; 7(5):536-40; Houdebine, "Transgenic animal bioreactors," *Transgenic Res.* 2000; 9(4-5):305-20; Pirity et al., "Embryonic stem cells, creating transgenic animals," *Methods Cell Biol.* 1998; 57:279-93; and Robl et al., "Artificial chromosome vectors and expression of complex proteins in transgenic animals," *Theriogenology.* 2003 Jan. 1; 59(1):107-13.

EXAMPLES

The following examples are offered to illustrate, but not to limit, the claimed invention.

Example One

SNPs Associated with Deep Vein Thrombosis

Introduction

To identify SNPs associated with DVT, 19,682 SNPs (which were primarily missense SNPs) were investigated for association with DVT in three large case-control studies.

Methods

Study Populations and Data Collection

The 3 studies (LETS, MEGA-1 and MEGA-2) in the present analysis are derived from 2 large population-based case-control studies: the Leiden Thrombophilia Study (LETS) and the Multiple Environmental and Genetic Assessment of risk factors for venous thrombosis (MEGA study) (Koster et al., *Lancet* 1993; 342(8886-8887):1503-1506 and Blom et al., *JAMA* 2005; 293(6):715-722). These studies were approved by the Medical Ethics Committee of the Leiden University Medical Center, Leiden, The Netherlands. All participants gave informed consent to participate.

LETS Population

Collection and ascertainment of DVT events in LETS has been described previously (Koster et al., *Lancet* 1993; 342 (8886-8887):1503-1506). Briefly, 474 consecutive patients, 70 years or younger, without a known malignancy were recruited between Jan. 1, 1988 and Dec. 30, 1992 from 3 anticoagulation clinics in The Netherlands. For each patient, an age- and sex-matched control participant without a history of DVT was enrolled. Participants completed a questionnaire on risk factors for DVT and provided a blood sample. No ethnicity information was collected. After exclusion of 52 participants due to inadequate sample, 443 cases and 453 controls remained in the analyses.

MEGA-1 and MEGA-2 Studies

Collection and ascertainment of DVT events in MEGA has been described previously (Blom et al., *JAMA* 2005; 293(6): 715-722; van Stralen et al., *Arch Intern Med* 2008; 168(1): 21-26). MEGA enrolled consecutive patients aged 18 to 70 years who presented with their first diagnosis of DVT or pulmonary embolism (PE) at any of 6 anticoagulation clinics in The Netherlands between Mar. 1, 1999 and May 31, 2004. Control subjects included partners of patients and random population control subjects frequency-matched on age and sex to the patient group. Participants completed a questionnaire on risk factors for DVT and provided a blood or buccal swab sample. The questionnaire included an item on parent birth country as a proxy for ethnicity.

For the present analyses, the MEGA study was split to form 2 case-control studies, based on recruitment date and sample availability (blood or buccal swab). Individuals with isolated pulmonary embolism or a history of malignant disorders were excluded in order to obtain a study population similar to the LETS population. The first subset of MEGA, "MEGA-1", included 1398 cases and 1757 controls who had all donated blood samples. The remaining 1314 cases and 2877 controls, who donated either a blood sample or a buccal swab sample, were included in "MEGA-2".

Baseline characteristics of the participants in the studies described above are presented in Table 5.

SNP Association Study

The 19,682 SNPs tested in this study are located in 10,887 genes and were selected because of their potential to affect gene function or expression (Shiffman et al., *Am J Hum Genet* 2005; 77(4):596-605). Most SNPs (69%) are missense. Another 24% of the SNPs are located in transcription factor binding sites or in untranslated regions of mRNA, which could affect mRNA expression or stability. 91% of the SNPs studied have minor allele frequencies$\geq$5% in whites.

The design of the SNP association study is presented in FIG. 1. First, all 19,682 SNPs were tested in pooled DNA samples of LETS. SNPs that were associated with DVT ($P \leq 0.05$) were tested in pooled DNA samples of MEGA-1. SNPs that were associated in both LETS and MEGA-1 pools ($P \leq 0.05$) were confirmed by genotyping individual samples of LETS and MEGA-1. SNP genotypes consistently associated with DVT in LETS and MEGA-1 ($P \leq 0.05$) were genotyped in MEGA-2.

Allele Frequency and Genotype Determination

DNA concentrations were standardized to 10 ng/µL using PicoGreen (Molecular Probes, Invitrogen Corp, Carlsbad, Calif.) fluorescent dye. DNA pools, typically of 30-100 samples, were assembled based on case-control status, sex, age and factor V Leiden status. DNA pools were made by mixing equal volumes of standardized DNA solution from each individual sample. Each allele was amplified separately by PCR using 3 ng of pooled DNA. In the pooled stage, 6 case pools and 4 control pools were used for LETS, and 13 case pools and 18 control pools were used for MEGA-1. Allele frequencies in pooled DNA were determined by kinetic polymerase chain reaction (kPCR) (Germer et al., *Genome Res* 2000; 10(2):258-266). Duplicate kPCR assays were run for each allele and the amplification curves from these assays were used to calculate the allele frequencies of the SNP (Germer et al., *Genome Res* 2000; 10(2):258-266). Genotyping of individual DNA samples was similarly performed using 0.3 ng of DNA in kPCR assays or using multiplexed oligo ligation assays (OLA) (Shiffman et al., *Arterioscler Thromb Vasc Biol* 2008; 28(1):173-179). Genotyping accuracy of the multiplex methodology and kPCR has been assessed in 3 previous studies and the overall concordance of the genotype calls from these two methods was >99% (Shiffman et al., *Am J Hum Genet* 2005; 77(4):596-605; Iakoubova et al., *Arterioscler Thromb Vasc Biol* 2006; 26(12):2763-2768; and Shiffman et al., *Arterioscler Thromb Vasc Biol* 2006; 26(7):1613-1618). The SNPs associated with DVT in MEGA-2 were successfully genotyped in >95% of the subjects in LETS, MEGA-1 and MEGA-2.

Gene Variants and DVT Risk in the CYP4V2 Region

The rs13146272 SNP in the gene CYP4V2 was most strongly associated with DVT in the SNP association study. To investigate whether other SNPs in this region are associated with DVT, results from the HapMap Project were used to identify a region surrounding rs13146272 (chr 4:187,297, 249-187,467,731) (*Nature* 2005; 437(7063):1299-1320). This region contained 149 SNPs with allele frequencies>2% (HapMap NCBI build 36). Allele frequencies and linkage disequilibrium were calculated from the SNP genotypes in the HapMap CEPH population, which includes Utah residents with ancestry from northern and western Europe. 48 of these 149 SNPs were selected for genotyping, as surrogates for 142 of the 149 SNPs in this region that were either directly genotyped or in strong linkage disequilibrium ($r^2 > 0.8$) with at least one of the 48 genotyped SNPs (the remaining 7 of the 149 SNPs were in low linkage disequilibrium with rs13146272 ($r^2 < 0.2$) and therefore not likely to be the cause of the observed association). The 48 SNPs were chosen using pairwise tagging in Tagger (implemented in Haploview) (Barrett et al., *Bioinformatics* 2005; 21(2):263-265).

The 48 SNPs were initially investigated in LETS, and SNPs that were equally or more strongly associated with DVT than rs13146272 were investigated in MEGA-1.

Factor XI Assays

Factor XI antigen measurements in LETS were described previously (Meijers et al., *N Engl J Med* 2000; 342(10):696-701). In MEGA, factor XI levels were measured on a STA-R coagulation analyzer (Diagnostica Stago, Asnières, France). STA CaCl$_2$ solution was used as an activator, STA Unicalibrator was used as a reference standard and Preciclot plus I (normal factor XI range) was used as control plasma. The intra-assay coefficient of variation (CV) was 5.8% (10 assays). The inter-assay CV was 8.7% (48 assays).

Statistical Analysis

Deviations from Hardy-Weinberg expectations were assessed using an exact test in controls (Weir, *Genetic Data Analysis II Sunderland: Sinauer Associates Inc* 1996). For pooled DNA analysis, a Fisher's exact test was used to evaluate allele frequency differences between cases and controls. For the final set of SNPs presented in Table 6, logistic regression models were used to calculate the odds ratio (OR), 95% confidence interval (95% CI) and 2-sided P-value for the association of each SNP with DVT and to adjust for age and sex. For each SNP, the OR per genotype relative to non-carriers of the risk allele, and the risk allele OR from an additive model, were calculated. This risk allele OR can be interpreted as the risk increase per copy of the risk allele, and the corresponding P-value was used to decide whether the SNP was associated with DVT (P≦0.05). For SNPs on the X chromosome the analysis was conducted separately in men and women.

The OR (95% CI) for SNPs in the CYP4V2 region was estimated by logistic regression with adjustment for factor XI levels and other SNPs in the region. Differences in factor XI level between groups were tested with t-tests, and changes in factor XI level per allele were estimated by linear regression. Analyses were done with SAS version 9 and SPSS for Windows, 14.0.2 (SPSS Inc, Chicago, Ill.).

False Discovery Rate

Studies of thousands of SNPs can lead to false-positive associations. Therefore, 2 replications were performed after the initial discovery stage in LETS and the false discovery rate was calculated for the SNPs genotyped in MEGA-2. The false discovery rate estimates the expected fraction of false positives among a group of SNPs; and is a function of the P-values and the number of tests (Benjamini et al., *Journal of the Royal Statistical Society* 1995; (Serials B(57)):1289-1300). False discovery rates were estimated using the 2-sided, unadjusted P-value from the additive model. A false discovery rate of 0.10 was used as a criterion for further analysis (for a false discovery rate of 0.10, one would expect 10% of the SNPs in the group considered associated to be false positives).

Results

SNPs Associated with DVT in LETS and MEGA-1

In LETS 19,682 SNPs were investigated by comparing the allele frequencies of patients and controls using pooled DNA samples (Germer et al., *Genome Res* 2000; 10(2):258-266). It was found that 1206 of these 19,682 SNPs were associated (P≦0.05) with DVT. These 1206 SNPs were then investigated in patients and controls from MEGA-1 using pooled DNA samples. SNPs that were associated with DVT in both LETS and MEGA-1 were confirmed by genotyping in both studies, and it was found that 18 SNPs were consistently (with the same risk allele) associated with DVT (P≦0.05) in both LETS and MEGA-1 (Table 6).

SNPs Associated with DVT in MEGA-2

Nine of these 18 SNPs were subsequently tested in MEGA-2 for association with DVT (Table 7); assays for the other 9 SNPs were not available at the time. The genotypes of these 9 SNPs did not deviate from Hardy-Weinberg equilibrium (P≦0.01) in the LETS and MEGA controls.

To account for the many tests, the false discovery rate was estimated for the SNPs tested in MEGA-2. In Table 6, factor V Leiden and the prothrombin G20210A mutation are presented for reference, but since these variants were not included in the SNP association study, their false discovery rate was not calculated. For the SNP in F9 (rs6048), only men were included because no association with DVT was observed in women in LETS and MEGA-1. It was found that 3 SNPs were again associated with DVT in MEGA-2 (P<0.05), with false discovery rates≦0.10. These 3 SNPs were in the genes CYP4V2, SERPINC1 and GP6. The 4 SNPs with the next lowest P-values (ranging from 0.06 to 0.15) also had low false discovery rates (≦0.20). These SNPs were in the genes RGS7, NR1I2, NAT8B and F9. The risk allele frequencies for these 7 SNPs ranged from 10% to 82% among the controls. The OR for homozygous carriers, compared with homozygotes of the other allele, ranged from 1.19 to 1.49. The 2 SNPs most strongly associated with DVT were in CYP4V2 (rs13146272, P<0.001, false discovery rate 0.0006) and SERPINC1 (rs2227589, P<0.001, false discovery rate 0.004).

For the two SNPs on chromosome 1 (rs2227589 and rs670659), linkage disequilibrium with the factor V Leiden (FVL) variant was investigated. The SNP (rs2227589) in SERPINC1, which encodes antithrombin, is 4.37 megabases away from the FVL variant. The SNP in RGS7 (rs670659) is 71.48 megabases from FVL. Each was in weak linkage-disequilibrium with FVL ($r^2$<0.01). Restricting analyses to non-carriers of FVL did not appreciably change the risk estimate of either SNP.

SNPs in CYP4V2 Region and DVT Risk

The SNP with the strongest association with DVT was rs13146272, located in the gene encoding a member of the cytochrome P450 family 4 (CYP4V2). 48 SNPs in this region were genotyped in the LETS population and the OR for DVT per copy of the risk-increasing allele was estimated. For many of the 48 SNPs, including rs13146272, the common allele was the risk allele. In LETS, rs13146272 had an OR for DVT of 1.22 (95% CI, 1.00-1.49). Higher ORs were observed for 9 of the other SNPs tested in this region. These SNPs were located in the CYP4V2, KLKB1 (coding for prekallikrein) and F11 (coding for coagulation factor XI) genes.

9 of the 48 SNPs that had an OR>1.22 (the OR of rs13146272) were then selected and investigated in MEGA-1. It was found that 5 of these SNPs were associated with DVT in both LETS and MEGA-1: rs13146272, rs3087505, rs3756008, rs2036914 and rs4253418 (Table 8). The rs3087505 SNP in KLKB1 had the highest risk estimate: OR 3.61 (95% CI, 1.48-8.82) for the major allele homozygotes versus minor allele homozygotes. Mutual adjustment among these 5 SNPs did not indicate that any of these 5 associations were explained by the other 4 SNPs.

SNPs in CYP4V2 Region and Factor XI Levels

Because the F11 gene is located close to rs13146272 and because factor XI levels have been previously reported to be associated with DVT in the LETS population, it was investigated whether an association between SNPs and factor XI levels explained the association between the SNPs and DVT (Meijers et al., *N Engl J Med* 2000; 342(10):696-701). In LETS, factor XI levels above the $90^{th}$ percentile had been shown to be associated with a 2-fold increased risk of DVT (Meijers et al., *N Engl J Med* 2000; 342(10):696-701). It was found that high factor XI levels (>$90^{th}$ percentile) were also associated with DVT in MEGA (OR 1.9, 95% CI, 1.6-2.3).

Only 9 of the 18 stage 3 SNPs were indeed tested in MEGA-2 DNA in stage 4. The reason for this was that in order to save MEGA-2 DNA, stage 4 SNPs were genotyped using multiplexed oligo ligation assays, and assays for only 9 stage 3 SNPs were available at the time of this study.

The 7 SNPs from the CYP4V2 region that were associated with DVT were all associated with factor XI levels in LETS and MEGA-1, with higher factor XI levels for those who carried the risk-increasing alleles (Table 8). It was investigated whether factor XI levels mediate the association between these 5 SNPs and DVT by adjusting for factor XI levels in the combined LETS and MEGA-1 studies. For all 5 SNPs, adjustment for factor XI levels weakened the association with DVT but none of the associations disappeared. Interestingly, the 5 SNPs that were not associated with DVT in the combined analysis of LETS and MEGA-1 (rs3736456, rs4253259, rs4253408, rs4253325 and rs3775302) were also not associated with factor XI levels in LETS.

All analyses were performed with and without adjustment for age and sex, and analyses in MEGA-1 and MEGA-2 were performed with and without restriction to the group with both parents born in North-West Europe. As neither influenced the results, the unadjusted OR is presented.

Discussion

7 SNPs were identified that were associated with DVT in 3 large, well characterized populations including 3155 cases and 5087 controls. The evidence was strongest for the 3 SNPs in CYP4V2, SERPINC1 and GP6. It is interesting to note that these SNPs are in or near genes that have a clear role in blood coagulation.

Testing 19,682 SNPs will result in false positive associations. Therefore, the SNPs were investigated in 3 large studies and the false discovery rate for the SNPs tested was estimated in the third study. The three SNPs in CYP4V2, SERPINC1 and GP6, were associated with DVT with a false discovery rate<10%, which means that <10% of these 3 SNPs would be expected to be false positive. Relaxing the false discovery rate to <20% would add 4 SNPs, in RGS7, NR1I2, NAT8B, and F9 as associated with DVT.

The 3 SNPs with the strongest evidence for association with DVT were in CYP4V2, SERPINC1, and GP6. CYP4V2 encodes a member of the CYP450 family 4 that is not known to be related to thrombosis (Lee et al., *Invest Opthalmol Vis Sci* 2001; 42(8):1707-1714 and Li et al., *Am J Hum Genet* 2004; 74(5):817-826). CYP4V2 is located on chromosome 4 in a region containing genes encoding coagulation proteins prekallikrein (KLKB1) and factor XI (F11). 4 other SNPs in the CYPV42/KLKB1/F11 locus were also identified as being associated with DVT. No previous reports exist for an association of genetic variants in CYP4V2 and KLKB1 with DVT. There exists no evidence for an association between prekallikrein levels and DVT, while there is for elevated factor XI levels (Souto et al., *Am J Hum Genet* 2000; 67(6):1452-1459; Meijers et al., *N Engl J Med* 2000; 342(10):696-701; and Gallimore et al., *Thromb Res* 2004; 114(2):91-96).

SERPINC1 encodes antithrombin, a serine protease inhibitor located on chromosome 1 that plays a central role in natural anticoagulation. Deficiencies of antithrombin are rare but result in a strong thrombotic tendency (Gallimore et al., *Thromb Res* 2004; 114(2):91-96). The SNP in SERPINC1 (rs2227589) had a minor allele frequency of 10% in the controls and was associated with a modest thrombotic tendency. GP6 encodes glycoprotein VI, a 58-kD platelet membrane glycoprotein that plays a crucial role in the collagen-induced activation and aggregation of platelets and may play a role in DVT (Massberg et al., *J Exp Med* 2003; 197(1):41-49 and Chung et al., *J Thromb Haemost* 2007; 5(5):918-924).

The SNPs in the genes F9, NR1I2, RGS7 and NA T8B are of interest. F9 encodes factor IX, a vitamin K-dependent clotting factor, of which high levels have been shown to increase the risk of DVT (van Hylckama Vlieg et al., *Blood* 2000; 95(12):3678-3682). The SNP rs6048, also known as F9 Malmö, is a common polymorphism at the third amino acid residue of the activation peptide of factor IX (McGraw et al., *Proc Natl Acad Sci U S A* 1985; 82(9):2847-2851).

The SNP in CYP4V2 (rs13146272) is located close to the gene encoding coagulation factor XI. Factor XI levels have been reported to be associated with DVT in LETS and in a large analysis of pedigrees (Souto et al., *Am J Hum Genet* 2000; 67(6):1452-1459 and Meijers et al., *N Engl J Med* 2000; 342(10):696-701). The association between DVT and factor XI levels was confirmed in MEGA. Interestingly, the 5 SNPs in the CYP4V2 region that were associated with DVT in both LETS and MEGA-1 were also associated with factor XI levels. However, the association between these 5 SNPs and DVT does not seem to be completely explained by variation in factor XI levels because adjusting for factor XI level did not remove the excess DVT risk of these 5 SNPs. Thus, if only part of the risk associated with these genetic variants is mediated through levels of factor XI, some of the risk might also be due to effects on protein function.

Several variants in the F11 gene (rs5974, rs5970, rs5971, rs5966, rs5976, and rs5973) were previously tested for association with factor XI levels in patients with DVT and atherosclerosis, but no relationship was observed (Gerdes et al., *J Thromb Haemost* 2004; 2(6): 1015-1017). In the present study, rs5974 ($r^2$=1.0 with 5970) and rs5971 ($r^2$=1.0 with 5966 and rs5976) were not associated with DVT in LETS. rs5973 was not genotyped because its minor allele frequency was lower than 2% (HapMap CEPH population). In a study of West African volunteers, rs3822056 and rs3733403 were associated with transcription factor binding affinity and slightly increased factor XI levels, but neither SNP was associated with DVT in LETS. In a study among white postmenopausal women, rs3822057 and rs2289252 were associated with DVT (Tarumi et al., *J Thromb Haemost* 2003; 1(8):1854-1856 and Smith et al., *JAMA* 2007; 297(5):489-498). Both of these associations were indirectly confirmed in the present study because 2 of the 5 SNPs in the CYPV42 region that were consistently associated with DVT and factor XI levels are in linkage disequilibrium with rs3822057 ($r^2$=0.9 with rs2036914) and rs2289252 ($r^2$=0.8 with rs3756008).

Since the variants described herein are common, they may be particularly useful markers for determining DVT risk, especially when combined with other risk factors.

This analysis was limited to a North-West European population. In LETS, no information on ethnicity was collected. However, it is thought that population stratification did not bias the results because MEGA participants were recruited from the same population as LETS but 10 years later and 90% of MEGA had both parents born in North-West Europe. Furthermore, restricting the analyses to this 90% of MEGA did not modify the results.

Conclusions

Thousands of SNPs were tested for association with DVT in unrelated individuals, and 7 of these SNPs were found to be consistently associated with DVT risk. In the CYP4V2 region, several SNPs were identified that were associated with both DVT and factor XI levels.

TABLE 5

Characteristics of Cases and Controls in LETS, MEGA-1, and MEGA-2

|  | LETS | | MEGA-1 | | MEGA-2 | |
| --- | --- | --- | --- | --- | --- | --- |
|  | Cases (n = 443) | Controls (n = 453) | Cases (n = 1398) | Controls (n = 1757) | Cases (n = 1314) | Controls (n = 2877) |
| Men, No. (%) | 190 (43) | 192 (42) | 652 (47) | 843 (48) | 633 (48) | 1348 (47) |
| Age, Mean (SD) | 45 (14) | 45 (14) | 47 (13) | 48 (12) | 48 (13) | 47 (12) |
| Both parents born in North-West Europe, N (%)[a] | — | — | 1247 (91) | 1609 (92) | 1149 (90) | 2527 (89) |

[a]No information on birth country was collected in LETS.

TABLE 6

Association of 18 SNPs from the SNP association study and factor V Leiden and prothrombin G20210A with DVT in LETS and MEGA-1.

| Chr | Gene | SNP ID | SNP Type[a] | Study | Risk allele | Case (%) | Control (%) | OR[b] | (95% CI) | P-Value |
|---|---|---|---|---|---|---|---|---|---|---|
| 3 | NR1I2 | rs1523127 | 5'UTR | LETS | C | 373 (42) | 300 (33) | 1.44 | (1.19-1.73) | <.001 |
|   |   |   |   | MEGA-1 |   | 1185 (42) | 1373 (39) | 1.15 | (1.04-1.27) | .008 |
| 19 | GP6 | rs1613662 | Ser219Pro | LETS | A | 749 (85) | 725 (80) | 1.36 | (1.07-1.74) | .01 |
|   |   |   |   | MEGA-1 |   | 2318 (84) | 2823 (81) | 1.21 | (1.06-1.38) | .004 |
| 17 | APOH | rs1801690 | Ser335Trp | LETS | C | 850 (97) | 852 (95) | 1.65 | (1.02-2.68) | .04 |
|   |   |   |   | MEGA-1 |   | 2676 (96) | 3312 (94) | 1.42 | (1.12-1.79) | .004 |
| 2 | NAT8B | rs2001490 | Ala112Gly | LETS | C | 382 (43) | 348 (38) | 1.23 | (1.01-1.49) | .04 |
|   |   |   |   | MEGA-1 |   | 1118 (40) | 1301 (37) | 1.14 | (1.03-1.26) | .01 |
| 1 | SERPINC1 | rs2227589 | Intronic | LETS | T | 105 (12) | 78 (9) | 1.42 | (1.04-1.94) | .03 |
|   |   |   |   | MEGA-1 |   | 303 (11) | 313 (9) | 1.24 | (1.05-1.47) | .01 |
| 7 | MET | rs2237712 | Intronic | LETS | G | 45 (5) | 27 (3) | 1.68 | (1.05-2.70) | .03 |
|   |   |   |   | MEGA-1 |   | 119 (4) | 110 (3) | 1.38 | (1.06-1.80) | .02 |
| 11 | EPS8L2 | rs3087546 | Leu101Leu | LETS | T | 522 (60) | 487 (54) | 1.26 | (1.04-1.52) | .02 |
|   |   |   |   | MEGA-1 |   | 1637 (59) | 1964 (56) | 1.12 | (1.01-1.24) | .03 |
| 6 | CASP8AP2 | rs369328 | Lys93Lys | LETS | A | 461 (52) | 406 (45) | 1.35 | (1.11-1.63) | .002 |
|   |   |   |   | MEGA-1 |   | 1420 (51) | 1680 (48) | 1.13 | (1.02-1.24) | .02 |
| 1 | SELP | rs6131 | Asn331Ser | LETS | T | 196 (22) | 161 (18) | 1.29 | (1.03-1.62) | .03 |
|   |   |   |   | MEGA-1 |   | 589 (21) | 636 (18) | 1.21 | (1.06-1.36) | .003 |
| 19 | ZNF544 | rs6510130 | Asp203His | LETS | G | 33 (4) | 13 (1) | 2.54 | (1.34-4.83) | .004 |
|   |   |   |   | MEGA-1 |   | 78 (3) | 64 (2) | 1.56 | (1.11-2.18) | .01 |
| 1 | RGS7 | rs670659 | Intronic | LETS | C | 617 (70) | 584 (64) | 1.27 | (1.04-1.54) | .02 |
|   |   |   |   | MEGA-1 |   | 1864 (67) | 2249 (64) | 1.13 | (1.01-1.25) | .03 |
| 2 | TACR1 | rs881 | 3'UTR | LETS | C | 745 (85) | 713 (80) | 1.38 | (1.07-1.77) | .01 |
|   |   |   |   | MEGA-1 |   | 2356 (85) | 2894 (83) | 1.15 | (1.01-1.32) | .04 |
| 4 | CYP4V2 | rs13146272 | Lys259Gln | LETS | A | 611 (69) | 588 (65) | 1.22 | (1.00-1.49) | .05 |
|   |   |   |   | MEGA-1 |   | 1896 (68) | 2245 (64) | 1.19 | (1.07-1.32) | .001 |
| 1 | F5 | rs4524 | Arg858Lys | LETS | T | 708 (80) | 671 (74) | 1.36 | (1.09-1.69) | .006 |
|   |   |   |   | MEGA-1 |   | 2184 (79) | 2608 (74) | 1.26 | (1.12-1.42) | <.001 |
| 1 | SMOYKEEBO/F5 | rs6016 | Ile736Ile | LETS | G | 704 (80) | 668 (74) | 1.35 | (1.09-1.69) | .006 |
|   |   |   |   | MEGA-1 |   | 2188 (79) | 2615 (75) | 1.27 | (1.13-1.43) | <.001 |
| 1 | C1orf114 | rs3820059 | Ser172Phe | LETS | A | 320 (36) | 269 (30) | 1.34 | (1.10-1.64) | .004 |
|   |   |   |   | MEGA-1 |   | 1065 (38) | 1169 (33) | 1.22 | (1.10-1.35) | <.001 |
| X | F9 | rs6048 | Ala194Thr | LETS Men | A | 146 (77) | 128 (67) | 1.74 | (1.10-2.74) | .02 |
|   |   |   |   | LETS Women |   | 225 (70) | 238 (68) | 1.09 | (0.84-1.42) | .50 |
|   |   |   |   | MEGA-1 Men |   | 464 (73) | 566 (68) | 1.26 | (1.00-1.58) | .05 |
|   |   |   |   | MEGA-1 Women |   | 674 (72) | 818 (71) | 1.04 | (0.90-1.21) | .61 |
| X | ODZ1 | rs2266911 | Intronic | LETS Men | C | 161 (85) | 147 (77) | 1.66 | (0.99-2.79) | .06 |
|   |   |   |   | LETS Women |   | 422 (83) | 418 (80) | 1.26 | (0.91-1.73) | .17 |
|   |   |   |   | MEGA-1 Men |   | 556 (85) | 671 (80) | 1.47 | (1.12-1.94) | .006 |
|   |   |   |   | MEGA-1 Women |   | 1234 (82) | 1430 (78) | 1.25 | (1.05-1.48) | .01 |
| 1 | F5 (Leiden) | rs6025 | Arg534Gln | LETS | A | 95 (11) | 14 (2) | 7.19 | (4.05-(12.77) | <.001 |
|   |   |   |   | MEGA-1 |   | 291 (10) | 96 (3) | 4.10 | (3.23-5.21) | <.001 |
| 11 | F2 (G20210A) | rs1799963 | 3'UTR | LETS | A | 28 (3) | 10 (1) | 2.98 | (1.43-6.20) | <.001 |
|   |   |   |   | MEGA-1 |   | 81 (3) | 37 (1) | 2.89 | (1.94-4.29) | <.001 |

Chr denotes chromosome number.
All gene symbols, rs numbers, SNP types and chromosome numbers are from NCBI build 36.
[a]The first amino acid corresponds to the non risk allele.
[b]OR were estimated by logistic regression using an additive model. Sex was included as a covariate in logistic regression models containing markers residing on the X chromosome and the number of risk alleles for these SNPs were coded as 0 or 1 for males and 0, 1 or 2 for females.

TABLE 7

Associations of SNPs from the SNP Association Study With Deep Vein Thrombosis in MEGA-2

| Chr | Gene | SNP | Risk allele[a] | Genotype[b] | Case, N (%)[c] | Control, N (%)[c] | OR (95% CI) | P value | FDR[d] |
|---|---|---|---|---|---|---|---|---|---|
| 4 | CYP4V2 | rs13146272 | A | CC | 121 (10) | 352 (13) | 1 (ref) |   |   |
|   |   |   |   | CA | 478 (41) | 1178 (45) | 1.18 (0.94-1.49) |   |   |
|   |   |   |   | AA | 561 (48) | 1094 (42) | 1.49 (1.19-1.88) |   |   |
|   |   |   |   | Additive | (69) | (64) | 1.24 (1.11-1.37) | <.001 | <.001 |
| 1 | SERPINC1 | rs2227589 | T | CC | 1001 (77) | 2325 (82) | 1 (ref) |   |   |
|   |   |   |   | CT | 278 (21) | 483 (17) | 1.34 (1.13-1.58) |   |   |
|   |   |   |   | TT | 15 (1) | 28 (1) | 1.24 (0.66-2.34) |   |   |
|   |   |   |   | Additive | (12) | (11) | 1.29 (1.10-1.49) | <.001 | 0.004 |
| 19 | GP6 | rs1613662 | A | GG | 29 (2) | 89 (3) | 1 (ref) |   |   |
|   |   |   |   | GA | 355 (27) | 835 (29) | 1.31 (0.84-2.02) |   |   |
|   |   |   |   | AA | 915 (70) | 1924 (68) | 1.46 (0.95-2.24) |   |   |
|   |   |   |   | Additive | (84) | (82) | 1.15 (1.01-1.30) | 0.03 | 0.10 |

TABLE 7-continued

Associations of SNPs from the SNP Association Study With Deep Vein Thrombosis in MEGA-2

| Chr | Gene | SNP | Risk allele[a] | Genotype[b] | Case, N (%)[c] | Control, N (%)[c] | OR (95% CI) | P value | FDR[d] |
|---|---|---|---|---|---|---|---|---|---|
| 1 | RGS7 | rs670659 | C | TT | 129 (10) | 355 (13) | 1 (ref) | | |
| | | | | TC | 615 (48) | 1326 (47) | 1.28 (1.02-1.60) | | |
| | | | | CC | 548 (42) | 1153 (41) | 1.31 (1.04-1.64) | | |
| | | | | Additive | (66) | (64) | 1.10 (1.00-1.22) | 0.06 | 0.13 |
| 3 | NR1I2 | rs1523127 | C | AA | 480 (37) | 1097 (39) | 1 (ref) | | |
| | | | | AC | 598 (46) | 1340 (47) | 1.02 (0.88-1.18) | | |
| | | | | CC | 220 (17) | 409 (14) | 1.23 (1.01-1.50) | | |
| | | | | Additive | (40) | (38) | 1.09 (0.99-1.20) | 0.07 | 0.13 |
| 2 | NAT8B | rs2001490 | C | GG | 490 (38) | 1122 (39) | 1 (ref) | | |
| | | | | GC | 603 (46) | 1334 (47) | 1.04 (0.90-1.19) | | |
| | | | | CC | 205 (16) | 394 (14) | 1.19 (0.98-1.45) | | |
| | | | | Additive | (39) | (37) | 1.08 (0.98-1.19) | 0.12 | 0.18 |
| X | F9 (men) | rs6048 | A | Additive | (73) | (70) | 1.17 (0.94-1.445) | 0.15 | 0.20 |
| X | F9 (women) | rs6048 | A | GG | 56 (8) | 148 (10) | 1 (ref) | | |
| | | | | GA | 275 (41) | 615 (41) | 1.18 (0.84-1.66) | | |
| | | | | AA | 343 (51) | 752 (50) | 1.21 (0.86-1.68) | | |
| | | | | Additive | (71) | (70) | 1.07 (0.93-1.23) | 0.37 | NA |
| 19 | ZNF544 | rs6510130 | G | CC | 1192 (95) | 2626 (95) | 1 (ref) | | |
| | | | | CG | 60 (5) | 137 (5) | 0.97 (0.71-1.32) | | |
| | | | | GG | 0 (0) | 4 (0) | — | | |
| | | | | Additive | (2) | (3) | 0.91 (0.67-1.24) | 0.56 | 0.63 |
| 7 | MET | rs2237712 | G | AA | 1183 (93) | 2528 (93) | 1 (ref) | | |
| | | | | AG | 86 (7) | 184 (7) | 1.00 (0.77-1.30) | | |
| | | | | GG | 3 (0) | 3 (0) | 2.14 (0.43-10.6) | | |
| | | | | Additive | (4) | (4) | 1.03 (0.80-1.33) | 0.79 | 0.79 |
| 11 | F2 | rs1799963 | A | GG | 1219 (94) | 2794 (98) | 1 (ref) | | |
| | | | | GA | 76 (6) | 55 (2) | 3.17 (2.22-4.51) | | |
| | | | | AA | 0 (0) | 0 (0) | — | | |
| | | | | Additive | (3) | (1) | 3.17 (2.22-4.51) | <.001 | NA[f] |
| 1 | F5 | rs6025 | A | GG | 1029 (81) | 2646 (95) | 1 (ref) | | |
| | | | | GA | 235 (18) | 140 (5) | 4.32 (3.46-5.39) | | |
| | | | | AA | 8 (0) | 2 (0) | 10.30 (2.18-48.52) | | |
| | | | | Additive | (10) | (3) | 4.24 (3.42-5.26) | <.001 | NA[f] |

Abbreviations:
OR, odds ratio;
CI, confidence interval;
FDR, false discovery rate;
NA, not applicable, not in FDR analysis.
[a]Risk increasing allele identified in LETS and MEGA-1.
[b]In the additive model, the increase in risk per copy of the risk allele is calculated
[c]For the additive model, only the allele frequency is presented, not the count.
[d]P value from the additive model was used for FDR estimation.
[e]All gene symbols and rs numbers are from NCBI build 36.
[f]Factor V Leiden and the prothrombin G20210A mutation are presented for reference. Since these variants were not included in the SNP association study, their false discovery rate was not calculated.

TABLE 8

Association of SNPs in CYP4V2 region with DVT and Factor XI levels in the combined LETS and MEGA-1 studies.

| SNP | Gene | Risk allele | Genotype | Case, N (%) | Control, N (%) | FXI[a] % difference (95% CI) | Deep Vein Thrombosis OR (95% CI) | OR[b] (95% CI) |
|---|---|---|---|---|---|---|---|---|
| rs13146272 | CYP4V2 | A | CC | 181 (10) | 293 (13) | reference | 1 (reference) | 1 (reference) |
| | | | CA | 808 (44) | 995 (45) | 3 (1-6) | 1.32 (1.07-1.62) | 1.26 (1.03-1.56) |
| | | | AA | 850 (46) | 919 (42) | 7 (4-9) | 1.50 (1.22-1.84) | 1.36 (1.10-1.68) |
| | | | Additive | (68) | (64) | 3 (2-4) | 1.20 (1.09-1.31) | 1.14 (1.04-1.25) |
| rs3736456[c] | CYP4V2 | T | CC | 7 (0) | 0 (0) | | | |
| | | | CT | 162 (9) | 222 (10) | reference | 1 (reference) | 1 (reference) |
| | | | TT | 1663 (91) | 1973 (90) | 1 (-1-4) | 1.16 (0.93-1.43) | 1.15 (0.93-1.42) |
| | | | Additive | (95) | (95) | 1 (-2-4) | 1.06 (0.86-1.30) | 1.05 (0.85-1.28) |
| rs3087505 | KLKB1 | C | TT | 6 (0) | 25 (1) | reference | 1 (reference) | 1 (reference) |
| | | | TC | 317 (17) | 438 (20) | 11 (6-16) | 3.02 (1.22-7.44) | 2.59 (1.05-6.40) |
| | | | CC | 1509 (82) | 1743 (79) | 19 (14-24) | 3.61 (1.48-8.82) | 2.81 (1.15-6.89) |
| | | | Additive | (91) | (89) | 8 (6-10) | 1.27 (1.09-1.47) | 1.15 (0.99-1.34) |
| rs4253259 | KLKB1 | C | AA | 5 (0) | 6 (0) | reference | 1 (reference) | 1 (reference) |
| | | | AC | 168 (9) | 219 (10) | 0 (-18-18) | 0.92 (0.28-3.07) | 0.95 (0.28-3.20) |
| | | | CC | 1652 (91) | 1978 (90) | 0 (-19-18) | 1.00 (0.31-3.29) | 1.03 (0.31-3.43) |
| | | | Additive | (95) | (95) | 0 (-3-2) | 1.08 (0.88-1.32) | 1.08 (0.88-1.32) |
| rs4253408 | F11 | A | GG | 1526 (83) | 1869 (85) | reference | 1 (reference) | 1 (reference) |
| | | | GA | 293 (16) | 317 (14) | 4 (2-6) | 1.13 (0.95-1.35) | 1.06 (0.89-1.27) |
| | | | AA | 15 (1) | 17 (1) | 13 (-1-27) | 1.08 (0.54-2.17) | 0.97 (0.48-1.98) |
| | | | Additive | (9) | (8) | 5 (3-7) | 1.11 (0.95-1.30) | 1.05 (0.89-1.23) |

TABLE 8-continued

Association of SNPs in CYP4V2 region with DVT and Factor XI levels in the combined LETS and MEGA-1 studies.

| SNP | Gene | Risk allele | Genotype | Case, N (%) | Control, N (%) | % difference (95% CI) | FXI$^a$ OR (95% CI) | Deep Vein Thrombosis OR$^b$ (95% CI) |
|---|---|---|---|---|---|---|---|---|
| rs4253325 | F11 | G | AA | 21 (1) | 23 (1) | reference | 1 (reference) | 1 (reference) |
| | | | AG | 308 (17) | 392 (18) | 5 (0-16) | 0.86 (0.47-1.58) | 0.86 (0.46-1.59) |
| | | | GG | 1507 (82) | 1785 (81) | 8 (−3-13) | 0.93 (0.51-1.68) | 0.88 (0.48-1.62) |
| | | | Additive | (90) | (90) | 3 (1-5) | 1.05 (0.91-1.21) | 1.01 (0.87-1.17) |
| rs3775302 | KLKB1 | A | GG | 1418 (77) | 1686 (77) | reference | 1 (reference) | 1 (reference) |
| | | | GA | 380 (21) | 481 (22) | −1 (−3-1) | 0.94 (0.81-1.09) | 0.97 (0.83-1.13) |
| | | | AA | 38 (2) | 34 (2) | −4 (−11-3) | 1.33 (0.83-2.12) | 1.34 (0.83-2.14) |
| | | | Additive | (12) | (12) | −1(−3-0) | 1.00 (0.87-1.14) | 1.02 (0.89-1.16) |
| rs3756008 | F11 | T | AA | 526 (29) | 788 (36) | reference | 1 (reference) | 1 (reference) |
| | | | AT | 903 (49) | 1032 (47) | 7 (6-9) | 1.31 (1.14-1.51) | 1.21 (1.04-1.39) |
| | | | TT | 408 (22) | 384 (17) | 15 (12-17) | 1.59 (1.33-1.90) | 1.32 (1.09-1.59) |
| | | | Additive | (47) | (41) | 7 (6-8) | 1.27 (1.16-1.38) | 1.16 (1.05-1.27) |
| rs2036914 | F11 | C | TT | 302 (17) | 505 (23) | reference | 1 (reference) | 1 (reference) |
| | | | TC | 895 (49) | 1081 (49) | 7 (5-9) | 1.38 (1.17-1.64) | 1.27 (1.07-1.51) |
| | | | CC | 633 (35) | 620 (28) | 14 (12-16) | 1.71 (1.43-2.05) | 1.43 (1.19-1.73) |
| | | | Additive | (59) | (53) | 7 (6-8) | 1.30 (1.19-1.42) | 1.19 (1.08-1.30) |
| rs4253418 | F11 | G | AA | 3 (0) | 4 (0) | reference | 1 (reference) | 1 (reference) |
| | | | AG | 120 (7) | 199 (9) | 14 (10-19) | 0.80 (0.18-3.65) | 0.69 (0.15-3.14) |
| | | | GG | 1710 (93) | 2000 (91) | 22 (18-26) | 1.14 (0.26-5.10) | 0.88 (0.20-3.94) |
| | | | Additive | (97) | (95) | 8 (5-11) | 1.39 (1.11-1.74) | 1.24 (0.99-1.56) |
| rs3756011 | F11 | A | CC | 361 (26) | 598 (34) | reference | 1 (reference) | 1 (reference) |
| | | | CA | 697 (50) | 839 (48) | 8 (7-10) | 1.38 (1.17-1.62) | 1.26 (1.07-1.49) |
| | | | AA | 326 (24) | 313 (18) | 17 (15-20) | 1.73 (1.41-2.11) | 1.44 (0.16-1.78) |
| | | | Additive | (49) | (42) | 9 (7-10) | 1.32 (1.19-1.46) | 1.21 (1.09-1.34) |
| rs3822057 | F11 | C | CC | 406 (30) | 422 (24) | reference | 1 (reference) | 1 (reference) |
| | | | CA | 690 (51) | 876 (50) | −8 (−10-−5) | 0.82 (0.69-0.97) | 0.89 (0.75-1.06) |
| | | | AA | 269 (20) | 457 (26) | −14 (−16-−11) | 0.61 (0.50-0.75) | 0.72 (0.58-0.88) |
| | | | Additive | (45) | (51) | −7 (−8-−6) | 0.78 (0.71-0.87) | 0.85 (0.76-0.94) |

Abbreviations:
CI, confidence 1 interval;
LETS, Leiden Thrombophilia Study;
MEGA, Multiple Environmental and Genetic Assessment of Risk Factors for Venous Thrombosis;
NA, not applicable, not in false discovery rate analysis;
OR, odds ratio;
SNP, single nucleotide polymorphism.
$^a$Factor XI level per genotype was calculated in controls. A Factor XI analysis with 95% CI not crossing zero is considered significant.
$^b$OR for DVT, adjusted for factor XI level.
$^c$As there were no homozygous controls for the C allele of rs3736456, the CT genotype was taken as reference group for the factor XI difference and genotype OR.
For OR results, an analysis with 95% CI not crossing 1 is considered significant.

For rs4253529 (KLKB1), an exemplary genomic context sequence is provided in the Sequence Listing as SEQ ID NO:2557. Note that the alleles presented in Table 8 for rs4253529 are based on a different orientation (i.e., the reverse complement) relative to SEQ ID NO:2557. For rs3775302 (KLKB1), an exemplary genomic context sequence is provided in the Sequence Listing as SEQ ID NO:2558. For the rest of the SNPs in Table 8, SEQ ID NOs of exemplary sequences are indicated in Tables 1-2.

Example Two

Association Between F9 Malmö and Deep Vein Thrombosis

Introduction

In LETS, elevated levels of factor IX above the 90$^{th}$ percentile (129 U/dL) have been associated with a 2-3 fold increased risk of DVT (van Hylckama Vlieg et al., *Blood.* 2000; 95:3678-3682). A genome-wide scan was recently performed for novel genetic polymorphisms associated with risk of DVT, as described above in Example One. One of the SNPs identified was an A-G polymorphism (rs6048, F9 "Malmö") in the gene encoding Factor IX and was associated with an 18% decrease in DVT risk in 3 case-control studies of DVT. This common variant (minor allele frequency=0.32) causes a substitution of Ala for Thr at position 148 of the factor IX zymogen and is located within the region that is cleaved from the zymogen to activate the factor IX protease and has not been previously associated with risk for DVT or hemophilia B (Graham et al., *Am J Hum Genet.* 1988; 42:573-580). Thus, the mechanism by which the F9 Malmö SNP leads to reduced risk of DVT is unclear.

In the study described here in Example Two, it was determined whether the association between the F9 Malmö SNP and DVT could be explained by the Malmö SNP affecting thrombin generation, Factor IX plasma levels, or activation of Factor IX. It was also determined whether the association between the F9 Malmö SNP and DVT could be explained by linkage disequilibrium between the Malmö SNP and other factor IX variants.

Methods

Study Populations and Data Collection

The case-control populations (LETS, MEGA-1 and MEGA-2) used to analyze the association of genotypes with DVT are derived from two large population-based case-control studies; the Leiden Thrombophilia Study (LETS) and the Multiple Environmental and Genetic Assessment (MEGA) of risk factors for venous thrombosis study (van der Meer et al., *Thromb Haemost.* 1997; 78:631-635; Blom et al., *JAMA.* 2005; 293:715-722). The LETS and MEGA studies were approved by the Medical Ethics Committee of the Leiden University Medical Center, Leiden, The Netherlands. All participants gave informed consent to participate in the studies, completed a questionnaire on risk factors for venous thrombosis and provided a blood or buccal swab sample. Diagnoses were objectively confirmed using hospital discharge records and information from general practitioners. LETS included only those patients with an confirmed DVT. In MEGA, 90% of patients gave permission to view their medical records and within this group 97% of diagnoses were confirmed. Patients for whom DVT was excluded according to the medical record were excluded from the MEGA study. Samples from the Northwick Park Heart Study-II (NPHS-II), were used to evaluate the association of F9 cleavage peptide and with the Malmö genotypes (Miller et al., *Thromb Haemost.* 1996; 75:767-771).

Collection and ascertainment of events in LETS has been described previously (van der Meer et al., *Thromb Haemost.* 1997; 78:631-635). Briefly, cases were recruited between Jan. 1, 1988 and Dec. 30, 1992 from three anticoagulation clinics in the western part of the Netherlands: Leiden, Amsterdam, and Rotterdam. A total of 474 consecutive cases, 70 years or younger, with a diagnosis of a first DVT and without a known malignancy were included. For each case, an age—(±5 years) and sex-matched control participant who had no history of DVT was enrolled. In this study of LETS, 52 participants were excluded due to inadequate quantity or quality of DNA. After these exclusions, 443 cases and 453 controls remained.

Collection and ascertainment of events in MEGA has been described previously (Blom et al., *JAMA.* 2005; 293:715-722). Briefly, MEGA-1 enrolled consecutive patients aged 18 to 70 years who presented with their first diagnosis of DVT or pulmonary embolism (PE) at any of 6 anticoagulation clinics in the Netherlands (Amsterdam, Amersfoort, The Hague, Leiden, Rotterdam, and Utrecht) between Mar. 1, 1999 and May 31, 2004. Control subjects in MEGA included partners of patients and random population control subjects and were selected so that the distribution of age and sex matched that of the patient group. The first 4,500 MEGA participants who donated a blood sample were included in the MEGA-1 study. MEGA-1 participants with inadequate quantity or quality of DNA (n=370), malignancy (n=272), or a diagnosis of isolated PE (n=711) were excluded. After these exclusions, 1,398 cases and 1,785 controls remained in the MEGA-1 population. An additional 5,673 MEGA participants that donated either a blood sample or a buccal swab sample were included in the MEGA-2 study. MEGA-2 participants were excluded from the analysis if they had inadequate quantity or quality of DNA (n=467), malignancy (n=433), or a diagnosis of isolated PE (n=639). After these exclusions, 1,314 cases and 2,877 controls remained in the MEGA-2 study.

The Northwick Park Heart Study-II (NPHS-II) has been described previously (Miller et al., *Thromb Haemost.* 1996; 75:767-771). Briefly, 4600 men aged 50-63 years registered with 9 general medical practices in England and Scotland were screened for eligibility in the NPHS-II. Exclusion criteria for the original study included: a history of unstable angina or acute myocardial infarction (AMI); a major Q wave on the electrocardiogram (ECG); regular anti-platelet or anticoagulant therapy; cerebrovascular disease; life-threatening malignancy; conditions exposing staff to risk or precluding informed consent. Of these, 796 men gave written informed consent, were approved by the institutional ethics committee and had measurements of F9 cleavage peptide at baseline.

Allele Frequency and Genotype Determination

DNA concentrations were standardized to 10 ng/μL using PicoGreen (Molecular Probes, Invitrogen Corp, Carlsbad, Calif.) fluorescent dye. Genotyping of individual DNA samples was performed as previously described in Example One using 0.3 ng of DNA in kPCR assays or using multiplexed oligo ligation assays (OLA) (Iannone et al., *Cytometry.* 2000; 39:131-140). Genotyping accuracy of the multiplex methodology and kPCR has been assessed in three previous studies by comparing genotype calls from multiplex OLA assays with those from real time kPCR assays for the same SNPs, and the overall concordance of the genotype calls from these two methods was >99% in each of these studies (Iakoubova et al., *Arterioscler Thromb Vasc Biol.* 2006; 26:2763-2768; Shiffman et al., *Arterioscler Thromb Vasc Biol.* 2006; 26:1613-1618; and Shiffman et al., *Am J Hum Genet.* 2005; 77:596-605).

Statistical Analysis

Deviations from Hardy-Weinberg expectations were assessed using an exact test in controls (Weir, Genetic Data Analysis II. Sunderland: Sinauer Associates Inc.; 1996). Adjustments for covariates (age in years and sex) were performed using logistic regression analysis with the genotypes coded as 0, 1 and 2 for the non-risk homozygote, heterozygote, and risk homozygote, respectively. Logistic regression models were performed to assess the association of each genotype (heterozygote and risk homozygote coded as 2 indicator variables) with the outcome. All P values of statistical tests in LETS and MEGA-1 were two-sided. Analyses of SNPs were conducted separately in males and females since the SNP were on the X chromosome. SAS version 9 was used for all regression models.

Odds ratios (OR) and 95% confidence intervals (95% CI) were computed as an estimate of risk of DVT associated with each tag SNP in males using logistic regression with adjustments for age as previously described. For the allelic OR the major allele homozygote was used as reference group. Differences in the factor IX level between genotype categories were assessed in control subjects of LETS, MEGA-1 and MEGA-2 using a T-test. Subjects with oral anticoagulant were excluded. Factor IX level were available for 191 male and 261 female subjects in LETS, 829 male and 916 female subjects in MEGA1, 484 male and 2534 female subjects in MEGA2. Among 796 men that had measurements of F9 cleavage peptide at baseline in NPHS-II, the differences in factor IX cleavage peptide between genotype categories were assessed in NPHS-II using a T-test. Regression analyses and T-tests were performed with SAS. Regression in the NPHS-II was adjusted for age, levels of fibrinogen and creatinine.

Power to detect a difference in mean F9 cleavage peptide between groups defined by F9 genotype was calculated using nQuery Advisor version 4.0 (ref) for a two sample t-test at a 0.05 two-sided significance level and assuming equal variance among the groups (Elashoff, nQuery Advisor Version 4.0 User's Guide. Los Angeles, Calif. (2000)).

Meta analysis was performed using the meta package version 0.8-2 available in R software language version 2.4.1 (R: A Language and Environment for Statistical Computing, R Development Core Team, R Foundation for Statistical Computing, Vienna Australia, 2007, ISBN 3-900051-07-0) by treating the individual studies as fixed effects and using the inverse variance method to estimate the pooled effect of the SNP (Cooper et al., The Handbook of Research Synthesis. Newbury Park, Calif.: Russell Sage Foundation (1994)).

Gene Variants and DVT Risk in the F9 Region

To investigate whether other SNPs in this region might be associated with DVT, results from the HapMap Project were used to identify a region surrounding the Malmö SNP, rs6048 (chr X: 138,404,951 to 138,494,063). This region contained 48 SNPs with allele frequencies>2% (HapMap data release #221, phase II April 7, on NCBI B36 assembly, dbSNP 126 (Bertina et al., *Pathophysiol Haemost Thromb.* 2003; 33:395-400). Allele frequencies and LD were calculated from the SNP genotypes in the HapMap CEPH population, which includes Utah residents with ancestry from northern and western Europe. Eighteen SNPs were chosen using pairwise tagging in Tagger (implemented in Haploview (Schaid et al., *Am J Hum Genet.* 2002; 70:425-434)). 15 of these 18 SNPs were selected for genotyping. These 15 SNPs are reasonable surrogates for 45 of the 48 SNPs in this region because the 45 SNPs are either directly genotyped or in strong linkage disequilibrium ($r^2>0.8$) with at least one of the 48 genotyped SNPs. Assays for 3 of the 18 SNPs could not be constructed (rs4149754, rs438601, and rs17340148); these 3 SNPs are unlikely to be responsible for the observed association between rs6048 and DVT since they were not in strong LD ($r^2<0.2$) with rs6048. The remaining 14 of the 48 SNPs were candidates SNPs (Khachidze, Seattle SNPs db, Psaty JAMA). In total 29 SNPs were initially investigated in the males of LETS, and SNPs that were associated with DVT were investigated in the males of MEGA-1. The association between each genotype and DVT was assessed using the Fisher Exact method.

The association between haplotype and DVT was assessed using the R language package of haplo.stats (Schaid et al., *Am J Hum Genet.* 2002; 70:425-434), which uses the expectation maximization algorithm to estimate haplotype frequencies followed by testing for association between haplotype and disease using a score test. A sliding window was used to select and test haplotypes consisting of 3, 5, and 7 adjacent SNPs from the set of SNPs including the Malmö SNP and the 28 other tagging SNPs in male subjects.

Factor IX assays

The levels of factor IX were determined by enzyme-linked immunosorbent assay (ELISA) as previously described (van Hylckama Vlieg et al., *Blood.* 2000; 95:3678-3682). This ELISA is highly specific for Factor IX and results are not affected by the levels of the other vitamin K-dependent proteins. Under these conditions, the intra-assay and interassay CV was 7% (n 5 9) and 7.2% (n 5 41), respectively, at a factor IX antigen level of about 100 U/dL. Results are expressed in units per deciliter, where 1 U is the amount of factor IX present in 1 mL pooled normal plasma.

F9 Cleavage Peptide in NPHS-II

F9 cleavage peptide was determined by double antibody radioimmunoassay as markers of turnover of Factor IX in the NPHS-II samples (Bauer et al., *Blood.* 1990; 76:731-736). The coefficient of variation (CV) for measurements made during repeat measurements on split samples were 14.7% for Factor IX cleavage peptide. The level of cleavage peptide in plasma is dependent on Factor IX levels, which are affected by age and inflammation, and on kidney function. The effects of inflammation and kidney function were assessed by adjusting the analysis for the levels of fibrinogen and creatinine, respectively.

Endogenous Thrombin Potential (ETP)-Based APC Sensitivity Test

Endogenous thrombin potential (ETP) is an activate protein C (APC) sensitivity test that quantifies the time integral of thrombin generated in plasma in which coagulation is initiated via the extrinsic pathway (Hemker et al., *Thromb Haemost.* 1995; 74:134-138 and Nicolaes et al., *Blood Coagul Fibrinolysis.* 1997; 8:28-38). The sensitivity of the plasma ETP to APC was measured under conditions where the test is insensitive for small amounts of phospholipid present in plasma as previously described (Rosing et al., *Br J Haematol.* 1997; 97:233-238; Tans et al., *Br J Haematol.* 2003; 122:465-470; and Curvers et al., *Thromb Haemost.* 2002; 87:483-492).

Results

Figure 2:
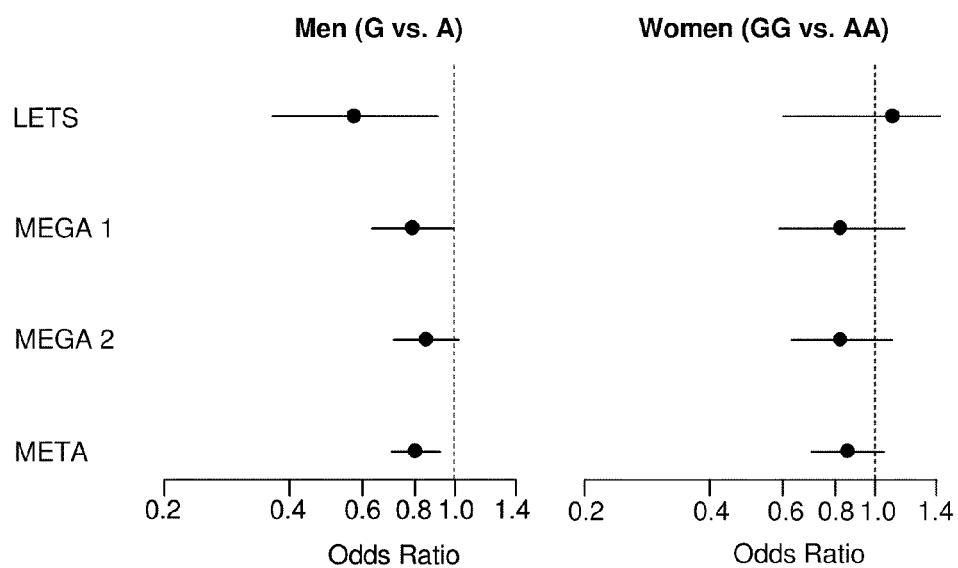
FIG. 2 shows the meta-analysis of Factor IX Malmö with DVT in women and men.

The Malmö SNP was previously found to be associated with DVT in men and not in women. In the previous analysis, women that were heterozygotic for the Malmo SNP were excluded from the analysis because lyonization, the process in which all X chromosomes of the cells in excess of one are inactivated on a random basis, causes the expressed genotypes to be different from the determined genotypes. Removing the heterozygote in the analysis in women reduces the power to detect associations between genotypes and DVT in women, which could explain why the association of Malmo with DVT in women had an OR for DVT that was similar to that found in men, but was not significant. It was found that the Malmö SNP, rs6048, was associated with DVT in men:the pooled odds ratio was 0.80 (95% CI, 0.71-0.92) for the A genotype (n=2688) compared with G (n=1108), but the Malmö SNP was not associated with DVT in women:the pooled odds ratio was 0.86 (95% CI, 0.70-0.1.05) for the AA (n=2190) compared with GG genotypes (n=405) (FIG. 2). Thus, analyses for this study were done in men.

It was determined whether the association between the F9 Malmö SNP and DVT could be explained by an association between the Malmö SNP and endogenous thrombin potential (ETP). Among the 161 male subjects of LETS for whom ETP measurements were available, it was found that Malmö genotype was not associated with ETP (median ETP=1657±341 for the A genotype and 1583±361 for the G genotype).

It was determined whether the association between the F9 Malmö SNP and DVT could be explained by an association between the Malmö SNP and Factor IX plasma levels. Among the male subjects for whom Factor IX plasma levels were available (161 in LETS, 829 in MEGA1 and 484 in MEGA2), there was not a significant difference in Factor IX level between the A and the G genotype. For the LETS subjects the mean FIX levels were 104±17% for the A genotype and 109±24% for the G genotype, P=0.0965. For the MEGA-1 subjects the mean Factor IX levels were 104±17% for patients with genotype A and 102±18% for the G genotype, P=0.119. For the MEGA-2 subjects the mean Factor IX levels were 104±15% for the genotype A and 104±18% for the G genotype, P=1.0).

It was determined whether the association between the F9 Malmö SNP and DVT could be explained by an association between the Malmö SNP and activation of Factor IX. Among the 796 male subjects of NPHS-II for whom plasma F9 cleavage peptide levels were available, there was not a significant difference in Factor IX level between the A and G genotypes; the mean plasma concentration of F9 cleavage peptide was 210.9+−75.04 (95% Cl: 204.6 to 217.2) for A genotype and 214.1+−73.82 (95% Cl: 204.7 to 223.4) for the G genotype. Adjustments for age, fibrinogen and creatinine levels did not appreciably change this result. The study had 80% power to detect a difference in means of 0.22 standard deviations or greater, or 90% power to detect a difference in means of 0.25 standard deviations or greater.

It was then determined whether the Malmö SNP was in linkage disequilibrium (LD) with other F9 variants that were associated with DVT. In the LETS population, 29 SNPs were investigated that represented groups of SNPs with LD greater than 0.8 in an 89 kb region surrounding the Malmö SNP on the X chromosome. It was found that six of the 29 SNPs, including the Malmö SNP, were associated (P≦0.05) with DVT (Table 9). The association between these six SNPs and DVT were then investigated in the MEGA-1 study, and two of these SNPs were found to be significantly associated with DVT in MEGA-1: the Malmö SNP and rs422187, an intronic SNP 300 bp from the Malmö SNP (Table 9). The risk estimate for the association between rs422187 and DVT was similar to that of the Malmö SNP, and LD between rs422187 and the Malmö SNP was high ($r^2$=0.94). Additionally, no SNPs or haplotypes were found to have a stronger association with DVT in the LETS or MEGA studies than the F9 Malmö SNP.

Discussion

It was investigated whether the previously reported association between DVT and the F9 Malmö SNP could be explained by changes in plasma levels of Factor IX, extrinsic coagulation, Factor IX activation, or LD with SNPs with stronger association with DVT than the Malmö SNP. However, analyses to directly or indirectly test these hypotheses did not provide support for any of them. Although the Malmö SNP did not affect ETP, an assay that measures extrinsic pathway coagulation initiated by TF:FVIIa, the Malmö SNP could have an affect on coagulation initiated by intrinsic pathway coagulation initiated by FXIa. The lack of an association of the Malmö SNP with Factor IX levels is consistent with the results of Khadhidze et al, which reported that 27 SNPs including F9 Malmö were not associated with FIX:C in the GAIT study (Khachidze et al., *J Thromb Haemost.* 2006; 4:1537-1545). The analysis of activation described here in Example Two used an indirect assay to estimate activation of Factor IX. The plasma level of the F9 cleavage peptide is dependent on the release of cleavage peptide that occurs when FIX is activated to FIXa and the steady clearance rate of the cleavage peptide in the kidneys (Lowe, *Br J Haematol.* 2001; 115:507-513). Direct measurements of Factor IX activation by TF:FVIIA or FXIa may reveal affects on the activation of Factor IX caused by F9 Malmö SNP.

The association of the Malmö SNP with DVT was previously reported in men as described in Example One. The result was not significant in women although the odds ratio in women was similar to that found in men. The LETS, MEGA-1 and MEGA-2 samples were pooled because these samples were collected in the Netherlands in the same health care system using similar inclusion criteria. The LETS inclusion and exclusion criteria were applied to the MEGA samples and they were pooled for meta-analysis. In the meta-analysis, the Malmö SNP was associated with DVT in men but was not with women although the odds ratio for men and women were similar. In the analysis of women, the AA genotype was compared with the GG genotype. However, the heterozygotes were excluded from the analysis because evaluation of female heterozygotes is confounded by lyonization. Therefore, the lack of association in female could be due to differences in penetrance between men and women or lack of power to detect the association in female homozygotes. The lack of an association between the Malmö SNP and DVT in women is consistent with recent results observed in postmenopausal women (Smith et al., *JAMA.* 2007; 297:489-498).

Fine mapping did not identify any SNPs that were more strongly associated with DVT than the Malmö SNP in the LETS and MEGA-1 samples. A recent study found that rs4149755 in the F9 gene was associated with DVT in postmenopausal women (Smith et al., *JAMA.* 2007; 297:489-498). rs4149755 was included in the fine mapping analysis in LETS, but rs4149755 was not associated with DVT in men (Table 9) or in women. No haplotypes were found using the evaluated fine mapping SNPs that were more strongly associated with DVT in both LETS and MEGA-1.

In conclusion, the Malmö SNP in F9 was significantly associated with an 18% reduction in risk of DVT in a pooled analysis of men from LETS, MEGA-1 and MEGA-2. Fine mapping of the F9 region surrounding the Malmö SNP did not reveal any additional SNPs associated with DVT in LETS and MEGA-1 or SNPs with greater significance than the Malmö SNP.

TABLE 9

The F9 MalmöP0 SNP fine mapping results in LETS and MEGA-1

| Study | Minor Allele | MAF | P-Value | OR | $r^2$ with Malmö | rs# | X Chromosome Position | SNP Type |
|---|---|---|---|---|---|---|---|---|
| LETS | A | 0.32 | 0.088 | 0.67 | 0.40 | rs4829996 | 138418800 | Intergenic |
| LETS | G | 0.08 | 0.849 | 0.92 | 0.02 | rs7055668(T) | 138427049 | Intergenic |
| LETS | A | 0.39 | 0.067 | 0.66 | 0.26 | rs411017 | 138439768 | Intergenic |
| LETS | T | 0.39 | 0.068 | 0.67 | 0.26 | rs378815(T) | 138439863 | TFBS synonymous |
| LETS | G | 0.02 | 1.000 | 0.67 | 0.01 | rs3817939(T) | 138440752 | TFBS synonymous |
| LETS | C | 0.44 | 0.538 | 1.14 | 0.06 | rs371000(T) | 138443187 | TFBS synonymous |
| LETS | T | 0.38 | 0.190 | 0.74 | 0.65 | rs4149674(T) | 138444467 | Intron |
| LETS | T | 0.08 | 1.000 | 1.07 | 0.03 | rs392959(T) | 138449920 | Intron |
| LETS | G | 0.34 | 0.032 | 0.61 | 0.85 | rs398101 | 138451623 | Intron |
| LETS | A | 0.06 | 0.423 | 1.42 | 0.03 | rs4149755 | 138451778 | Intron |
| LETS | A | 0.08 | 0.543 | 0.73 | 0.18 | rs4149758 | 138455143 | Intron |
| LETS | G | 0.07 | 1.000 | 1.00 | 0.02 | rs374988(T) | 138458881 | Intron |
| LETS | C | 0.33 | 0.039 | 0.61 | 0.94 | rs422187 | 138460525 | Intron |
| MEGA-1 | C | 0.32 | 0.016 | 0.88 | 0.93 | | | |
| LETS | G | 0.33 | 0.022 | 0.58 | NA | rs6048(T) | 138460946 | Missense Mutation |
| MEGA-1 | G | 0.30 | 0.021 | 0.88 | NA | | | |
| LETS | C | 0.09 | 0.454 | 0.74 | 0.08 | rs4149759(T) | 138462720 | Intron |
| LETS | G | 0.24 | 0.041 | 0.58 | 0.44 | rs413957 | 138465182 | Intron |
| LETS | T | 0.01 | 0.248 | N/A | 0.01 | rs4149761(T) | 138467129 | Intron |
| LETS | T | 0.03 | 1.000 | 0.99 | 0.02 | rs4149730(T) | 138467398 | Intron |
| LETS | C | 0.24 | 0.029 | 0.56 | 0.45 | rs421766 | 138468258 | Intron/TFBS |
| LETS | A | 0.05 | 0.230 | 1.76 | 0.00 | rs4149762(T) | 138469863 | Intron |
| LETS | C | 0.25 | 0.041 | 0.57 | 0.45 | rs370713 | 138470059 | Intron |
| LETS | T | 0.00 | 1.000 | N/A | 0.00 | rs4149749 | 138470891 | Intron/TFBS |
| LETS | A | 0.00 | 1.000 | N/A | 0.00 | rs4149763 | 138472372 | UTR3 |
| LETS | A | 0.24 | 0.057 | 0.61 | 0.43 | rs440051(T) | 138472583 | TFBS/UTR3 |

TABLE 9-continued

The F9 MalmöP0 SNP fine mapping results in LETS and MEGA-1

| Study | Minor Allele | MAF | P-Value | OR | r² with Malmö | rs# | X Chromosome Position | SNP Type |
|---|---|---|---|---|---|---|---|---|
| LETS | G | 0.26 | 0.008 | 0.50 | 0.42 | rs434144 | 138474091 | Intergenic |
| LETS | A | 0.01 | 0.247 | N/A | 0.00 | rs17342358(T) | 138482244 | TFBS synonymous |
| LETS | T | 0.45 | 0.411 | 1.21 | 0.00 | rs5907573(T) | 138489652 | TFBS |
| LETS | C | 0.44 | 0.305 | 1.26 | 0.00 | rs3128282 | 138490821 | Intergenic |
| LETS | A | 0.01 | 0.499 | N/A | 0.00 | rs2235708 | 138506410 | ESE |

(T) = tagging SNP;
MAF = minor allele frequency
TFBS = Transcription Factor Binding Site;
ESE = exon splicing enhancer
N/A = Not applicable or the calculation contained a group with zero counts.
Unadjusted allelic odds ratios and P-values were calculated by the Fisher Exact method in men.
15/18 tag SNPs were run in LETS, 3 single SNP tags were not run in LETS Example Three Gene Variants of Cyp4V2, SERPINC1 and GP6 are Associated with Pulmonary Embolism Overview Pulmonary embolism (PE) is a manifestation of venous thrombosis (VT) that may share genetic risk factors in common with deep vein thrombosis (DVT). To identify SNPs associated with isolated PE, 11 SNPs previously found to be associated with DVT were analyzed for their association with isolated PE in a case-control study of 1206 cases and 4634 controls from the Multiple Environmental and Genetic Assessment (MEGA) study. Odds ratios (OR) for isolated PE were estimated in logistic regression models that adjusted for age and sex.

SNPs determined to be associated with isolated PE included SNPs in genes for CYP4V2 (rs13146272: OR, 1.15; 95% CI, 1.04-1.27), GP6 (rs1613662: OR, 1.18; 95% CI, 1.04-1.33) and SERPINC1 (rs2227589: OR, 1.28; 95% CI, 1.11-1.48) and F9 in females (rs6048: OR, 1.20; 95% CI, 1.06-1.38). Many of these SNPs were found in genes not previously reported to be involved in VT. Factor V Leiden and prothrombin G20210A variants were associated with isolated DVT (rs6025: OR, 4.43; 95% CI, 3.76-5.22; rs1799963: OR, 3.01; 95% CI, 2.29-3.95) and with isolated PE (rs6025: OR, 1.82; 95% CI, 1.45-2.28; rs1799963: OR, 1.82; 95% CI, 1.27-2.62); however, the case frequencies were significantly lower in the isolated PE study compared to the isolated DVT study (P<0.01).

Introduction

Pulmonary embolism (PE) is a common and potentially fatal manifestation of VT, which occurs as a consequence of a DVT that embolizes to the lung. VT affects about 750,000 patients annually in the EU and about 600,000 patients annually in the US. It is the 3$^{rd}$ most common cardiovascular disease worldwide, behind CHD and stroke (Zidane et. al., *Throm Haemost* 2003 90:439-445 and Perrier, *Chest* 200 118:1234-6)

In the United States, the total incidence of symptomatic PE is approximately 630,000 cases per year. Approximately a third of these patients die, and in nearly half of these patients who die, PE is the sole cause of death (Diseases of the Veins. Pathology, diagnosis and treatment. In: Browse et al., editors. Pulmonary embolism. London:Edwards Arnolds; 1989. p 557-80). Estimates of the total number of non-fatal PE event across Europe exceed 400,000 per year and the total number of PE-related deaths is about 514,000 (Cohen, *Throm Haemost* (2007) 98, 756-764 and Lindblad, B M J 1991; 302; 709-711). PE is the major cause of VT deaths.

The genetic risk factors for PE may be different for DVT. It has been assumed that PE and DVT share the same genetic risk factors. However, studies that evaluated the factor V Leiden (FVL) variant (which is known to be associated with DVT) in patients with PE but without DVT found that it was weakly associated with PE. In addition, genetic variants may predispose the thrombus to particular vascular beds. For example, patients with PT G20210A mutations are predisposed to portal vein thrombosis whereas individuals with FVL variants are not, and it has been suggested that patient with FVL are predisposed to DVTs of the calf. Thus, although DVT and PE may be different manifestations of the same disease, they may not share all the same risk factors.

A functional genome-wide scan of DVT was recently performed and seven SNPs were identified that were associated with DVT in three case-controls studies, as described in Example One above. Here in Example Three, it was determined whether any of these seven SNPs, plus four other SNPs (in F2, F5, and F11), were also associated with isolated PE.

Methods

Study Populations and Data Collection

This genetic study of PE investigated patients with PE selected from the Multiple Environmental and Genetic Assessment of risk factors for venous thrombosis (MEGA) study (Blom et al., *JAMA*. Feb. 9, 2005; 293(6):715-722). The MEGA study was approved by the Medical Ethics Committee of the Leiden University Medical Center, Leiden, The Netherlands. All participants gave informed consent to participate in the studies and completed an institutional review board-approved questionnaire. Diagnoses of PE and DVT in the studies were objectively confirmed using hospital discharge records and information from general practitioners. Patients with isolated PE had a confirmed PE and no record of a DVT, and patients with isolated DVT had a confirmed DVT and no record of a PE.

The Multiple Environmental and Genetic Assessment Study (MEGA)

Collection and ascertainment of events in MEGA has been described previously (Blom et al., *JAMA*. Feb. 9, 2005; 293 (6):715-722). MEGA enrolled consecutive patients aged 18 to 70 years who presented with their first diagnosis of DVT or PE at any of 6 anticoagulation clinics in the Netherlands (Amsterdam, Amersfoort, The Hague, Leiden, Rotterdam, and Utrecht) between Mar. 1, 1999 and May 31, 2004. The anticoagulation clinics monitor the anticoagulant therapy of all patients in defined regions of the Netherlands, which allowed them to identify consecutive and unselected cases with DVT. Partners of cases were invited to take part as controls. Additional control participants were recruited by random digit dialing from the same region that the cases were collected (Chinthammitr et al., *J Thromb Haemost*. December 2006; 4(12):2587-2592). The age and sex of the controls were matched to cases. MEGA DNA was collected and extracted from blood or buccal swabs as previously described (Blom et al., *JAMA*. Feb. 9, 2005; 293(6):715-722). MEGA included ~10,000 participants. Subjects were excluded due to inadequate quantity or quality of DNA (n=370+467), for malignancy (n=272+433).

Allele Frequency and Genotype Determination

Genotypes were determined by kPCR or multiplex oligo-ligation assay. DNA concentrations were standardized to 10 ng/µL using PicoGreen (Molecular Probes) fluorescent dye. Each allele was amplified separately by PCR using genotyping of individual DNA samples was similarly performed using 0.3 ng of DNA in kinetic polymerase chain reaction (kPCR) assays (Germer et al., *Genome Res*. February 2000; 10(2):258-266) or using multiplex PCR assays capable of genotyping up to 50 SNPs in a single reaction (Tannone et al., *Cytometry*. Feb. 1, 2000; 39(2):131-140). Genotyping accuracy of the multiplex methodology has been assessed in three previous studies by comparing genotype calls from the multiplex OLA assays to those from real time kinetic PCR assays for the same SNPs, and the overall concordance of the genotype calls from these two methods was >99% in each of these studies (Iakoubova et al., *Arterioscler Thromb Vasc Biol*. Sep. 28, 2006; 26(26):2763-2768; Shiffman et al., *Arterioscler Thromb Vasc Biol*. July 2006; 26(7):1613-1618; and Shiffman et al., *Am J Hum Genet*. October 2005; 77(4):596-605). The 7 assays associated with DVT in MEGA were successfully genotyped in >95% of the subjects in MEGA.

Study Design

To identify genetic risk variants that were associated with isolated PE, the risk allele of 11 SNPs previously associated with DVT were evaluated for their association with isolated PE in MEGA. The case-control studies of DVT that were used to identify 7 of these SNPs (out of the 11 SNPs) excluded patient with isolated PE. This study evaluates these patients with isolated PE who were excluded from the studies used to identify these SNPs. The same controls used in the DVT discovery studies were used for this study. The controls were subjects with no history of VT.

Study Populations

The baseline characteristics of the cases and controls in the isolated PE and isolated DVT studies of MEGA are presented in Table 10.

Statistical Analysis

Deviations from Hardy-Weinberg expectations were assessed using an exact test in controls (Weir, Genetic Data Analysis 2: Methods for Discrete Population Genetic Data 2nd edition (April 1996) ed. Sunderland: Sinauer Associates; 1996). Adjustments for covariates (age in years, and sex) were performed using logistic regression analysis with the genotypes coded as 0, 1 and 2 for the non-risk homozygote, heterozygote, and risk homozygote, respectively. For the SNPs presented in Table 11, logistic regression models were performed to assess the association of each genotype (heterozygote and risk homozygote coded as 2 indicator variables) with the outcome. All statistical tests in MEGA were two-sided.

Results

SNPs Associated with PE in MEGA

In MEGA, the association with isolated PE of 7 SNPs previously found to be associated with DVT was analyzed. In the controls of MEGA, the genotypes of the 11 SNPs did not deviate from the distributions expected under Hardy-Weinberg equilibrium ($P \leq 0.01$) (Weir, Genetic Data Analysis 2: Methods for Discrete Population Genetic Data 2nd edition (April 1996) ed. Sunderland: Sinauer Associates; 1996). The method of Bonferoni was used to correct for multiple comparisons. Both the isolated DVT and isolated PE studies of MEGA had greater than 80% to detect association of the 7 SNP (power=0.5 for 0.1 allele frequency)

Eight of the 11 SNPs evaluated were associated ($P \leq 0.05$) with isolated PE. These were in the genes for CYP4V2, GP6, SERPINC1, F2, F5, and F11. The risk allele and OR of these SNPs can be found in Table 11. The associations between isolated PE and each genotype of these eight associated SNPs are shown in Table 12.

Six of the 11 SNPs evaluated were associated ($P \leq 0.05$) with isolated DVT. These were in the genes for CYP4V2, GP6, SERPINC1, RGS7, NRI12, and NAT8. The associations between isolated DVT and each genotype of these SNPs are shown in Table 13.

The case allele frequencies for FVL and PT are substantially lower (P<0.05) in the case frequencies of the isolated DVT study than in the isolated PE study, which is reflected as a lower risk estimates for FVL and PT in the isolated PE study than in the isolated DVT study. The three SNPs in genes for NRI12, NAT8 and RGS7 that were associated with isolated DVT but not with isolated PE, also have slightly lower case frequencies in the isolated DVT study compared to the isolated PE study, although the frequency differences were not statistically significant.

Discussion

Eight SNPs in genes for CYP4V2, SERPINC1, GP6, F2, F5, and F11 (Table 12) were identified that were associated with isolated PE in a large, well characterized case-control population (MEGA) (1206 PE cases and 4634 controls). The associations were corrected for multiple testing using the Bonferroni method. The risk alleles associated with isolated PE for each of the SNPs are the same risk alleles previously reported to be associated with DVT, as described in Example One.

This study also confirmed that established genetic risk factors for venous thrombosis, notably FVL (Chinthammitr et al., *J Thromb Haemost*. December 2006; 4(12):2587-2592 and Bertina et al., *Nature*. May 5, 1994; 369(6475):64-67) and prothrombin G20210A (Chinthammitr et al., *J Thromb Haemost*. December 2006; 4(12):2587-2592 and Poort et al., *Blood*. Nov. 15, 1996; 88(10):3698-3703), are associated with isolated PE in MEGA. However, the risk estimates for FVL and prothrombin G20210A with isolated PE are about half of the risk estimated found for isolated DVT (FVL, OR=4.43 and OR=1.82, respectively; PT, OR=3.01 and OR=1.82) (Chinthammitr et al., *J Thromb Haemost*. December 2006; 4(12):2587-2592 and Poort et al., *Blood*. Nov. 15, 1996; 88(10):3698-3703).

These results are consistent with the previous associations of FVL and PT with isolated DVT and isolated PE. The most notable of the genetic risk factors for DVT is Factor V Leiden, which has an OR for DVT of 6. Intriguingly, studies of consecutive suspected PE patients found that there was no difference in the prevalence of FVL in patients with or without confirmed PE. This was been replicated in many other studies (Perrier, *Chest* 200 118:1234-6). This weak association of FVL with PE is in sharp contrast to its association with DVT and has been called the Factor V Leiden paradox. It has been suggested that the reason for this paradox is that DVT patients with FVL are more likely to have a distal DVT which is less likely to embolize (i.e., lower tendency to develop iliofemoral DVT that carriers). However, this was not substantiated by Martinelli (*JTH* 5: 98-101). The paradox suggests that although FVL is an important risk factor for DVT, it may not increase the risk of PE. Since PE cause most VT deaths and is therefore more clinically important than DVT (Martinelli, *JTH* 5:98-101), it has been suggested that patient with FVL should be treated less aggressively rather than more aggressively (Bounameaux, *Lancet* (2000) 356:182-183).

PT G20210A is another genetic risk factor associated with different manifestations of VT. PT G20210A is associated with increased portal vein VT, whereas FVL is not (Primignami et al., *Heptology* 2005 41:603-8). In addition, some studies suggest that carriers of PT G20210A have an increased risk of developing PE, which is similar to that seen for DVT. PT G20210 has an OR of 3.0 for DVT. However, other studies suggest that PT G20210A is not associated with risk in PE, which (like FVL) is not explained by a difference in the rate of distal versus proximal DVT. Unfortunately, these studies are complicated by the low allele frequency of the PT G20210A variant. One of the advantages of the MEGA study is it large size, which provides greater power for detecting associations. In the current study, FVL and PT were both found to be associated with isolated PE and isolated DVT. However, the risk estimates were lower in the isolated PE study than in the isolated DVT, which is consistent with literature reports of FVL and PT not being associated with isolated PE in smaller studies having less power.

Although SERPINC1 is located in the same region of chromosome 1 as the Factor V gene, its association with isolated DVT or isolated PE is not due to linkage-disequilibrium with the FVL variant (see Example One).

Conclusions

Eight SNPs were identified that were associated with isolated PE in the MEGA study. These variants are useful for assessing genetic risk of PE, and the genes containing these variants and the products encoded by these genes (e.g., protein and mRNA) are useful as therapeutic targets for treating PE.

Additional SNPs associated with PE are provided in Table 25 (Example Seven below).

TABLE 10

Characteristics of Cases and Controls in MEGA

| Characteristic | PE Cases n = 1206 | DVT Cases n = 2229 | Controls n = 4634 | P value DVT* | P value PE[46] |
|---|---|---|---|---|---|
| Male, % | 498 (41.2) | (1032) 46.3 | (2191) 47.3 | 0.45 | 1.7E−0.4 |
| Age, years Mean ± SD | 47 (13) | 47 (13) | 47 (13) | 0.46 | 0.64 |
| Range | 18.1-70.0 | 18.2-70.0 | 18.0-70.0 | | |

Differences between characteristics were assessed by the Wilcoxon rank sum test (continuous variables) or by Fisher's exact test (discrete variables).
*Comparison between DVT cases and controls.
†Comparison between PE cases and controls.

TABLE 11

Association of Nine SNPs with Isolated DVT or PE

| Gene Symbol | SNP | Endpoint | Risk Allele* | Frequency (%) Cases | Frequency (%) Control | Unadjusted OR (95% CI) | Unadjusted P Value | Adjusted OR (95% CI) | Adjusted P Value |
|---|---|---|---|---|---|---|---|---|---|
| CYP4V2 | rs13146272 | PE | A | 67 | 64 | 1.15 (1.05-1.27) | 0.004 | 1.15 (1.04-1.27) | 0.005 |
| | | DVT | | 68 | 64 | 1.19 (1.10-1.29) | <0.0001 | 1.19 (1.10-1.29) | <0.0001 |
| SERPINC1 | rs2227589 | PE | T | 12 | 9 | 1.28 (1.11-1.48) | 0.0003 | 1.28 (1.11-1.48) | 0.001 |
| | | DVT | | 11 | 9 | 1.24 (1.10-1.39) | 0.0004 | 1.24 (1.10-1.39) | 0.0003 |
| GP6 | rs1613662 | PE | A | 84 | 82 | 1.18 (1.04-1.33) | 0.009 | 1.18 (1.04-1.33) | 0.008 |
| | | DVT | | 84 | 82 | 1.15 (1.04-1.26) | 0.005 | 1.15 (1.04-1.33) | 0.005 |
| RGS7 | rs670659 | PE | C | 65 | 64 | 1.03 (0.93-1.13) | 0.58 | 1.02 (0.93-1.13) | 0.62 |
| | | DVT | | 67 | 64 | 1.12 (1.04-1.21) | 0.003 | 1.13 (1.04-1.21) | 0.002 |
| NR1I2 | rs1523127 | PE | C | 40 | 38 | 1.05 (0.96-1.15) | 0.30 | 1.05 (0.96-1.15) | 0.30 |
| | | DVT | | 41 | 38 | 1.12 (1.04-1.21) | 0.002 | 1.12 (1.04-1.21) | 0.002 |
| NAT8B | rs2001490 | PE | C | 37 | 37 | 0.99 (0.91-1.09) | 0.59 | 0.99 (0.91-1.09) | 0.91 |
| | | DVT | | 40 | 37 | 1.11 (1.03-1.20) | 0.005 | 1.11 (0.91-1.09) | 0.005 |
| F9 | rs6048 | PE | | | | | | | |
| | | Male | A | 72 | 69 | 1.24 (0.99-1.55) | 0.06 | 1.24 (1.00-1.55) | 0.06 |
| | | Female | | 90 | 88 | 1.21 (1.06-1.38) | 0.005 | 1.20 (1.06-1.38) | 0.006 |
| | | DVT | | | | | | | |
| | | Male | A | 74 | 69 | 1.16 (0.99-1.37) | 0.07 | 1.16 (0.98-1.37) | 0.08 |
| | | Female | | 90 | 88 | 1.07 (0.96-1.19) | 0.20 | 1.06 (0.95-1.18) | 0.29 |
| F2 | rs1799963 | PE | A | 2 | 1 | 1.85 (1.29-2.66) | 0.0009 | 1.82 (1.27-2.62) | 0.001 |
| | | DVT | | 3 | 1 | 3.01 (2.30-3.96) | <0.0001 | 3.01 (2.29-3.95) | <0.0001 |
| F5 | rs6025 | PE | A | 5 | 3 | 1.81 (1.45-2.27) | <0.0001 | 1.82 (1.45-2.28) | <0.0001 |
| | | DVT | | 11 | 3 | 4.42 (3.75-5.21) | <0.0001 | 4.43 (3.76-5.22) | <0.0001 |

SNP annotation based on build 126, (human genome map 36) of the NCBI SNP database.

The risk estimate was calculated based on the risk allele analyzed using the general DVT endpoint.

*Allele frequency for the risk allele.

†OR denotes odds ratio, which were estimated and adjusted for age and sex by logistic regression using an additive model. Sex was included as a covariate in logistic regression models containing markers residing on the X chromosome and the number of risk alleles for these SNPs were coded as 0 or 1 for males and 0, 1 or 2 for females.

TABLE 12

Association of Eight SNPs with PE

| Gene | SNP | Risk allele | Genotype | Count (Frequency %) Case | Count (Frequency %) Control | Unadjusted OR (95% CI) | Unadjusted P Value | Adjusted‡ OR (95% CI) | Adjusted‡ P Value |
|---|---|---|---|---|---|---|---|---|---|
| SERPINC1 | rs2227589 | T | TT | 20 (2) | 43 (1) | 1.87 (1.09-3.20) | 0.02 | 1.85 (1.08-3.16) | 0.02 |
|  |  |  | TC | 239 (20) | 766 (17) | 1.26 (1.07-1.48) | 0.006 | 1.23 (1.08-1.41) | 0.002 |
|  |  |  | CC | 940 (78) | 3782 (82) | Ref |  | Ref |  |
| CYP4V2 | rs13146272 | A | AA | 513 (45) | 1814 (41) | 1.35 (1.08-1.68) | 0.008 | 1.35 (1.08-1.67) | 0.008 |
|  |  |  | AC | 494 (44) | 1983 (45) | 1.19 (0.95-1.48) | 0.13 | 1.18 (0.95-1.47) | 0.14 |
|  |  |  | CC | 122 (11) | 581 (13) | Ref |  | Ref |  |
| GP6 | rs1613662 | A | AA | 842 (71) | 3059 (67) | 1.29 (0.87-1.90) | 0.20 | 1.30 (0.88-1.92) | 0.19 |
|  |  |  | GA | 319 (27) | 1388 (30) | 1.08 (0.72-1.61) | 0.72 | 1.08 (0.72-1.62) | 0.70 |
|  |  |  | GG | 32 (3) | 150 (3) | Ref |  | Ref |  |
| F2 | rs1799963 | A | AA | 1 (0) | 0 (0) | — | — | — | — |
|  |  |  | AG | 42 (4) | 92 (2) | 1.78 (1.23-2.58) | 0.002 | 1.75 (1.21-2.54) | 0.003 |
|  |  |  | GG | 1157 (96) | 4514 (98) | Ref |  | Ref |  |
| F5 | rs6025 | A | AA | 4 (0) | 7 (0) | 2.29 (0.67-7.84) | 0.19 | 2.29 (0.67-7.86) | 0.19 |
|  |  |  | AG | 105 (9) | 226 (5) | 1.86 (1.46-2.37) | <0.0001 | 1.87 (1.47-2.38) | <0.0001 |
|  |  |  | GG | 1076 (91) | 4312 (95) | Ref |  | Ref |  |
| F5 | rs4524 | T | TT | 702 (60) | 2466 (55) | Ref |  | Ref |  |
|  |  |  | CT | 410 (35) | 1713 (38) | 0.84 (0.73-0.96) | 0.013 | 0.84 (0.74-0.97) | 0.015 |
|  |  |  | CC | 58 (5) | 325 (7) | 0.63 (0.47-0.84) | 0.002 | 0.62 (0.46-0.83) | 0.001 |
| F11 | rs4253418 | G | GG | 1095 (93) | 4120 (91) | Ref |  | Ref |  |
|  |  |  | AG | 76 (6) | 381 (8) | 0.75 (0.58-0.97) | 0.03 | 0.75 (0.58-0.97) | 0.029 |
|  |  |  | AA | 5 (0) | 11 (0) | 1.71 (0.59-1.93) | 0.32 | 1.68 (0.58-4.85) | 0.338 |
| F11 | rs3756008 | T | AA | 368 (31) | 1672 (37) | Ref |  | Ref |  |
|  |  |  | TA | 573 (49) | 2115 (47) | 1.23 (1.06-1.42) | 0.005 | 1.23 (1.07-1.43) | 0.005 |
|  |  |  | TT | 234 (20) | 730 (16) | 1.46 (1.21-1.75) | <0.001 | 1.46 (1.22-1.76) | <0.001 |

*Genotypic allele frequency.
†The risk estimate (odds ratio) was calculated based on the risk allele analyzed with the general DVT endpoint.
‡Adjusted for age and sex.

TABLE 13

Association of Five SNPs with Isolated DVT

| Gene | SNP | Genotype | Count (Frequency %) Case | Count (Frequency %) Control | Unadjusted OR (95% CI) | Unadjusted P Value | Adjusted‡ OR (95% CI) | Adjusted‡ P Value |
|---|---|---|---|---|---|---|---|---|
| SERPINC1 | rs2227589 | TT | 31 (1) | 43 (1) | 1.57 (0.98-2.50) | 0.06 | 1.57 (0.98-2.49) | 0.06 |
|  |  | TC | 434 (20) | 766 (17) | 1.23 (1.08-1.40) | 0.002 | 1.23 (1.08-1.41) | 0.002 |
|  |  | CC | 1740 (79) | 3782 (82) | Ref |  | Ref |  |
| CYP4V2 | rs13146272 | AA | 991 (47) | 1814 (41) | 1.37 (1.15-1.62) | 0.0003 | 1.37 (1.15-1.62) | 0.0003 |
|  |  | AC | 879 (42) | 1983 (45) | 1.11 (0.94-1.32) | 0.23 | 1.11 (0.93-1.32) | 0.24 |
|  |  | CC | 232 (11) | 581 (13) | Ref |  | Ref |  |
| GP6 | rs1613662 | AA | 1546 (70) | 3059 (67) | 1.26 (0.93-1.72) | 0.13 | 1.26 (0.93-1.71) | 0.13 |
|  |  | GA | 604 (27) | 1388 (30) | 1.09 (0.80-1.49) | 0.60 | 1.09 (0.79-1.49) | 0.60 |
|  |  | GG | 60 (3) | 150 (3) | Ref |  | Ref |  |
| F2 | rs1799963 | AA | 0 (0) | 0 (0) | — | — | — | — |
|  |  | AG | 128 (6) | 92 (2) | 3.01 (2.29-3.96) | <0.0001 | 1.75 (1.21-2.54) | 0.003 |
|  |  | GG | 2085 (94) | 4514 (98) | Ref |  | Ref |  |
| F5 | rs6025 | AA | 16 (1) | 7 (0) | 5.64 (2.32-13.74) | 0.0001 | 2.29 (0.67-7.86) | 0.19 |
|  |  | AG | 431 (20) | 226 (5) | 4.71 (3.97-5.58) | <0.0001 | 1.87 (1.47-2.38) | <0.0001 |
|  |  | GG | 1746 (80) | 4312 (95) | Ref |  | Ref |  |

*Genotypic allele frequency.
†The odds ratio was calculated based on the risk allele analyzed using the general DVT endpoint.
‡Adjusted for age and sex.

Example Four

Multiple SNPs Independently Associated with Expression of Factor XI and Risk of Deep Vein Thrombosis Overview Two recent studies have detected association of DVT risk with SNPs in the 4q35 locus that contains genes encoding cytochrome P450, family 4, subfamily V, polypeptide 2 (CYP4V2), factor XI (F11) and prekallikrein (KLKB1) (Smith et al., *JAMA* 297, 489-98 (2007) and Bezemer et al., *JAMA* 299, 1306-14 (2008)). To determine the risk gene(s) among these candidates and identify the variants most likely to have a functional role in altering the risk for DVT, an analysis involving dense genotyping and association testing of 103 SNPs over 200 kbp in the CYP4V2/KLKB1/F11 locus in large case control sample sets (up to 3,155 cases and 5,087 controls) was carried out. Disease-SNP modeling identified three independently risk-related SNPs: rs2289252 (in F11, $OR_{homozygote}$ [95% CI]=1.84 [1.62-2.10], $P_{genotypic}$=1.7× $10^{-20}$), rs2036914 (in F11: $OR_{homozygote}$ [95% CI]=1.84 [1.61-2.10], $P_{genotypic}$=6.5×$10^{-19}$), and rs13146272 (in CYP4 V2, $OR_{homozygote}$ [95% CI]=1.58 [1.29-1.76], $P_{genotypic}$=2.1× $10^{-7}$). Genotypes of these markers are associated with the level of factor XI (FXI) which is known to associate with DVT (e.g., P=2.1×10$^{-20}$ for rs2289252) (Meijers et al., *N Engl J Med* 342, 696-701 (2000)), and carriers of risk genotypes have higher levels of FXI than non-carriers. These data indicate that SNPs in CYP4V2 and F11 confer risk of DVT that is at least partly explained by FXI levels.

Introduction

In a large scale, gene-centric SNP-based association study, statistically significant associations were found between DVT and SNPs in the CYP4V2 region on chromosome 4, SERPINC1 on chromosome 1, and GP6 on chromosome 19 (Bezemer et al., *JAMA* 299, 1306-14 (2008)), as described above in Example One. Additional genotyping in the CYP4V2 region identified several associated markers in the neighboring genes, encoding factor XI (F11) and prekallikrein (KLKB1). In a candidate gene-based association study, Smith et al. reported that two SNPs in F11 were associated with risk of DVT in postmenopausal women with DVT (Smith et al., *JAMA* 297, 489-98 (2007)).

However, because of LD and the limited coverage of the genome by the initial characterizations, it remained undetermined whether the observed markers are "causal" or serve as proxies to untested causal variants and whether other variants at this locus add to DVT risk. Identification of the causal variants enables a better assessment of proper effect size and further understanding of pertinent biological mechanisms. This is of particular interest for the 4q35 region, since F11 and its homologue KLKB1 are both known to be involved in the intrinsic blood coagulation cascade: in the initial contact phase, activation of Factor XII is triggered in the presence of prekallikrein, a serine protease, resulting in subsequent activation of factor XI (FXI) that further leads to the middle phase of the intrinsic pathway of blood coagulation (Gailani et al., *J Thromb Haemost* 5, 1106-12 (2007)). Therefore, functional genetic variants in either F11 or KLKB1 may modulate DVT risk. For example, it is known that high levels of FXI are associated with increased risk of DVT (Meijers et al., *N Engl J Med* 342, 696-701 (2000)). To identify causal markers, an analysis involving comprehensive genotyping and association with DVT testing in the CYP4V2/KLKB1/F11 locus was carried out, which is described here in Example Four.

Results and Discussion

According to the HapMap CEPH dataset, the entire locus containing CYP4V2, KLKB1 and F11 resides in a region of high LD that is distinct from adjacent LD regions. To identify the causal marker(s), the region containing these genes was interrogated with 103 SNPs. The majority of these markers (90.3%) were selected to cover SNP diversity in the region. These 103 SNPs were first evaluated in two sample sets that contained 2,210 controls and 1,841 DVT cases: The Leiden Thrombophilia Study (LETS) and a subset of The Multiple Environmental and Genetic Assessment (MEGA) study, MEGA-1. The allelic association between 54 SNPs and DVT reached a significance level of 0.05; the 7 most significant markers were clustered in the F11 gene (Table 17). Two highly correlated F11 SNPs, rs3756011 and rs2289252 ($r^2$=0.98), showed the strongest association with DVT (P=5.2×10$^{-9}$ and 3.2×10$^{-9}$, and OR=1.30 [1.19-1.42] and 1.31 [1.20-1.43], respectively).

To examine whether significant associations of these 54 SNPs were independent of each other, logistic regression models were evaluated for each possible pair of SNPs. Attempting to identify the most parsimonious set of SNPs that showed independent association with DVT risk, it was observed that the two strongest markers in F11, rs3756011 and rs2289252, remained significant after adjustment for any other markers except each other. Furthermore, they were the only markers whose significance was not appreciably attenuated after adjustment by other markers. Because LD between rs3756011 and rs2289252 was very high ($r^2$=0.98), further analysis only included rs2289252.

To determine if any of the other markers made contributions to DVT risk, a search was carried out for those markers that were significantly associated with DVT after adjustment for rs2289252, which lead to the identification of 17 markers. Significance of these 17 markers was modest after the adjustment (P ranged from 0.0043 to 0.046). Within these markers, six were identified that were in high LD with one of the other significant markers ($r^2$>0.95); the marker with the weaker association was removed from the list of 17 markers, leaving 11 markers.

To further examine the relationship between the above 11 markers and rs2289252, the markers were then tested in another large DVT case-control study (MEGA-2: 1,314 cases and 2,877 controls). Further statistical analyses was performed in the three sample sets combined instead of using a discovery-replication approach, as the former provides greater power (Skol et al., *Nat Genet* 38, 209-3 (2006)). All eleven SNPs remained significant in a combined analysis of all samples (Mantel-Haenszel P<0.05, Table 18).

To identify a subset of the 11 SNPs that independently contributed to the association signals, two different analyses were performed: forward stepwise logistic regression and multiple logistic regressions. For forward stepwise logistic regression analysis, the selection procedure required a P-value<0.05 as a criterion for entry into the model where sample set, sex and age were covariates. A final model was derived that contained 3 markers, rs2289252, rs2036914 and rs13146272 (Table 14). No other SNPs were able to enter the model at a significance threshold of 0.05. The multiple logistic regression analysis identified rs2289252 as the most significant association after adjustment for age, sex and study (OR [95% CI]=1.21 [1.11-1.32]). The next strongest associations were rs2036914 (OR [95% CI]=1.13 [0.98-1.32]) and rs13146272 (OR [95% CI]=1.09 [0.98 to 1.21]). Thus these three markers were the most informative ones among those interrogated in this study.

Two of the independent markers, rs2289252 (the same marker as reported in Smith et al., *JAMA* 297, 489-98 (2007)) and rs2036914, are in F11, and the third one, rs13146272, is in CYP4V2. All three markers appeared to operate in an additive model, with odds ratios up to 1.84 for the risk homozygote (Table 15). LD was modest between the two F11 markers ($r^2$=0.38) and low between either of the F11 markers and the CYP4V2 marker ($r^2$=0.12 and 0.04, respectively) (Table 19). These markers are common (for example, ~27% of the population tested in these sample sets are risk homozygote carriers of rs2036914), indicating high DVT risk among a sizable fraction of the population. Furthermore, in contrast to the infrequent Factor V Leiden variant and prothrombin G20210A polymorphism that are mostly present in Caucasians, all three independent SNPs noted here are of similarly high frequencies in Asians and Africans, indicating that they also make a substantial contribution to DVT risk in these populations.

Both the F11 SNPs, rs2036914 and rs2289252, are intronic, thus these markers (or variants in high LD) may alter transcriptional regulatory elements such as an enhancer and these variants may modulate expression of F11. Therefore, association of the individual genotype and the level of FXI was tested in the LETS sample set. The genotype of rs2289252 was significantly associated with FXI levels ($P_{trend}$=2.1×10$^{-20}$, N=895). The genotype of rs2036914 has been shown to be associated with the level of FXI (Bezemer et al., *JAMA* 299, 1306-14 (2008)). The third SNP, rs13146272, is a missense variant (K259Q) of CYP4V2. CYP4V2 may play a role in fatty acid and steroid metabolism, and mutations in the gene cause autosomal recessive retinal dystrophy (Li et al., *Am J Hum Genet* 74, 817-26 (2004)). However, given the correlation of the CYP4V2 marker with the level of FXI (Bezemer et al., *JAMA* 299, 1306-14 (2008)), its genetic effect on DVT susceptibility may be indirectly mediated through FXI protein. This indirect effect may arise from a long-range transcriptional regulatory element of F11 encompassing the CYP4V2 SNP or its proxies (for example, rs2292425, an intronic SNP also in CYP4V2, which is in perfect LD [$r^2$=1]); rs13146272 lies 67 kb upstream of the F11 gene, and long range regulatory elements have been observed across multiple genes (Kapranov et al., *Nat Rev Genet.* 8, 413-23 (2007)). Alternatively, the CYP4V2 SNP may be in high LD with another variant in or more proximal to the F11 gene that is capable of directly regulating F11 expression.

For all three markers, risk allele carriers had higher levels of FXI than those without the risk allele, and risk homozygote carriers had higher levels of FXI than the heterozygote carriers. In addition, the relative difference of the average FXI levels among individuals of different genotypes was greater for the F11 markers than for the CYP4V2 marker. For example, the average level of FXI in risk homozygote carriers was 119% for rs2289252, 119% for rs2036914, and 108% for rs13146272 relative to the non-carriers. Furthermore, in the model with all three SNPs, each risk allele of rs2289252 resulted in an increase of 7.6 units of FXI levels on average (P=$3.7 \times 10^{-10}$; it had an effect of 8.8 units and P=$2.1 \times 10^{-20}$ prior to adjustment by the other two SNPs), while the effect of rs2036914 alleles was only 1.9 units of FXI level (P=0.15; compared to an effect of 7.2 and p=$5.6 \times 10^{-13}$ prior to adjustment), and the effect of rs13146272 was 0.6 units per allele after adjustment (P=0.60; compared to an effect of 3.4 and P=0.002 prior to adjustment). The direction of the effect was consistent with the expected increase of DVT risk with high levels of FXI (Meijers et al., *N Engl J Med* 342, 696-701 (2000)).

To determine whether FXI levels contributed to the observed SNP-disease association, association of the three independent markers with DVT was re-tested following adjustment by Factor XI levels. For each of the three SNPs in the combined LETS and MEGA-1 sample sets, the adjustment for FXI levels lowered the risk estimates and increased the P values, but the association with DVT remained significant (Table 16).

In summary, the majority of the common genetic variants in the CYP4V2/KLKB1/F11 locus were analyzed. In addition, the large case control collections, with a total of >8,000 individuals, offered high power to not only convincingly implicate common SNPs of even modest effect in disease susceptibility but also reasonably distinguish their relationship (dependence) among various markers. Three independent SNPs, in particular, in the CYP4V2/KLKB1/F11 locus were identified that are associated with DVT. In addition, there was a strong correlation between genotype of each of these three independent markers and FXI levels. Directionality of the genotypic effect on DVT risk and that on FXI levels were congruent with earlier evidence that individuals with high levels of FXI are at elevated risk of DVT (Bezemer et al., *JAMA* 299, 1306-14 (2008) and Meijers et al., *N Engl J Med* 342, 696-701 (2000)), and SNPs associated with higher increase in FXI show stronger association with disease risk. Furthermore, adjustment of SNP-disease association by FXI protein did not abate the observed association. These genetic variants may directly or indirectly modulate F11 expression, thereby contributing to the differential risk of DVT, although prekallikrein and FXI expression may be co-regulated.

These markers may also be associated with other conditions such as myocardial infarction (Doggen et al., *Blood* 108, 4045-51 (2006) and Merlo et al., *Atherosclerosis* 161, 261-7 (2002)) and ischemic stroke (Yang et al., *Am J Clin Pathol* 126, 411-5 (2006)), where high levels of FXI may be a risk factor as well. Thus, in addition to their utility in predicting DVT risk, these markers may also be useful for predicting an individual's risk for myocardial infarction, ischemic stroke, and other diseases in which high levels of FXI are a risk factor for the disease.

Methods

LETS and MEGA Samples

The three case control sample sets used in this study included Caucasian individuals, primarily Northwestern Europeans; all provided informed consent. The Leiden Thrombophilia Study (LETS) sample set consisted of 443 cases (43% male) with a first confirmed DVT and 453 controls (42% male) with no history of DVT or PE. The participants were 18 to 70 years old without cancer when enrolled in the study, with a mean age (±SD) of 45 (±14) years for cases and 45 (±15) years for controls. The Multiple Environmental and Genetic Assessment (MEGA) study comprised participants aged 18 to 80 years, cases with first DVT and controls without history of DVT or PE. Two sample sets were derived from this study, MEGA-1 with 1,398 cases (47% male) and 1,757 controls (48% male) and MEGA-2 with 1,314 cases (48% male) and 2,877 controls (47% male). The mean ages of the cases and controls are 47±13 and 48±12 years in MEGA-1 and 48±13 and 47±12 years in MEGA-2, respectively. The total sample size is 3,155 cases and 5,087 controls. Additional information can be found in Bezemer et al., *JAMA* 299, 1306-14 (2008).

SNP Selection

Upon initial discovery of the association of CYP4V2 with DVT, additional genotyping and statistical analysis was carried out in a limited scope (Bezemer et al., *JAMA* 299, 1306-14 (2008)). In the study described here in Example Four, a comprehensive analysis of SNPs in the 4q35 locus and those of putative functional significance was carried out. The fine-mapping region was determined by examination of the LD structure at the CYP4V2/KLKB1/F11 locus in the HapMap CEPH dataset and was defined by two SNP landmarks, rs4862644 at 187,294,806 bp and rs13150040 at 187,494,774 bp on chromosome 4 (NCBI Build 36), encompassing 200 kbp. The targeted region covers the LD block containing the initial significant marker and a portion of the neighboring blocks and contains 320 known SNPS (187 of these with allele frequency than 2%) in the HapMap dataset. Selected markers included those that capture the SNP diversity in the defined region; they were identified by the tagger program, using the HapMap CEPH dataset and the following criteria: minimum allele frequency of 0.02 and pair wise $r^2$ threshold of 0.8. Additional markers included missense/nonsense SNPs and those that are in high LD with any of the three significant SNPs previously reported, rs13146272 in CYP4V2, rs2036914 and rs3756008, both in F11 ($r^2$>0.2).

Genotyping

Genotyping of individual samples was determined by allele-specific real-time PCR using primers designed and validated in Celera's high-throughput genotyping laboratory (Germer et al., *Genome Res* 10, 258-66 (2000)). Case and control samples were randomly arrayed in 384-well plates for the PCR reaction, and genotypes were assigned by an automated algorithm and subjected to manual inspection of assay qualities by a technician without the knowledge of case and control status. Genotyping accuracy in this laboratory has been consistently higher than 99% (Li et al., *Proc Natl Acad Sci USA* 101, 15688-93 (2004)).

Statistical Analyses

Hardy-Weinberg equilibrium for each genotyped SNP was examined in cases and controls separately by an exact test. Linkage disequilibrium measurements, D' and $r^2$ were calculated from the unphased genotype data using LDMax in the GOLD package (Abecasis et al., *Bioinformatics* 16, 182-3 (2000)). Odds ratios in individual sample sets were calculated using the observed allele counts. Allelic association of the SNPs with disease was determined by the $\chi^2$ test in individual sample sets and by Mantel-Haenszel methods to combine odds ratios (OR) across the sample sets. P-values were 2 sided. Evidence for heterogeneity of effects across sample sets was examined by the Breslow-Day test (Breslow et al., *IARC Sci Publ*, 5-338 (1980)). Logistic regression was used to estimate odds ratios while adjusting for covariates such as age, sex, sample set, and Factor XI levels. To assess the relative importance among the significant markers (reference Cordell and Clayton here), logistic regression models were performed for each possible pair of SNPs as well as stepwise logistic regression models. These models assumed an additive effect of each additional risk allele on the log odds of DVT. Linear regression models were performed to estimate the effect of SNPs on Factor XI levels and to test for an increasing trend of mean Factor XI levels assuming an additive effect of each additional risk allele for a given SNP.

TABLE 14

SNPs in the final model by forward selection procedures in LETS, MEGA-1 and MEGA-2 samples combined

| SNP | Model* | OR (95% CI)** | P*** |
|---|---|---|---|
| rs2289252 | TT vs CC | 1.49 (1.25-1.76) | $3.8 \times 10^{-6}$ |
|  | CT vs CC | 1.28 (1.13-1.45) | $1.0 \times 10^{-4}$ |
| rs2036914 | CC vs TT | 1.33 (1.11-1.59) | $1.8 \times 10^{-3}$ |
|  | CT vs TT | 1.19 (1.03-1.38) | $1.9 \times 10^{-2}$ |
| rs13146272 | AA vs CC | 1.24 (1.05-1.46) | $1.1 \times 10^{-2}$ |
|  | AC vs CC | 1.14 (0.97-1.34) | $9.5 \times 10^{-2}$ |

*risk genotype vs reference genotype
**adjusted by age, sex, sample set, and other SNPs in the model
***chi-square test

TABLE 15

Association of the three independently significant SNPs with DVT in LETS, MEGA-1 and MEGA-2 samples combined

| SNP/Gene | Genotype | Case (N) | Case (%) | Control (N) | Control (%) | OR (95% CI) | P* |
|---|---|---|---|---|---|---|---|
| rs2289252 | TT | 716 | 23.5 | 849 | 17.1 | 1.84 (1.62-2.10) | $1.7 \times 10^{-20}$ |
| F11 | TC | 1511 | 49.6 | 2341 | 47.1 | 1.41 (1.27-1.57) |  |
|  | CC | 817 | 26.8 | 1785 | 35.9 | 1.00 (reference) |  |
| rs2036914 | CC | 1080 | 35.1 | 1364 | 27.4 | 1.84 (1.61-2.10) | $6.5 \times 10^{-19}$ |
| F11 | CT | 1499 | 48.7 | 2450 | 49.3 | 1.42 (1.26-1.61) |  |
|  | TT | 499 | 16.2 | 1159 | 23.3 | 1.00 (reference) |  |
| rs13146272 | AA | 1391 | 47.2 | 1986 | 41.8 | 1.58 (1.29-1.76) | $2.1 \times 10^{-7}$ |
| CYP4V2 | AC | 1263 | 42.8 | 2132 | 44.9 | 1.28 (1.09-1.49) |  |
|  | CC | 295 | 10.0 | 635 | 13.4 | 1.00 (reference) |  |

*logistic regression analysis adjusted by sample sets

TABLE 16

Association of rs2289252, rs13146272 and rs2036914 with DVT in the LETS and MEGA-1 sample sets after adjustment by Factor XI

| SNP | Model* | OR (95% CI) | P |
|---|---|---|---|
| rs2289252 | CT vs CC | 1.27 (1.09-1.47) | 0.002 |
|  | TT vs CC | 1.39 (1.15-1.69) | 0.001 |
| rs2036914 | CT vs TT | 1.26 (1.07-1.48) | 0.006 |
|  | CC vs TT | 1.42 (1.19-1.70) | <0.001 |
| rs13146272 | CA vs CC | 1.27 (1.04-1.56) | 0.018 |
|  | AA vs CC | 1.40 (1.14-1.71) | 0.001 |

*adjusted for FXI and study

TABLE 17

Significant markers (P < 0.05) in the LETS and MEGA-1 sample sets combined

| SNP | Location (bp)* | SNP Type | Gene Symbol | Allele Risk | Allele Reference | Risk Allele Frequency Case | Risk Allele Frequency Control | OR (95% CI) | P |
|---|---|---|---|---|---|---|---|---|---|
| rs1877321 | 187,316,011 | intron | FAM149A | G | A | 0.784 | 0.763 | 1.13 (1.02-1.26) | 2.24E−02 |
| rs10017419 | 187,345,132 | intergenic |  | T | G | 0.442 | 0.415 | 1.12 (1.02-1.22) | 1.62E−02 |
| rs10866290 | 187,351,473 | intron | CYP4V2 | C | T | 0.357 | 0.335 | 1.1 (1-1.21) | 4.62E−02 |
| rs10013653 | 187,352,626 | intron | CYP4V2 | A | C | 0.473 | 0.433 | 1.18 (1.08-1.28) | 3.47E−04 |
| rs7682918 | 187,352,835 | intron | CYP4V2 | T | C | 0.436 | 0.401 | 1.15 (1.05-1.26) | 1.82E−03 |

TABLE 17-continued

Significant markers (P < 0.05) in the LETS and MEGA-1 sample sets combined

| SNP | Location (bp)* | SNP Type | Gene Symbol | Allele Risk | Allele Reference | Risk Allele Frequency Case | Risk Allele Frequency Control | OR (95% CI) | P |
|---|---|---|---|---|---|---|---|---|---|
| rs7684025 | 187,353,221 | intron | CYP4V2 | A | G | 0.508 | 0.464 | 1.19 (1.09-1.3) | 9.32E−05 |
| rs4862662 | 187,355,656 | intron | CYP4V2 | T | G | 0.458 | 0.416 | 1.19 (1.09-1.3) | 1.67E−04 |
| rs13146272 | 187,357,205 | missense | CYP4V2 | A | C | 0.682 | 0.642 | 1.2 (1.09-1.31) | 1.51E−04 |
| rs3817184 | 187,359,298 | intron | CYP4V2 | T | C | 0.464 | 0.421 | 1.19 (1.09-1.3) | 1.06E−04 |
| rs2276917 | 187,366,989 | intron | CYP4V2 | A | G | 0.639 | 0.615 | 1.11 (1.01-1.21) | 2.75E−02 |
| rs1877320 | 187,368,273 | intron | CYP4V2 | A | G | 0.905 | 0.885 | 1.24 (1.08-1.44) | 3.12E−03 |
| rs9995366 | 187,368,378 | intron | CYP4V2 | C | T | 0.902 | 0.882 | 1.22 (1.06-1.41) | 5.98E−03 |
| rs2102575 | 187,368,498 | intron | CYP4V2 | A | G | 0.910 | 0.889 | 1.26 (1.09-1.46) | 2.25E−03 |
| rs1053094 | 187,370,025 | 3UTR | CYP4V2 | T | A | 0.545 | 0.497 | 1.21 (1.11-1.32) | 2.36E−05 |
| rs6842047 | 187,370,570 | 3UTR | CYP4V2 | C | A | 0.910 | 0.891 | 1.23 (1.06-1.43) | 6.50E−03 |
| rs4253236 | 187,385,065 | 5' near gene | KLKB1 | C | T | 0.677 | 0.637 | 1.19 (1.09-1.31) | 1.93E−04 |
| rs2048 | 187,385,127 | 5' near gene | KLKB1 | T | G | 0.565 | 0.515 | 1.23 (1.12-1.34) | 7.13E−06 |
| rs4253238 | 187,385,381 | 5' near gene | KLKB1 | T | C | 0.564 | 0.515 | 1.22 (1.1-1.34) | 8.52E−05 |
| rs1912826 | 187,386,534 | intron | KLKB1 | A | G | 0.565 | 0.515 | 1.22 (1.12-1.34) | 9.43E−06 |
| rs4253252 | 187,394,452 | intron | KLKB1 | G | T | 0.566 | 0.516 | 1.22 (1.12-1.33) | 1.04E−05 |
| rs3733402 | 187,395,028 | missense | KLKB1 | A | G | 0.566 | 0.518 | 1.22 (1.11-1.33) | 1.30E−05 |
| rs4253260 | 187,399,071 | intron | KLKB1 | G | C | 0.859 | 0.835 | 1.2 (1.07-1.36) | 2.86E−03 |
| rs4253302 | 187,410,482 | intron | KLKB1 | A | G | 0.859 | 0.836 | 1.19 (1.06-1.35) | 4.57E−03 |
| rs4253303 | 187,410,540 | intron | KLKB1 | A | G | 0.442 | 0.398 | 1.2 (1.1-1.31) | 6.06E−05 |
| rs4253311 | 187,411,677 | intron | KLKB1 | G | A | 0.565 | 0.519 | 1.21 (1.1-1.32) | 3.37E−05 |
| rs2292423 | 187,412,716 | intron | KLKB1 | A | T | 0.465 | 0.417 | 1.22 (1.11-1.33) | 1.38E−05 |
| rs925453 | 187,416,204 | synonymous | KLKB1 | C | T | 0.708 | 0.687 | 1.11 (1.01-1.22) | 3.52E−02 |
| rs3087505 | 187,416,480 | 3UTR | KLKB1 | G | A | 0.910 | 0.889 | 1.26 (1.09-1.46) | 2.01E−03 |
| rs4253332 | 187,416,797 | 3' near gene | | C | T | 0.701 | 0.679 | 1.11 (1-1.22) | 3.93E−02 |
| rs6844764 | 187,418,527 | intergenic | | G | C | 0.587 | 0.561 | 1.11 (1.02-1.22) | 1.90E−02 |
| rs3756008 | 187,422,379 | 5' near gene | | T | A | 0.468 | 0.408 | 1.27 (1.17-1.39) | 7.66E−08 |
| rs925451 | 187,424,563 | intron | F11 | A | G | 0.458 | 0.392 | 1.31 (1.19-1.43) | 4.44E−09 |
| rs4253399 | 187,425,088 | intron | F11 | G | T | 0.450 | 0.388 | 1.29 (1.18-1.41) | 2.18E−08 |
| rs3822057 | 187,425,146 | intron | F11 | C | A | 0.551 | 0.494 | 1.26 (1.15-1.37) | 3.64E−07 |
| rs4253405 | 187,427,804 | intron | F11 | A | G | 0.664 | 0.628 | 1.17 (1.07-1.28) | 7.14E−04 |
| rs2036914 | 187,429,475 | intron | F11 | C | T | 0.591 | 0.526 | 1.3 (1.19-1.42) | 4.89E−09 |
| rs1593 | 187,432,545 | intron | F11 | A | T | 0.896 | 0.873 | 1.26 (1.1-1.45) | 1.09E−03 |
| rs4253418 | 187,436,491 | intron | F11 | G | A | 0.966 | 0.953 | 1.39 (1.1-1.74) | 4.56E−03 |
| rs2241817 | 187,437,995 | intron | F11 | A | G | 0.674 | 0.645 | 1.14 (1.04-1.25) | 5.03E−03 |
| rs4253422 | 187,441,996 | intron | F11 | C | G | 0.850 | 0.834 | 1.13 (1-1.28) | 4.31E−02 |
| rs3822058 | 187,443,174 | intron | F11 | G | A | 0.675 | 0.644 | 1.15 (1.05-1.26) | 3.15E−03 |
| rs3756011 | 187,443,243 | intron | F11 | A | C | 0.485 | 0.420 | 1.3 (1.19-1.42) | 5.15E−09 |
| rs2289252 | 187,444,375 | intron | F11 | T | C | 0.485 | 0.419 | 1.31 (1.2-1.43) | 3.23E−09 |
| rs4253430 | 187,447,058 | 3UTR | F11 | G | C | 0.676 | 0.645 | 1.15 (1.05-1.26) | 3.61E−03 |
| rs11938564 | 187,449,128 | intergenic | | T | G | 0.807 | 0.786 | 1.14 (1.02-1.27) | 1.85E−02 |
| rs13136269 | 187,454,002 | intergenic | | T | C | 0.758 | 0.721 | 1.21 (1.1-1.34) | 1.49E−04 |
| rs13116273 | 187,454,880 | intergenic | | G | A | 0.758 | 0.723 | 1.2 (1.08-1.32) | 4.05E−04 |
| rs10025152 | 187,462,298 | intergenic | | G | A | 0.857 | 0.829 | 1.23 (1.09-1.39) | 8.43E−04 |
| rs1008728 | 187,463,667 | intergenic | | T | C | 0.656 | 0.622 | 1.16 (1.06-1.27) | 1.91E−03 |
| rs12500826 | 187,464,445 | intergenic | | C | T | 0.658 | 0.624 | 1.16 (1.06-1.27) | 1.91E−03 |
| rs13133050 | 187,467,731 | intergenic | | C | A | 0.696 | 0.672 | 1.11 (1.01-1.23) | 2.58E−02 |
| rs6552971 | 187,475,382 | intergenic | | A | G | 0.529 | 0.505 | 1.1 (1.01-1.2) | 3.44E−02 |
| rs6552972 | 187,475,398 | intergenic | | C | T | 0.224 | 0.197 | 1.17 (1.05-1.31) | 3.72E−03 |
| rs9993749 | 187,476,843 | intergenic | | T | G | 0.275 | 0.254 | 1.11 (1.01-1.23) | 3.79E−02 |

*on chromsome 4, based on NCBI Build 36

For the SNPs provided in Table 17, SEQ ID NOs of exemplary sequences are indicated in Tables 1-2, with the exception of the following SNPs for which SEQ ID NOs of exemplary genomic context sequences provided in the Sequence Listing are as follows:

rs10017419=SEQ ID NO:2559
rs10866290=SEQ ID NO:2560
rs2276917=SEQ ID NO:2561
rs1877320=SEQ ID NO:2562
rs9995366=SEQ ID NO:2563
rs2102575=SEQ ID NO:2564
rs6842047=SEQ ID NO:2565
rs2048=SEQ ID NO:2566
rs4253238=SEQ ID NO:2567
rs1912826=SEQ ID NO:2568
rs4253252=SEQ ID NO:2569
rs4253260=SEQ ID NO:2570
rs4253311=SEQ ID NO:2571
rs925453=SEQ ID NO:2572
rs4253332=SEQ ID NO:2573
rs1593=SEQ ID NO:2574
rs4253422=SEQ ID NO:2575
rs11938564=SEQ ID NO:2576
rs10025152=SEQ ID NO:2577
rs1008728=SEQ ID NO:2578
rs13133050=SEQ ID NO:2579
rs9993749=SEQ ID NO:2580

TABLE 18

Significant markers (P < 0.05) in the LETS, MEGA-1
and MEGA-2 sample sets combined

| SNP | Gene Symbol | Allele | | Risk Allele Frequency | | OR | P |
|---|---|---|---|---|---|---|---|
| | | Risk | Reference | Case | Control | | |
| rs13146272 | CYP4V2 | C | A | 0.686 | 0.642 | 1.21 (1.13-1.30) | 2.88E−08 |
| rs3817184 | CYP4V2 | C | T | 0.469 | 0.417 | 1.23 (1.16-1.32) | 1.63E−10 |
| rs1053094 | CYP4V2 | A | T | 0.550 | 0.493 | 1.25 (1.17-1.33) | 5.47E−12 |
| rs4253236 | CYP4V2 | T | C | 0.676 | 0.639 | 1.17 (1.09-1.25) | 3.02E−06 |
| rs3733402 | KLKB1 | G | A | 0.568 | 0.517 | 1.23 (1.15-1.31) | 3.35E−10 |
| rs4253302 | KLKB1 | G | A | 0.859 | 0.837 | 1.18 (1.08-1.30) | 1.92E−04 |
| rs4253303 | KLKB1 | G | A | 0.448 | 0.395 | 1.24 (1.17-1.33) | 4.44E−11 |
| rs2292423 | KLKB1 | T | A | 0.468 | 0.411 | 1.25 (1.18-1.34) | 5.59E−12 |
| rs2036914 | F11 | T | C | 0.594 | 0.521 | 1.34 (1.26-1.43) | 3.58E−19 |
| rs4253418 | F11 | A | G | 0.966 | 0.956 | 1.31 (1.10-1.55) | 1.43E−03 |
| rs2289252 | F11 | C | T | 0.483 | 0.406 | 1.35 (1.27-1.45) | 2.96E−20 |

TABLE 19

Marker LD in the LETS, MEGA-1 and MEGA-2 sample sets combined (controls):
D' shown in the upper right triangle, r² shown in the lower left triangle

| | rs13146272 | rs3817184 | rs1053094 | rs4253236 | rs3733402 | rs4253302 | rs4253303 | rs2292423 | rs2036914 | rs4253418 | rs2289252 |
|---|---|---|---|---|---|---|---|---|---|---|---|
| rs13146272 | | 0.993 | 0.58 | 0.618 | 0.546 | 0.955 | 0.912 | 0.781 | 0.443 | 0.812 | 0.338 |
| rs3817184 | 0.392 | | 0.986 | 0.812 | 0.772 | 0.931 | 0.889 | 0.82 | 0.587 | 0.717 | 0.351 |
| rs1053094 | 0.182 | 0.716 | | 0.843 | 0.804 | 0.954 | 0.901 | 0.918 | 0.585 | 0.723 | 0.461 |
| rs4253236 | 0.382 | 0.267 | 0.39 | | 0.991 | 0.993 | 0.983 | 0.985 | 0.397 | 0.937 | 0.235 |
| rs3733402 | 0.178 | 0.398 | 0.586 | 0.593 | | 0.993 | 0.964 | 0.981 | 0.55 | 0.93 | 0.412 |
| rs4253302 | 0.319 | 0.12 | 0.172 | 0.34 | 0.205 | | 0.994 | 0.995 | 0.56 | 0.995 | 0.35 |
| rs4253303 | 0.302 | 0.72 | 0.544 | 0.356 | 0.565 | 0.125 | | 0.979 | 0.659 | 0.932 | 0.37 |
| rs2292423 | 0.238 | 0.658 | 0.608 | 0.383 | 0.63 | 0.134 | 0.892 | | 0.686 | 0.939 | 0.418 |
| rs2036914 | 0.118 | 0.227 | 0.307 | 0.097 | 0.298 | 0.066 | 0.26 | 0.303 | | 0.968 | 0.773 |
| rs4253418 | 0.054 | 0.017 | 0.024 | 0.072 | 0.043 | 0.009 | 0.026 | 0.028 | 0.047 | | 1 |
| rs2289252 | 0.043 | 0.117 | 0.149 | 0.021 | 0.108 | 0.016 | 0.131 | 0.17 | 0.376 | 0.031 | |

Example Five

SNPs Associated with Venous Thrombosis (Analysis in LETS, MEGA-1, and/or MEGA-2)

Tables 20-23 provide SNPs associated with VT, particularly DVT, in the LETS, MEGA-1, and/or MEGA-2 sample sets (these sample sets are described in Examples One through Four above). Specifically, Table 20 provides unadjusted additive and genotypic association with DVT for 149 SNPs that were tested in both MEGA-1 and LETS, and were associated with DVT in both of these sample sets (p-value cutoff <=0.05 in MEGA-1 and p-value cutoff <=0.1 in LETS, in at least one model). Table 21 provides unadjusted association of 92 SNPs with DVT in LETS (p<=0.05) that have not yet been tested in the MEGA-1 sample set, and Table 22 provides unadjusted association of 9 SNPs with DVT in MEGA-1 (p<=0.05) that have not yet been tested in the LETS sample set. Table 23 provides age- and sex-adjusted association with DVT for 41 SNPs that were tested in the three sample sets LETS, MEGA-1, and MEGA-2.

Example Six

SNPs Associated with Recurrent Venous Thrombosis

Table 24 provides three SNPs that are examples of SNPs associated with recurrence of VT (p-value cutoff <=0.05 in MEGA-1 and MEGA-2 combined).

The MEGA study has been described previously (Blom et al., *JAMA* 2005; 293(6):715-722). An analysis for association of SNPs specifically with recurrent VT in MEGA is ongoing. Briefly, approximately 4000 individuals (cases) who have had a first-time VT in MEGA are being followed-up for about 5 years, and time to the next event (if any) is being recorded. Currently, this recurrent VT analysis in MEGA is approximately at the halfway point, and approximately 600 recurrent cases have been recorded. Certain SNPs have been specifically identified as examples of SNPs that are associated with recurrent VT, and these SNPs are provided in Table 24 below. These SNPs are particularly useful for, for example, determining the risk for individual who has already had VT of having another occurrence of VT.

TABLE 24

Two examples of SNPs associated with VT recurrence in MEGA (combined) (p <= 0.05).

| Gene | SNP | Risk allele | Genotype | VT recurrence (counts) | No VT recurrence (counts) | OR | 95% CI | p-value (Fisher Exact) |
|---|---|---|---|---|---|---|---|---|
| F5 | rs6025 | A | GG | 406 | 2235 | 1 | | |
| | | | GA | 101 | 387 | 1.44 | 1.13-1.83 | 0.004032 |
| | | | AA | 5 | 16 | 1.72 | 0.63-1.72 | 0.355669 |
| ABO | rs8176719 | | O | 121 | 793 | 1 | | |
| | | | non-O | 447 | 2245 | 1.31 | 1.05-1.62 | 0.015636 |

Example Seven

SNPs Associated with Pulmonary Embolism (PE)

Table 25 provides 52 SNPs that are examples of SNPs associated with pulmonary embolism (PE) (p-value cutoff <= 0.05 in MEGA-1 and MEGA-2 combined). SNPs associated with PE are also described in Example Three above. Example Three also provides further information regarding PE as well as information pertaining to methods and study populations in MEGA for determining associations with PE. Cases were individuals with a confirmed PE and no history of VT, and controls were individuals with no history of either PE or VT. The SNPs provided in Table 25 had a p-value <=0.05 when comparing these cases and controls in the combined MEGA-1 and MEGA-2 studies. These SNPs are particularly useful for, for example, determining an individual's risk for PE.

Example Eight

SNPs Associated with Venous Thrombosis in Individuals Who have Cancer

Table 26 provides 31 SNPs that are examples of SNPs that are associated with VT, particularly DVT, in individuals who have cancer (p-value cutoff <=0.05 in MEGA-1 and MEGA-2 combined). The SNPs provided in Table 26 had a p-value <= 0.05 when comparing individuals (cases) in the combined MEGA-1 and MEGA-2 studies who had both cancer (of any type) and DVT compared with individuals (controls) who had neither cancer nor DVT. These SNPs are particularly useful for, for example, determining risk for VT in individuals who have cancer.

Example Nine

Fine-Mapping/Linkage Disequilibrium SNPs Associated with Venous Thrombosis

Table 27 provides 123 SNPs associated with VT, particularly DVT, in LETS (p-value cutoff <=0.1 in LETS) based on fine-mapping/linkage disequilibrium analysis. Table 27 provides additive association with DVT for each SNP, as well as linkage disequilibrium data from Hapmap. Table 27 specifically provides SNPs based on fine-mapping/linkage disequilibrium analysis around the following target genes and SNPs (as indicated in Table 27): gene AKT3 (SNP hCV233148), gene SERPINC1 (SNP hCV16180170), gene RGS7 (SNP hCV916107), gene NR1I2 (SNP hCV263841), gene FGG (SNP hCV11503469), gene CYP4V2 (SNP hCV25990131), gene GP6 (SNP hCV8717873), and gene F9 (SNP hCV596331).

The AKT3 gene and SNP rs1417121/hCV233148 are an example of a target around which fine-mapping/linkage disequilibrium analysis was carried out. Results of the association of AKT3 SNPs with DVT are provided in Table 27 (in LETS), as well as in Tables 28-29 below (which provide results in MEGA-1 as well as in LETS (Table 29), and in MEGA-2 for rs1417121 (Table 28)).

SNP rs1417121/hCV233148 in the AKT3 gene was identified among 24,965 SNPs tested in a functional genome scan (scan WGS38-V0013; Bezemer et al., *JAMA* 299, 1306-14 (2008)) and found by genotyping to be associated with DVT and PE in LETS, MEGA-1, and MEGA-2 with a p-value<0.05 and a consistent risk allele in all three studies (Tables 28-29). The FDR for this SNP is 0.044 in MEGA-2. To determine whether other SNPs in this region are associated with DVT, results from the HapMap Project were used to identify a region surrounding SNP rs1417121/hCV233148 (chr1:241735973). This region contained 228 SNPs with allele frequencies>2% (HapMap NCBI build 36, 2005). Allele frequencies and linkage disequilibrium were calculated from the SNP genotypes in the HapMap CEPH population, which includes Utah residents with ancestry from northern and western Europe. 36 of these 228 SNPs were selected for genotyping in LETS as surrogates for 205 of these 228 SNPs. Thus, these 205 SNPs included the 36 SNPs that were directly genotyped plus 169 SNPs that were in strong linkage disequilibrium ($r^2$>0.8) with at least one of the 36 genotyped SNPs (these 36 SNPs may be referred to as "tagging SNPs"). The 36 tagging SNPs were chosen using pairwise tagging in Tagger (de Bakker et al. 2005) (implemented in Haploview (Barrett et al. 2005)). 62 SNPs (including the 36 tagging SNPs) were initially investigated in LETS, and 29 SNPs that were equally or more strongly associated with DVT in LETS than SNP rs1417121/hCV233148 were investigated in MEGA-1. 20 SNPs were associated with DVT in both LETS and MEGA-1 with an additive p-value<0.05 and a consistent risk allele (these 20 SNPs are shown in Table 29 below).

TABLE 28

Age and sex-adjusted associations of an AKT3 SNP with DVT in MEGA-2

| Gene Symbol (RS Number) | Chr:B36 Region | parameter | Case (frequency) | Control (frequency) | P value | Odds ratio (95% CI) | FDR* |
|---|---|---|---|---|---|---|---|
| AKT3 (rs1417121) | 1:241735973 | CC_vs_GG | 126 (0.1) | 214 (0.08) | 0.009 | 1.38 (1.08-1.75) | |
| | | CG_vs_GG | 494 (0.4) | 1074 (0.39) | 0.333 | 1.07 (0.93-1.24) | |
| | | G G | 626 (0.5) | 1458 (0.53) | ref | ref | 0.044 |
| | | C_vs_G | | (0.27) | 0.018 | 1.13 (1.02-1.26) | |

TABLE 29

Additive associations of 20 replicated AKT3 fine-mapping SNPs in LETS and MEGA-1

| | | LETS | | MEGA-1 | |
|---|---|---|---|---|---|
| annotation | additive comparison | p-value | OR (95% CI) | p-value | OR (95% CI) |
| AKT3 (rs10737888) | C_vs_A | 4E−05 | 1.58 (1.27-1.96) | 0.001 | 1.21 (1.08-1.36) |
| AKT3 (rs6656918) | G_vs_A | 5E−05 | 1.56 (1.26-1.94) | 0.003 | 1.19 (1.06-1.34) |
| AKT3 (rs1538773) | G_vs_T | 1E−04 | 1.55 (1.24-1.92) | 0.006 | 1.18 (1.05-1.32) |
| AKT3 (rs10927041) | C_vs_T | 0.0001 | 1.59 (1.26-2) | 0.007 | 1.18 (1.05-1.34) |
| AKT3 (rs2290754) | C_vs_A | 0.0001 | 1.57 (1.24-1.97) | 0.019 | 1.15 (1.02-1.3) |
| AKT3 (rs7517340) | T_vs_C | 0.0002 | 1.58 (1.24-2) | 0.003 | 1.2 (1.07-1.36) |
| AKT3 (rs10754807) | A_vs_G | 0.0002 | 1.57 (1.24-1.98) | 0.002 | 1.21 (1.07-1.36) |
| AKT3 (rs320339) | T_vs_G | 0.0003 | 1.51 (1.21-1.9) | 0.002 | 1.21 (1.07-1.37) |
| AKT3 (rs1417121) | C_vs_G | 0.0003 | 1.45 (1.18-1.78) | 0.001 | 1.2 (1.08-1.33) |
| AKT3 (rs6671475) | G_vs_A | 0.0004 | 1.52 (1.21-1.91) | 0.014 | 1.16 (1.03-1.31) |
| AKT3 (rs1058304) | T_vs_C | 0.0004 | 1.45 (1.18-1.78) | 0.008 | 1.16 (1.04-1.29) |
| AKT3 (rs1458023) | C_vs_T | 0.0004 | 1.5 (1.2-1.88) | 0.006 | 1.18 (1.05-1.33) |
| AKT3 (rs12048930) | T_vs_C | 0.001 | 1.47 (1.17-1.86) | 0.026 | 1.15 (1.02-1.29) |
| AKT3 (rs1578275) | C_vs_G | 0.0012 | 1.49 (1.17-1.89) | 0.047 | 1.14 (1-1.29) |
| AKT3 (rs10927035) | C_vs_T | 0.0019 | 1.36 (1.12-1.66) | 0.002 | 1.18 (1.06-1.3) |
| AKT3 (rs12140414) | C_vs_T | 0.0026 | 1.44 (1.14-1.82) | 0.04 | 1.14 (1.01-1.3) |
| AKT3 (rs12037013) | A_vs_G | 0.0029 | 1.49 (1.15-1.93) | 0.021 | 1.18 (1.02-1.35) |
| AKT3 (rs12744297) | G_vs_A | 0.0058 | 1.32 (1.08-1.61) | 0.001 | 1.19 (1.07-1.32) |
| AKT3 (rs10927065) | A_vs_C | 0.01 | 1.4 (1.08-1.8) | 0.013 | 1.18 (1.04-1.34) |
| AKT3 (rs12045585) | A_vs_G | 0.0354 | 1.32 (1.02-1.72) | 0.002 | 1.25 (1.08-1.43) |

Example Ten

Additional SNPs in Linkage Disequilibrium with Venous Thrombosis-Associated Interrogated SNPs An additional analysis was conducted to identify additional SNP markers in linkage disequilibrium (LD) with SNPs which have been found to be associated with VT, such as shown in the tables and described in the Examples. Briefly, the power threshold (T) was set at 51% for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, a threshold level of LD, or $r^2$ value, was derived for each interrogated SNP ($r_T^2$, equations (32) and (33)). The threshold value $r_T^2$ is the minimum value of linkage disequilibrium between the interrogated SNP and its LD SNPs possible such that the non-interrogated SNP still retains a power greater or equal to T for detecting disease-association.

Based on the above methodology, LD SNPs were found for the interrogated SNPs. LD SNPs are listed in Table 4, each associated with its respective interrogated SNP. Also shown are the public SNP IDs (rs numbers) for interrogated and LD SNPs, the threshold $r^2$ value and the power used to determine this, and the $r^2$ value of linkage disequilibrium between the interrogated SNP and its matching LD SNP. As an example, in Table 4, VT-associated interrogated SNP hCV11503414 (rs2066865) was calculated to be in LD with hCV11503416 (rs2066864) at an $r_T^2$ value of 1, using 51% power, thus establishing SNP hCV11503416 as a marker associated with VT as well.

In general, the threshold $r_T^2$ value can be set such that one of ordinary skill in the art would consider that any two SNPs having an $r^2$ value greater than or equal to the threshold $r_T^2$ value would be in sufficient LD with each other such that either SNP is useful for the same utilities, such as determining an individual's risk for VT. For example, in various embodiments, the threshold $r_T^2$ value used to classify SNPs as being in sufficient LD with an interrogated SNP (such that these LD SNPs can be used for the same utilities as the interrogated SNP, for example, such as determining VT risk) can be set at, for example, 0.7, 0.75, 0.8, 0.85, 0.9, 0.95, 0.96, 0.97, 0.98, 0.99, 1, etc. (or any other $r^2$ value in-between these values). Threshold $r_T^2$ values may be utilized with or without considering power or other calculations.

All publications and patents cited in this specification are herein incorporated by reference in their entirety. Modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 3

| Marker | Alleles | Primer 1 (Allele-specific Primer) | |
|---|---|---|---|
| hCV10008773 | T/C | CACGTGTGCTCACTTACAGAT | (SEQ ID NO: 1588) |
| hCV11342584 | A/T | GGCTGCTAGCCAAATACTATTA | (SEQ ID NO: 1591) |
| hCV11466393 | C/G | GGATGGAATGTTTTCCCTAAC | (SEQ ID NO: 1594) |
| hCV11503414 | A/G | TGTTTCCTAAGACTAGATACATGGTAT | (SEQ ID NO: 1597) |
| hCV11503431 | C/T | CCAGTGCTTGCCTTCTC | (SEQ ID NO: 1600) |
| hCV11503469 | A/T | AGTTTACAATCTAATGCAGTGGT | (SEQ ID NO: 1603) |
| hCV11503470 | C/T | AAAATGATGGGAAGTTAGGG | (SEQ ID NO: 1606) |
| hCV11541681 | C/G | CCACCTTCTCTTCAGATTCAC | (SEQ ID NO: 1609) |
| hCV11559107 | A/G | TGAGATTTTGAAGACATCTGGTA | (SEQ ID NO: 1612) |
| hCV11629656 | G/T | CCCCAATAAAAGGACACAGTTAG | (SEQ ID NO: 1615) |
| hCV11629657 | A/G | TGTCCTAAGATTAGCTAATATTTAACAT | (SEQ ID NO: 1618) |
| hCV11633415 | C/T | CCCAGAGGTCTACTATCTGAC | (SEQ ID NO: 1621) |
| hCV11726971 | A/G | GCAAGGTGTCTCCGAATTAT | (SEQ ID NO: 1624) |
| hCV11786147 | G/T | CGTGCGTGAATTGAATGG | (SEQ ID NO: 1627) |
| hCV11786258 | A/G | GTGGAGAATACCCACTCAGT | (SEQ ID NO: 1630) |
| hCV11853483 | A/G | CACACACATCTTTAAAATCCATTCTATT | (SEQ ID NO: 1633) |
| hCV11853496 | A/T | CCTTTCTCACCTGATAGAATGAGT | (SEQ ID NO: 1636) |
| hCV11922386 | C/T | CCTGGCCCTTTCCTACG | (SEQ ID NO: 1639) |
| hCV11942562 | A/G | ACGAATGTGATGGCCACA | (SEQ ID NO: 1642) |
| hCV11962159 | C/T | ATTAAGCAACTGGTTTCCG | (SEQ ID NO: 1645) |
| hCV11975250 | T/C | AGGACAAAATACCTGTATTCCTT | (SEQ ID NO: 1648) |
| hCV11975296 | T/C | CAGTCCATGGTTCCTTCAT | (SEQ ID NO: 1651) |
| hCV11975651 | C/G | CACCTTCCCCACTCTCTTAG | (SEQ ID NO: 1654) |
| hCV11975658 | A/G | GGTGACAGGGGAGAAAAGA | (SEQ ID NO: 1657) |
| hCV1198623 | C/G | CCATGCCTGATACAGAAGAC | (SEQ ID NO: 1660) |
| hCV1202883 | G/A | GCGTGATGATGAAATCGG | (SEQ ID NO: 1663) |
| hCV12066124 | C/T | GCAGCTTTTGCCAGTAAAGAC | (SEQ ID NO: 1666) |
| hCV12073840 | C/T | ACGGACACTGGACATACC | (SEQ ID NO: 1669) |
| hCV12086148 | A/G | GTGAAGGTTTCCCTTTAAGTTACT | (SEQ ID NO: 1672) |
| hCV12092542 | T/C | GCCTTGTCTTCAATTTTGGT | (SEQ ID NO: 1675) |
| hCV12098639 | C/G | GGATGTGGCTTCCCC | (SEQ ID NO: 1678) |
| hCV134275 | A/G | GGTGCTTAGAATACATCAACAAAAT | (SEQ ID NO: 1681) |
| hCV134278 | C/T | TAACCTGATCCATTATCCAAGATAC | (SEQ ID NO: 1684) |
| hCV1376206 | C/T | AGCAGGCTACTACTCCTTC | (SEQ ID NO: 1687) |
| hCV1376207 | C/G | CGTACAGACAGCCGAGG | (SEQ ID NO: 1690) |
| hCV1376227 | A/C | TCTCAACTTGGCTATCTTACAAATA | (SEQ ID NO: 1693) |
| hCV1376246 | A/C | CTTATTGAGTTCATCATTAAAGTCATCT | (SEQ ID NO: 1696) |
| hCV1376342 | C/T | ACTCACCAGTTGTGAAGACTTC | (SEQ ID NO: 1699) |
| hCV1420741 | C/G | CAGGCTTTAAGGACAGGC | (SEQ ID NO: 1702) |

TABLE 3-continued

| hCV1455329 | A/G | CATGTTTTGTGAACAAAGATTCCAT | (SEQ ID NO: 1705) |
| hCV1547677 | A/G | AGGTGACAGTCCCAACACT | (SEQ ID NO: 1708) |
| hCV15755949 | A/G | AATACTTAGTTCTCCCCTCCATAA | (SEQ ID NO: 1711) |
| hCV15793897 | A/G | AGCTCTGAGTGCACTGTGTT | (SEQ ID NO: 1714) |
| hCV15860433 | C/T | ACCCAAGACTTAGTAAACATTCAG | (SEQ ID NO: 1717) |
| hCV15864094 | A/G | GTGGATCAAGCTTCGTTGTTAT | (SEQ ID NO: 1720) |
| hCV15871021 | G/A | AAATCTTGCTCTTTATGAGTATTTG | (SEQ ID NO: 1723) |
| hCV15885425 | A/C | CATTTACAATGTAACAGCAAAACCA | (SEQ ID NO: 1726) |
| hCV15947925 | C/T | GCTCCAGGACAGAGAACG | (SEQ ID NO: 1729) |
| hCV15949414 | A/G | GGCTTTCATAATGCAAATGT | (SEQ ID NO: 1732) |
| hCV15952952 | A/G | AAAGTGGAGAAGGCTCTGAT | (SEQ ID NO: 1735) |
| hCV15953063 | A/G | GTTGGAAATAATGTAGGATGAAGACA | (SEQ ID NO: 1738) |
| hCV15956034 | A/C | CACTGAGCTGAAATGATCCATA | (SEQ ID NO: 1741) |
| hCV15956054 | C/T | CACCCAGTGCAGATTCAC | (SEQ ID NO: 1744) |
| hCV15956055 | G/T | GCAAGAAGGCAAGTCCC | (SEQ ID NO: 1747) |
| hCV15956059 | C/T | TGTAGTTGAAGGACAGAGTGG | (SEQ ID NO: 1750) |
| hCV15956077 | A/G | TTACTCTAACACAGGGTTCCA | (SEQ ID NO: 1753) |
| hCV15968043 | A/T | GCCCAGTTTCAAACAGGA | (SEQ ID NO: 1756) |
| hCV15977624 | A/G | GTCCTCTTCACCAAGGAGT | (SEQ ID NO: 1759) |
| hCV15990789 | A/G | TGAACCTGAGCGTGTCAA | (SEQ ID NO: 1762) |
| hCV16000557 | C/T | ACAAAGTCACACCGAATCG | (SEQ ID NO: 1765) |
| hCV1605386 | A/G | AGTGGGAAACACACAGAAATTTA | (SEQ ID NO: 1768) |
| hCV16135173 | C/G | GGCAACCTCAACACAGAC | (SEQ ID NO: 1771) |
| hCV16170613 | A/G | ACAGCAGGCATTGTTTTCT | (SEQ ID NO: 1774) |
| hCV16172935 | A/G | GGAGTTACACCCATAAACCAT | (SEQ ID NO: 1777) |
| hCV16177220 | C/T | ATCTGGTGGTCATTCAAATG | (SEQ ID NO: 1780) |
| hCV16180170 | C/T | GGGAGAGCACTTGAAATGAC | (SEQ ID NO: 1783) |
| hCV1650632 | C/T | TCATCCAGCCACTCC | (SEQ ID NO: 1786) |
| hCV1678674 | C/T | GGCTTCAAAGTGATAAATTCTATATTCG | (SEQ ID NO: 1789) |
| hCV1678682 | G/T | GGACACAACTCATTATTCTGGG | (SEQ ID NO: 1792) |
| hCV1703855 | C/T | AACGAATGGCATGTATTTTATGG | (SEQ ID NO: 1795) |
| hCV1703867 | C/T | CGATGATTTTGTTCTCATGTTCG | (SEQ ID NO: 1798) |
| hCV1703892 | A/T | CCTGTTGCATTCTGGATACT | (SEQ ID NO: 1801) |
| hCV1703910 | A/G | ACCTATGTAACACACCCTTCTATT | (SEQ ID NO: 1804) |
| hCV1723643 | A/C | ACCCTCACAGCTCTGAAGA | (SEQ ID NO: 1807) |
| hCV1825046 | C/T | TGCACAGTCCCCTGAC | (SEQ ID NO: 1810) |
| hCV1833991 | C/T | GGGAGCCTTAATAAGATTAACAGC | (SEQ ID NO: 1813) |
| hCV1834242 | A/G | CCTACTTTCACAAACATATCTTTGAA | (SEQ ID NO: 1816) |
| hCV1841975 | A/T | TCGTGGAGATACTGCAAGTT | (SEQ ID NO: 1819) |
| hCV1842260 | G/T | TCTCAGGCACCTGGATTAG | (SEQ ID NO: 1822) |

TABLE 3-continued

| | | | |
|---|---|---|---|
| hCV1859855 | C/T | GGCCTCACTAGAGAAGGAGAG | (SEQ ID NO: 1825) |
| hCV1874482 | A/G | AAAGGTTTCTTCTGATCACTGAT | (SEQ ID NO: 1828) |
| hCV18996 | C/T | TGAAGTAATACTGGAGATCAAATTAC | (SEQ ID NO: 1831) |
| hCV1900162 | C/T | CAGTATACCTAGAGCATAGTGG | (SEQ ID NO: 1834) |
| hCV1937195 | A/G | CACAGGGCACAGATAACT | (SEQ ID NO: 1837) |
| hCV1974936 | C/T | TGTGCACAAAGATAGGTCAC | (SEQ ID NO: 1840) |
| hCV1974951 | A/G | CGGGACACCATCCACA | (SEQ ID NO: 1843) |
| hCV1974967 | A/G | CACATCAACGAGAAATTGCTA | (SEQ ID NO: 1846) |
| hCV2017876 | A/G | ACTGCTTCCAGAAGATCAAGT | (SEQ ID NO: 1849) |
| hCV2086329 | A/G | CCCAGCCACACTGTTGA | (SEQ ID NO: 1852) |
| hCV2103346 | C/T | AGGAGCCATGATGCCC | (SEQ ID NO: 1855) |
| hCV2103392 | C/T | CCTCCTCCATGAAGCTGTC | (SEQ ID NO: 1858) |
| hCV2144411 | A/G | AAGCTCCGGGGTTATTGT | (SEQ ID NO: 1861) |
| hCV2211618 | C/G | GGCCATGTGCTGCCATC | (SEQ ID NO: 1864) |
| hCV22272267 | A/G | CTGGCAGCGAATGTTAT | (SEQ ID NO: 1867) |
| hCV2288095 | C/T | TGAGTTAATATTTGTGTAAAGTATGATGTTTAG | (SEQ ID NO: 1870) |
| hCV2303891 | C/G | CACAGTTCTCTGGCTTTTTG | (SEQ ID NO: 1873) |
| hCV233148 | C/G | TCATCACAGGACATTTATGAGAAG | (SEQ ID NO: 1876) |
| hCV2403368 | C/G | AAAGGTGAGCTCCACCATAC | (SEQ ID NO: 1879) |
| hCV2456747 | A/G | CCTCCACTAGAAGACACTACTACTTT | (SEQ ID NO: 1882) |
| hCV2494846 | G/T | CTTCTTCCCTTCGCTCTG | (SEQ ID NO: 1885) |
| hCV2532034 | C/T | CTGAAGCGCAACCATAAC | (SEQ ID NO: 1888) |
| hCV25473516 | T/C | CCACCCAATGCCAAGT | (SEQ ID NO: 1891) |
| hCV25474413 | A/C | GCATTCACAGTGTTCTCATTATAAT | (SEQ ID NO: 1894) |
| hCV25474414 | G/T | CTGCAGAGCTGTAAGAGTG | (SEQ ID NO: 1897) |
| hCV25596789 | C/G | TCTGCTCCATTTTTCTCATG | (SEQ ID NO: 1900) |
| hCV25602230 | G/T | AGCTGAGGAGAGTCCG | (SEQ ID NO: 1903) |
| hCV25611352 | C/T | AATAATTGTAACTCTAGAACAAAAGTATTC | (SEQ ID NO: 1906) |
| hCV25615302 | C/T | GTTCCAGTTCCGATAGC | (SEQ ID NO: 1909) |
| hCV25620145 | A/G | CACACCAGCAATGATGAAACT | (SEQ ID NO: 1912) |
| hCV25634754 | C/T | GTCACTTATTTGAATCCCATTGC | (SEQ ID NO: 1915) |
| hCV25649928 | G/A | AAGACTTTTTCCAGGAATGC | (SEQ ID NO: 1918) |
| hCV25748719 | T/C | CGGCAGCCAATGACAT | (SEQ ID NO: 1921) |
| hCV2575036 | A/G | CAGTTTATGCCTGCAACAAT | (SEQ ID NO: 1924) |
| hCV25752810 | C/A | GCCCATAAGGAGACAGAAAAG | (SEQ ID NO: 1927) |
| hCV25767872 | A/G | CACCATGTGTGTGTTCCAT | (SEQ ID NO: 1930) |
| hCV25768636 | A/G | AGAATTTGGCCACAAAGAGT | (SEQ ID NO: 1933) |
| hCV2590858 | C/T | GAGTGAGAATTCTGTCAAGAGG | (SEQ ID NO: 1936) |
| hCV25932979 | A/G | AAAAGAGGGAGTAAACAACTGT | (SEQ ID NO: 1939) |
| hCV25951992 | A/C | CTGGAAAGATGGAGGCAT | (SEQ ID NO: 1942) |

TABLE 3-continued

| | | | |
|---|---|---|---|
| hCV25959466 | T/C | AAGCGATTCCTCAGCAGT | (SEQ ID NO: 1945) |
| hCV25959498 | G/A | ACAACATAAAACTGACTTGGAAG | (SEQ ID NO: 1948) |
| hCV25990131 | A/C | TGTTGGTAAAAGTATGTAGGATCTT | (SEQ ID NO: 1951) |
| hCV25991132 | A/G | CCAGGAATGGAGACCATCT | (SEQ ID NO: 1954) |
| hCV25995678 | C/T | TCTGTCTTCCACAACCAAAG | (SEQ ID NO: 1957) |
| hCV25996277 | A/T | TATCTCCTTCAAAGGATGCA | (SEQ ID NO: 1960) |
| hCV26034142 | C/T | CAACCTAATTTAAGCCATCATTAACG | (SEQ ID NO: 1963) |
| hCV26034157 | C/T | CAACTCAAACAGGACACTGAG | (SEQ ID NO: 1966) |
| hCV26038139 | A/G | TCAGCTGGCGAAGTTGA | (SEQ ID NO: 1969) |
| hCV2605707 | C/G | GCTGTTAATTCAGGAGGTAAAGC | (SEQ ID NO: 1972) |
| hCV26175114 | A/G | CCAGTCATCTCTGCAGAAAAA | (SEQ ID NO: 1975) |
| hCV26265231 | A/G | GGGATAAATATTACAAACCCATGCTA | (SEQ ID NO: 1978) |
| hCV26338456 | A/G | CACAGAAGATACAGCAAATGGAA | (SEQ ID NO: 1981) |
| hCV26338482 | C/T | AAACAGTAACAGGCTCAGC | (SEQ ID NO: 1984) |
| hCV26338512 | A/G | CAGGCCTCGGAAAATGAA | (SEQ ID NO: 1987) |
| hCV26338513 | C/T | CGCACTTTTAGTGGCTGG | (SEQ ID NO: 1990) |
| hCV263841 | A/C | AGCTAATACTCCTGTCCTGAAA | (SEQ ID NO: 1993) |
| hCV26719108 | C/T | GCAGGGGCATTGGTG | (SEQ ID NO: 1996) |
| hCV26719113 | C/T | CTTACGATTAGTTCCAACATGAATAC | (SEQ ID NO: 1999) |
| hCV26719121 | C/T | CCCACTAAGCACAGGAAAG | (SEQ ID NO: 2002) |
| hCV26719154 | C/T | TGGTCTGTGCCCTCAG | (SEQ ID NO: 2005) |
| hCV26719227 | A/C | TGCCTTGGATATGCTTTAAAGAT | (SEQ ID NO: 2008) |
| hCV26887403 | A/C | CTAGCACTGGAACGATAATAAAGA | (SEQ ID NO: 2011) |
| hCV26887434 | A/C | GACTTTACGACTAATTAGGTATAAAGGTTA | (SEQ ID NO: 2014) |
| hCV26887464 | A/G | GCAGGTCAGATAACTTCTTTATGA | (SEQ ID NO: 2017) |
| hCV26895255 | C/T | CACCGTATTCAGCTGAGAC | (SEQ ID NO: 2020) |
| hCV2699725 | C/G | GTACCTCTTGGTCTCTCTCC | (SEQ ID NO: 2023) |
| hCV27020269 | C/G | CCAGTTTTGCACATTTAAAGATACG | (SEQ ID NO: 2026) |
| hCV2706410 | C/T | CCTCCATGTCATCCTACG | (SEQ ID NO: 2029) |
| hCV27102953 | C/T | TTAGTGTAATGGGCAAGACG | (SEQ ID NO: 2032) |
| hCV27102978 | A/C | CTCCTCCTGTCTCCGTT | (SEQ ID NO: 2035) |
| hCV27103080 | G/T | GGGATGTGCAACCCG | (SEQ ID NO: 2038) |
| hCV27103182 | C/T | GGCATCTCTCAATCCCTACG | (SEQ ID NO: 2041) |
| hCV27103188 | A/G | TGTTTGGACAATGACTTGGAAAT | (SEQ ID NO: 2044) |
| hCV27103189 | A/G | AAGAGGTCAAGCCAATGAAAT | (SEQ ID NO: 2047) |
| hCV27103207 | A/G | GGCTGCCAGGGACAT | (SEQ ID NO: 2050) |
| hCV2716314 | A/C | GGCATACAAATTCAAAATACTGTATA | (SEQ ID NO: 2053) |
| hCV2734332 | A/G | GCCATGTTGACTCGAGAAT | (SEQ ID NO: 2056) |
| hCV2744023 | A/G | CTACCTGTGTCTGTATTTCTTTAAAT | (SEQ ID NO: 2059) |
| hCV27474895 | A/C | GGAGGATACTGAAGTAGCAAACT | (SEQ ID NO: 2062) |

TABLE 3-continued

| | | | |
|---|---|---|---|
| hCV27474984 | A/G | ACTTGAGTTACACCAGACCTA | (SEQ ID NO: 2065) |
| hCV27476043 | A/G | CAGGCCAGGTCAACA | (SEQ ID NO: 2068) |
| hCV27477533 | A/T | GAGGTTCCATGGAGTAAACAATA | (SEQ ID NO: 2071) |
| hCV27480803 | C/T | GCACTAGAAACCTGCCG | (SEQ ID NO: 2074) |
| hCV27490984 | A/G | CTTACTTAGGTCACTTTCAGCA | (SEQ ID NO: 2077) |
| hCV27502514 | A/G | ATATTGGCGAGTTATCTAATGTCTT | (SEQ ID NO: 2080) |
| hCV27833944 | C/T | TGCTAGGGACTAACCTTGG | (SEQ ID NO: 2083) |
| hCV27878067 | A/G | CCCAACTGACCCAAAGGT | (SEQ ID NO: 2086) |
| hCV27902808 | C/T | CAGGCCTGAAGTCTAGGTC | (SEQ ID NO: 2089) |
| hCV27904396 | A/G | GACTACACTACTATGCAATATATCTATGTA | (SEQ ID NO: 2092) |
| hCV27937396 | C/T | GCCTGAATTCTGAGAAGACATAG | (SEQ ID NO: 2095) |
| hCV27956129 | A/C | CCATTTATGCAAAAGCAGAATCA | (SEQ ID NO: 2098) |
| hCV2811695 | A/C | AGTGTTGTATTTGTATGTGTCT | (SEQ ID NO: 2101) |
| hCV2852784 | G/A | CACAGCTCTTCTACTCCACC | (SEQ ID NO: 2104) |
| hCV2879752 | A/G | GGCCTCCTGCTCCAA | (SEQ ID NO: 2107) |
| hCV2892855 | C/T | GGTAATCATTTAACACATTTCATGTTCC | (SEQ ID NO: 2110) |
| hCV2892869 | A/G | TGTGCCAGTCCTTGTGT | (SEQ ID NO: 2113) |
| hCV2892877 | C/T | GCTCTGGACCTGGAAGTG | (SEQ ID NO: 2116) |
| hCV2892893 | A/T | AGTGTGCTCATGATGAAAGAAAA | (SEQ ID NO: 2119) |
| hCV2892905 | C/T | GTGTGATATGACTTTCATTTAGAACG | (SEQ ID NO: 2122) |
| hCV2892918 | A/T | TGCATCCACATAAAATGCTACT | (SEQ ID NO: 2125) |
| hCV2892926 | C/T | GTTCAAGTTAAATGATAGGGTAATACC | (SEQ ID NO: 2128) |
| hCV2892927 | A/T | GTACTTTCTGTTCAACATCTTTTAAGT | (SEQ ID NO: 2131) |
| hCV28960679 | C/G | CCAGACCTCATATTTTCCTTCAG | (SEQ ID NO: 2134) |
| hCV2915511 | C/T | CTGGCTCCTTCTCCGTC | (SEQ ID NO: 2137) |
| hCV29210363 | A/G | GCCATCTACAGGCTTACTCAT | (SEQ ID NO: 2140) |
| hCV29269378 | A/G | CATAATTTGCTTTTGACCACAACA | (SEQ ID NO: 2143) |
| hCV29271569 | C/T | CCAGCCTCAGGTTAAGGATC | (SEQ ID NO: 2146) |
| hCV29521317 | A/G | TCCATTGATACTGCATTAAACCATA | (SEQ ID NO: 2149) |
| hCV2969899 | C/G | GCATCCTGTCAAATACTCTCATTATAG | (SEQ ID NO: 2152) |
| hCV29821005 | C/T | GCAAACTAAAGCAACAATAAGACAC | (SEQ ID NO: 2155) |
| hCV2986575 | A/T | CCTTTGTACTTTAAATCATCTCTAGGT | (SEQ ID NO: 2158) |
| hCV29983641 | A/G | AGAAAATTAAGCCAGGAGAAGTTAA | (SEQ ID NO: 2161) |
| hCV30002208 | A/G | TGCTTTCAGGCAATTTTGAGA | (SEQ ID NO: 2164) |
| hCV30040828 | C/T | GGGGTGAAGAAGAAACCTCC | (SEQ ID NO: 2167) |
| hCV30205817 | C/T | GATGAAGTAGTTCATTTTGAATGGC | (SEQ ID NO: 2170) |
| hCV30440155 | C/G | CTTTGGAGTCTGCTTGTACC | (SEQ ID NO: 2173) |
| hCV30505633 | C/T | CGCTTAACAAAGGTGTTAGAAC | (SEQ ID NO: 2176) |
| hCV30548253 | A/C | GAGAGATAGAGGCAAAGGAAAAT | (SEQ ID NO: 2179) |
| hCV30562347 | A/G | GGCTGTCATTTCAGAAGCA | (SEQ ID NO: 2182) |

TABLE 3-continued

| | | | |
|---|---|---|---|
| hCV305844 | C/G | CTGTGCCCTTCCTGG | (SEQ ID NO: 2185) |
| hCV30626715 | G/T | AGGATGTCTGCCATTATTTCC | (SEQ ID NO: 2188) |
| hCV30690777 | A/G | CCGTGTGCCTGAGAAGT | (SEQ ID NO: 2191) |
| hCV30690778 | C/T | AGGCAGAGTTTCCACTCAG | (SEQ ID NO: 2194) |
| hCV30690780 | A/C | GTGTTCATTGACAGATGAGTGT | (SEQ ID NO: 2197) |
| hCV30690784 | C/T | AGCGATGGCCTTAGGTATC | (SEQ ID NO: 2200) |
| hCV30699692 | C/T | GGAAAGAACCACCTCGATATG | (SEQ ID NO: 2203) |
| hCV30711231 | A/G | GTGTATGTGTGTGTGTGAGAA | (SEQ ID NO: 2206) |
| hCV30922162 | C/T | ACTGTTACTAGAGACAAGGGATAC | (SEQ ID NO: 2209) |
| hCV31056155 | C/G | GTTTTCTCTTTGTTACTAATATGTCACAC | (SEQ ID NO: 2212) |
| hCV31199195 | A/C | GAGATATCAATTGAAAACGGACATT | (SEQ ID NO: 2215) |
| hCV31475431 | G/T | ATTGTGATTGGGGAACTTCC | (SEQ ID NO: 2218) |
| hCV31523557 | A/G | AGGTAGTTTGTTCCACAGCA | (SEQ ID NO: 2221) |
| hCV31523608 | A/G | CATTAAATGAGTTCCACTGCCT | (SEQ ID NO: 2224) |
| hCV31523638 | A/G | TTCTTCTGCCTCTCTCATACA | (SEQ ID NO: 2227) |
| hCV31523643 | A/G | TGCAAACCATGCTGGATTAA | (SEQ ID NO: 2230) |
| hCV31523650 | C/T | TCAACTTTTAACCAGTACTGTTCC | (SEQ ID NO: 2233) |
| hCV31523658 | A/C | TTGCTAATACTGCATTTCTTACAAAT | (SEQ ID NO: 2236) |
| hCV3164397 | C/T | TGTGCCTTACAGAATCCG | (SEQ ID NO: 2239) |
| hCV3170967 | C/G | GGAGGGTGAGGTCAAGC | (SEQ ID NO: 2242) |
| hCV31714450 | C/T | CACCTTGACCTTGGACTTC | (SEQ ID NO: 2245) |
| hCV31749285 | C/T | GTTGGAATTGAGGCTTATGC | (SEQ ID NO: 2248) |
| hCV3180954 | A/G | TCCTGGGAGCCTTTGA | (SEQ ID NO: 2251) |
| hCV31863982 | A/G | ACAAATCCTTTGACAATCACTGT | (SEQ ID NO: 2254) |
| hCV3187716 | A/C | CCTTCAATTCTGAAAAGTAGCTAAT | (SEQ ID NO: 2257) |
| hCV31965333 | C/T | AGCCCTTCAGAAGAAAACAG | (SEQ ID NO: 2260) |
| hCV31997958 | A/G | CCCTGCTGGAGAAAATCA | (SEQ ID NO: 2263) |
| hCV3205858 | C/T | GTGCTCACTCAGAATAAAATGC | (SEQ ID NO: 2266) |
| hCV3210786 | C/T | CCCATGAATATTGTACTTAGGAAC | (SEQ ID NO: 2269) |
| hCV3216426 | A/T | TTATTTTCAGAGTCTTGAATATTATTGA | (SEQ ID NO: 2272) |
| hCV3216649 | A/G | CAGCTTGTACATCGTACTTAACAGT | (SEQ ID NO: 2275) |
| hCV32209605 | C/T | GTGAAATTACTCCTTCATCAGGG | (SEQ ID NO: 2278) |
| hCV32209620 | C/T | CAGGCTTTTATGTGTGCATG | (SEQ ID NO: 2281) |
| hCV32209621 | A/G | ATGCATGTCTTGGTATTTATCCA | (SEQ ID NO: 2284) |
| hCV32212664 | A/G | TGATTGGAAGCATTTCCCATAAT | (SEQ ID NO: 2287) |
| hCV32291301 | A/G | TCAGGTTGGTCAGTGCTT | (SEQ ID NO: 2290) |
| hCV3230016 | A/G | AGCCAGCACAGACCATCT | (SEQ ID NO: 2293) |
| hCV3230030 | A/G | GGGCAAAACCCACAGTAAAA | (SEQ ID NO: 2296) |
| hCV3230038 | C/T | CCAGGATGAGAGGGCG | (SEQ ID NO: 2299) |
| hCV3230083 | A/C | CACAACTTTCTCATCTTGATTGAATTTA | (SEQ ID NO: 2302) |

TABLE 3-continued

| | | | |
|---|---|---|---|
| hCV3230084 | C/T | GAGAATCTCACCAGAATCAATATAAC | (SEQ ID NO: 2305) |
| hCV3230096 | C/T | AGAAGCATGTGATTATCATTCAAATC | (SEQ ID NO: 2308) |
| hCV3230099 | C/T | ACGCCAATGAAGACTGC | (SEQ ID NO: 2311) |
| hCV3230113 | A/T | AAATGAAGACTATAAGTGCACGAT | (SEQ ID NO: 2314) |
| hCV3230119 | C/G | GCCACTACTTGGTTATTTTCTGG | (SEQ ID NO: 2317) |
| hCV3230131 | C/T | CCGGTGTTGTTTCAGCATAC | (SEQ ID NO: 2320) |
| hCV3230136 | A/G | CTAATTATGTCCACAGCCACTAT | (SEQ ID NO: 2323) |
| hCV3272537 | A/T | AATTTGACACTAGTCATAGCCAT | (SEQ ID NO: 2326) |
| hCV356522 | C/T | ACCAAGCATGAACAGGATATATTAC | (SEQ ID NO: 2329) |
| hCV4041 | C/T | AAGTCCATCACATCTCCCC | (SEQ ID NO: 2332) |
| hCV470708 | G/T | CAACCCTCATTCCAGCTC | (SEQ ID NO: 2335) |
| hCV491830 | C/T | TCCAGCAGCCGCAG | (SEQ ID NO: 2338) |
| hCV505733 | A/G | ACACGGTGGCATAAGCA | (SEQ ID NO: 2341) |
| hCV540410 | A/T | ACTCACTCTGACTTCAGTTTCTTAT | (SEQ ID NO: 2344) |
| hCV596326 | A/G | CCCTGAATTTGACTATATTGATTACATC | (SEQ ID NO: 2347) |
| hCV596330 | A/C | CATCCCTGAATGGAAGTCTT | (SEQ ID NO: 2350) |
| hCV596331 | A/G | AGTCCACATCAGGAAAATCAGT | (SEQ ID NO: 2353) |
| hCV596335 | C/G | CCCTGGAATAAGGTAAGAAATGAG | (SEQ ID NO: 2356) |
| hCV596336 | C/T | CCCAGTCTCCATCCACTTC | (SEQ ID NO: 2359) |
| hCV596337 | C/G | GGAAGTGCACCCTACAATTTAAG | (SEQ ID NO: 2362) |
| hCV596663 | A/G | CACCCTATCCTTCCTCGAT | (SEQ ID NO: 2365) |
| hCV596669 | A/G | GTATTTGGGACTACTTCCTGAT | (SEQ ID NO: 2368) |
| hCV7422466 | A/C | TGCTACAATTATGGAAACCCTAAA | (SEQ ID NO: 2371) |
| hCV7429782 | A/T | GCAAGAGATGTATCTCAACTACAAA | (SEQ ID NO: 2374) |
| hCV7429793 | C/T | GCCTTGTGCTATGGAGACC | (SEQ ID NO: 2377) |
| hCV7459627 | A/G | CTGAGTTGGAGGTCCAT | (SEQ ID NO: 2380) |
| hCV7504118 | A/G | CTCAACCAGCTTGACACT | (SEQ ID NO: 2383) |
| hCV7574127 | A/G | GGTCTTCTGAGATGGATAAATATTCAA | (SEQ ID NO: 2386) |
| hCV7581501 | C/G | AACCCTCACAACCACCTTAC | (SEQ ID NO: 2389) |
| hCV7584272 | A/G | GACACCACCCAGCTCA | (SEQ ID NO: 2392) |
| hCV7625318 | A/G | ATCAGGGCATCGGAGT | (SEQ ID NO: 2395) |
| hCV788647 | A/G | GCACATGGCATGATTCTATTTAT | (SEQ ID NO: 2398) |
| hCV813581 | G/T | GCAGCAAAATAACAGTGTGC | (SEQ ID NO: 2401) |
| hCV815038 | C/T | CCTGACTCAGCAATTAATAGTCG | (SEQ ID NO: 2404) |
| hCV8241630 | A/G | CATCTCTACAAAGCTAAATCAGACAT | (SEQ ID NO: 2407) |
| hCV8361354 | A/C | CATGGCCATCGCTCAA | (SEQ ID NO: 2410) |
| hCV837462 | A/C | TGGCATACTTTCGATATACTCA | (SEQ ID NO: 2413) |
| hCV8598986 | C/T | GACTGTGGTGTCTGAAACTC | (SEQ ID NO: 2416) |
| hCV8688111 | C/G | AGAACTTGGGGATTTTCCATAC | (SEQ ID NO: 2419) |
| hCV8703249 | G/T | CTTTTATGGATCTTTCTAGTCTTGTTTC | (SEQ ID NO: 2422) |

TABLE 3-continued

| | | | |
|---|---|---|---|
| hCV8717752 | A/G | CCGGCTCCATCACCA | (SEQ ID NO: 2425) |
| hCV8717873 | A/G | AACAGAACCACCTTCCT | (SEQ ID NO: 2428) |
| hCV8717893 | A/G | GACAGTTCGGTGAAGTGA | (SEQ ID NO: 2431) |
| hCV8717916 | A/C | ATGAGAAGAAGGCCTTTCTT | (SEQ ID NO: 2434) |
| hCV8717949 | A/C | GTCGTAAGTCTCTCCTCTCTTA | (SEQ ID NO: 2437) |
| hCV8726802 | A/G | CCAATAAAAGTGACTCTCAGCA | (SEQ ID NO: 2440) |
| hCV8727391 | G/A | GGAGCTTCTTCATTTACCTTC | (SEQ ID NO: 2443) |
| hCV8827309 | C/T | CTTTCTCAGCAAGAGCAC | (SEQ ID NO: 2446) |
| hCV8856223 | C/G | AGACATTTCTCAAGATCATGGC | (SEQ ID NO: 2449) |
| hCV8857351 | C/T | GATAGATAGATAGATAGATAGAGATTTTGAGG | (SEQ ID NO: 2452) |
| hCV8911768 | C/T | GAAAGCAGGGTGAGACTG | (SEQ ID NO: 2455) |
| hCV8919442 | T/C | AAGTCAAGAACATGCTAAGCA | (SEQ ID NO: 2458) |
| hCV8919444 | C/T | TGGTGCTGGAGAATTCAG | (SEQ ID NO: 2461) |
| hCV8919450 | A/G | TCCGAAACTCATCATTGAAT | (SEQ ID NO: 2464) |
| hCV8919451 | A/G | GATGAGTTTCGGAATGACCTA | (SEQ ID NO: 2467) |
| hCV8941510 | A/C | TGGTAGGGTGAACCGGA | (SEQ ID NO: 2470) |
| hCV8957432 | C/G | CCATTTCTTAAGACTTTCTGCTG | (SEQ ID NO: 2473) |
| hCV9102827 | C/T | GTAAGGGATGAGAAGGATG | (SEQ ID NO: 2476) |
| hCV9114656 | C/T | CCATCACTGGAGTATTTTTAGTTATAC | (SEQ ID NO: 2479) |
| hCV916106 | A/G | ACATCACAAGCATAGCAAAGATAT | (SEQ ID NO: 2482) |
| hCV916107 | C/T | AGAATCCGAGAAGTCTGATG | (SEQ ID NO: 2485) |
| hCV926518 | G/T | GAGTTAACGTGGACATGAAGTAG | (SEQ ID NO: 2488) |
| hCV9327878 | C/G | TCATGAATGTCCATTTCTGG | (SEQ ID NO: 2491) |
| hCV9493081 | C/T | GGCAGTAGTGCGGTTG | (SEQ ID NO: 2494) |
| hCV949676 | C/T | CATTAGCCTGGGAAATAAATAAC | (SEQ ID NO: 2497) |
| hCV9596963 | A/G | TGCCCCCAGCCAGAA | (SEQ ID NO: 2500) |
| hCV9680592 | A/G | TTGTACATGAAAATACAGGATTACA | (SEQ ID NO: 2503) |
| hCV97631 | G/T | CACAGGCAGCAGATTCTC | (SEQ ID NO: 2506) |
| hCV9860072 | A/C | GCATAGACACCATGTTCCCT | (SEQ ID NO: 2509) |
| hDV70662128 | A/G | AAGAGACCATATCAGAGGCAA | (SEQ ID NO: 2512) |
| hDV70683187 | C/G | AATTTTCAAAGTTCCTTCTCTAGAATC | (SEQ ID NO: 2515) |
| hDV70683212 | C/G | CCCGCAATGAACTTTAATTCTG | (SEQ ID NO: 2518) |
| hDV70683382 | C/G | AGAATGTTTTCCTCCAGTTCAC | (SEQ ID NO: 2521) |
| hDV70941043 | A/G | GAAGAAATACTTGACTTGAAGAGAAATT | (SEQ ID NO: 2524) |
| hDV70965621 | A/G | GCTCCCGTTCCACTCT | (SEQ ID NO: 2527) |
| hDV71075942 | T/G | CAGCCAAGGGGTACCA | (SEQ ID NO: 2530) |
| hDV76976792 | C/T | CAATTTAAGCCAGAATCAGGTAAAC | (SEQ ID NO: 2533) |
| hDV76976795 | A/G | AAAGTGGACAAAGCAGTGAT | (SEQ ID NO: 2536) |
| hCV1841974 | A/G | GAAGCCCACCTATGCCT | (SEQ ID NO: 2539) |
| hCV1952126 | A/C | TCGGTCTCCTTTCTGAGTTT | (SEQ ID NO: 2542) |

TABLE 3-continued

| | | | |
|---|---|---|---|
| hCV22272816 | A/G | TCTGTTCCACCACCTCTT | (SEQ ID NO: 2545) |
| hCV25597241 | A/G | GACAGAGGCAGAGAGAGAA | (SEQ ID NO: 2548) |
| hCV30500334 | A/G | ACGCATCTACTTTCTGTCTGTATA | (SEQ ID NO: 2551) |
| hCV30747430 | C/T | GGAAACTTCTCTTTGGGACTC | (SEQ ID NO: 2554) |

| Marker | Primer 2 (Allele-specific Primer) | |
|---|---|---|
| hCV10008773 | CACGTGTGCTCACTTACAGAC | (SEQ ID NO: 1589) |
| hCV11342584 | GGCTGCTAGCCAAATACTATTT | (SEQ ID NO: 1592) |
| hCV11466393 | GGATGGAATGTTTTCCCTAAG | (SEQ ID NO: 1595) |
| hCV11503414 | GTTTCCTAAGACTAGATACATGGTAC | (SEQ ID NO: 1598) |
| hCV11503431 | CCAGTGCTTGCCTTCTT | (SEQ ID NO: 1601) |
| hCV11503469 | CAGTTTACAATCTAATGCAGTGGA | (SEQ ID NO: 1604) |
| hCV11503470 | CAAAATGATGGGAAGTTAGGA | (SEQ ID NO: 1607) |
| hCV11541681 | CCACCTTCTCTTCAGATTCAG | (SEQ ID NO: 1610) |
| hCV11559107 | GAGATTTTGAAGACATCTGGTG | (SEQ ID NO: 1613) |
| hCV11629656 | GCCCCAATAAAAGGACACAGTTAT | (SEQ ID NO: 1616) |
| hCV11629657 | TGTCCTAAGATTAGCTAATATTTAACAC | (SEQ ID NO: 1619) |
| hCV11633415 | CCCAGAGGTCTACTATCTGAT | (SEQ ID NO: 1622) |
| hCV11726971 | GCAAGGTGTCTCCGAATTAC | (SEQ ID NO: 1625) |
| hCV11786147 | ACGTGCGTGAATTGAATGT | (SEQ ID NO: 1628) |
| hCV11786258 | TGGAGAATACCCACTCAGC | (SEQ ID NO: 1631) |
| hCV11853483 | CACACACATCTTTAAAATCCATTCTATC | (SEQ ID NO: 1634) |
| hCV11853496 | CCTTTCTCACCTGATAGAATGAGA | (SEQ ID NO: 1637) |
| hCV11922386 | CCTGGCCCTTTCCTACA | (SEQ ID NO: 1640) |
| hCV11942562 | CGAATGTGATGGCCACG | (SEQ ID NO: 1643) |
| hCV11962159 | CATTAAGCAACTGGTTTCCA | (SEQ ID NO: 1646) |
| hCV11975250 | AGGACAAAATACCTGTATTCCTC | (SEQ ID NO: 1649) |
| hCV11975296 | CAGTCCATGGTTCCTTCAC | (SEQ ID NO: 1652) |
| hCV11975651 | ACCTTCCCCACTCTCTTAC | (SEQ ID NO: 1655) |
| hCV11975658 | GGTGACAGGGGAGAAAAGG | (SEQ ID NO: 1658) |
| hCV1198623 | CCATGCCTGATACAGAAGAG | (SEQ ID NO: 1661) |
| hCV1202883 | GCGTGATGATGAAATCGA | (SEQ ID NO: 1664) |
| hCV12066124 | GCAGCTTTTGCCAGTAAAGAT | (SEQ ID NO: 1667) |
| hCV12073840 | AACGGACACTGGACATACT | (SEQ ID NO: 1670) |
| hCV12086148 | TGAAGGTTTCCCTTTAAGTTACC | (SEQ ID NO: 1673) |
| hCV12092542 | CCTTGTCTTCAATTTTGGC | (SEQ ID NO: 1676) |
| hCV12098639 | GGATGTGGCTTCCCG | (SEQ ID NO: 1679) |
| hCV134275 | GGTGCTTAGAATACATCAACAAAAC | (SEQ ID NO: 1682) |
| hCV134278 | GTAACCTGATCCATTATCCAAGATAT | (SEQ ID NO: 1685) |
| hCV1376206 | AAGCAGGCTACTACTCCTTT | (SEQ ID NO: 1688) |
| hCV1376207 | CGTACAGACAGCCGAGC | (SEQ ID NO: 1691) |

TABLE 3-continued

| | | |
|---|---|---|
| hCV1376227 | TCTCAACTTGGCTATCTTACAAATC | (SEQ ID NO: 1694) |
| hCV1376246 | TTATTGAGTTCATCATTAAAGTCATCG | (SEQ ID NO: 1697) |
| hCV1376342 | TACTCACCAGTTGTGAAGACTTT | (SEQ ID NO: 1700) |
| hCV1420741 | CAGGCTTTAAGGACAGGG | (SEQ ID NO: 1703) |
| hCV1455329 | TGTTTTGTGAACAAAGATTCCAC | (SEQ ID NO: 1706) |
| hCV1547677 | GTGACAGTCCCAACACC | (SEQ ID NO: 1709) |
| hCV15755949 | ATACTTAGTTCTCCCCTCCATAG | (SEQ ID NO: 1712) |
| hCV15793897 | AGCTCTGAGTGCACTGTGTC | (SEQ ID NO: 1715) |
| hCV15860433 | ACCCAAGACTTAGTAAACATTCAA | (SEQ ID NO: 1718) |
| hCV15864094 | TGGATCAAGCTTCGTTGTTAC | (SEQ ID NO: 1721) |
| hCV15871021 | GAAATCTTGCTCTTTATGAGTATTTA | (SEQ ID NO: 1724) |
| hCV15885425 | TTTACAATGTAACAGCAAAACCC | (SEQ ID NO: 1727) |
| hCV15947925 | GCTCCAGGACAGAGAACA | (SEQ ID NO: 1730) |
| hCV15949414 | GCTTTCATAATGCAAATGC | (SEQ ID NO: 1733) |
| hCV15952952 | AAAGTGGAGAAGGCTCTGAC | (SEQ ID NO: 1736) |
| hCV15953063 | TGGAAATAATGTAGGATGAAGACG | (SEQ ID NO: 1739) |
| hCV15956034 | ACTGAGCTGAAATGATCCATC | (SEQ ID NO: 1742) |
| hCV15956054 | CACCCAGTGCAGATTCAT | (SEQ ID NO: 1745) |
| hCV15956055 | GCAAGAAGGCAAGTCCA | (SEQ ID NO: 1748) |
| hCV15956059 | TGTAGTTGAAGGACAGAGTGA | (SEQ ID NO: 1751) |
| hCV15956077 | ACTCTAACACAGGGTTCCG | (SEQ ID NO: 1754) |
| hCV15968043 | GCCCAGTTTCAAACAGGT | (SEQ ID NO: 1757) |
| hCV15977624 | TCCTCTTCACCAAGGAGC | (SEQ ID NO: 1760) |
| hCV15990789 | TGAACCTGAGCGTGTCAG | (SEQ ID NO: 1763) |
| hCV16000557 | AACAAAGTCACACCGAATCA | (SEQ ID NO: 1766) |
| hCV1605386 | GTGGGAAACACACAGAAATTTG | (SEQ ID NO: 1769) |
| hCV16135173 | GGCAACCTCAACACAGAG | (SEQ ID NO: 1772) |
| hCV16170613 | AGCAGGCATTGTTTTCC | (SEQ ID NO: 1775) |
| hCV16172935 | GGAGTTACACCCATAAACCAC | (SEQ ID NO: 1778) |
| hCV16177220 | CATCTGGTGGTCATTCAAATA | (SEQ ID NO: 1781) |
| hCV16180170 | GGGAGAGCACTTGAAATGAT | (SEQ ID NO: 1784) |
| hCV1650632 | ATTCATCCAGCCACTCT | (SEQ ID NO: 1787) |
| hCV1678674 | GGCTTCAAAGTGATAAATTCTATATTCA | (SEQ ID NO: 1790) |
| hCV1678682 | GGACACAACTCATTATTCTGGT | (SEQ ID NO: 1793) |
| hCV1703855 | AAACGAATGGCATGTATTTTATGA | (SEQ ID NO: 1796) |
| hCV1703867 | CGATGATTTTGTTCTCATGTTCA | (SEQ ID NO: 1799) |
| hCV1703892 | CCTGTTGCATTCTGGATACA | (SEQ ID NO: 1802) |
| hCV1703910 | ACCTATGTAACACACCCTTCTATC | (SEQ ID NO: 1805) |
| hCV1723643 | CCCTCACAGCTCTGAAGC | (SEQ ID NO: 1808) |
| hCV1825046 | CTGCACAGTCCCCTGAT | (SEQ ID NO: 1811) |

TABLE 3-continued

| | | |
|---|---|---|
| hCV1833991 | GGGAGCCTTAATAAGATTAACAGT | (SEQ ID NO: 1814) |
| hCV1834242 | CCTACTTTCACAAACATATCTTTGAG | (SEQ ID NO: 1817) |
| hCV1841975 | GTCGTGGAGATACTGCAAGTA | (SEQ ID NO: 1820) |
| hCV1842260 | GTCTCAGGCACCTGGATTAT | (SEQ ID NO: 1823) |
| hCV1859855 | GGCCTCACTAGAGAAGGAGAA | (SEQ ID NO: 1826) |
| hCV1874482 | AAAGGTTTCTTCTGATCACTGAC | (SEQ ID NO: 1829) |
| hCV18996 | TGAAGTAATACTGGAGATCAAATTAT | (SEQ ID NO: 1832) |
| hCV1900162 | AACCAGTATACCTAGAGCATAGTGA | (SEQ ID NO: 1835) |
| hCV1937195 | CAGGGCACAGATAACC | (SEQ ID NO: 1838) |
| hCV1974936 | GTGTGCACAAAGATAGGTCAT | (SEQ ID NO: 1841) |
| hCV1974951 | CGGGACACCATCCACG | (SEQ ID NO: 1844) |
| hCV1974967 | ACATCCAACGAGAAATTGCTG | (SEQ ID NO: 1847) |
| hCV2017876 | CTGCTTCCAGAAGATCAAGC | (SEQ ID NO: 1850) |
| hCV2086329 | CCAGCCACACTGTTGG | (SEQ ID NO: 1853) |
| hCV2103346 | GAGGAGCCATGATGCCT | (SEQ ID NO: 1856) |
| hCV2103392 | CCTCCTCCATGAAGCTGTT | (SEQ ID NO: 1859) |
| hCV2144411 | GCTCCGGGGTTATTGC | (SEQ ID NO: 1862) |
| hCV2211618 | GGCCATGTGCTGCCATG | (SEQ ID NO: 1865) |
| hCV22272267 | CTGGCAGCGAATGTTAC | (SEQ ID NO: 1868) |
| hCV2288095 | TGAGTTAATATTTGTGTAAAGTATGATGTTTAA | (SEQ ID NO: 1871) |
| hCV2303891 | ACACAGTTCTCTGGCTTTTC | (SEQ ID NO: 1874) |
| hCV233148 | TCATCACAGGACATTTATGAGAAC | (SEQ ID NO: 1877) |
| hCV2403368 | AAAGGTGAGCTCCACCATAG | (SEQ ID NO: 1880) |
| hCV2456747 | CCTCCACTAGAAGACACTACTACTTC | (SEQ ID NO: 1883) |
| hCV2494846 | ACTTCTTCCCTTCGCTCTT | (SEQ ID NO: 1886) |
| hCV2532034 | CTGAAGCGCAACCATAAT | (SEQ ID NO: 1889) |
| hCV25473516 | CACCCAATGCCAAGC | (SEQ ID NO: 1892) |
| hCV25474413 | GCATTCACAGTGTTCTCATTATAAG | (SEQ ID NO: 1895) |
| hCV25474414 | TCTGCAGAGCTGTAAGAGTT | (SEQ ID NO: 1898) |
| hCV25596789 | ATCTGCTCCATTTTTCTCATC | (SEQ ID NO: 1901) |
| hCV25602230 | GAAGCTGAGGAGAGTCCT | (SEQ ID NO: 1904) |
| hCV25611352 | AATAATTGTAACTCTAGAACAAAAGTATTT | (SEQ ID NO: 1907) |
| hCV25615302 | GGTTCCAGTTCCGATAGT | (SEQ ID NO: 1910) |
| hCV25620145 | CACCAGCAATGATGAAACC | (SEQ ID NO: 1913) |
| hCV25634754 | AGTCACTTATTTGAATCCCATTGT | (SEQ ID NO: 1916) |
| hCV25649928 | GAAGACTTTTTCCAGGAATGT | (SEQ ID NO: 1919) |
| hCV25748719 | CGGCAGCCAATGACAC | (SEQ ID NO: 1922) |
| hCV2575036 | CAGTTTATGCCTGCAACAAC | (SEQ ID NO: 1925) |
| hCV25752810 | GCCCATAAGGAGACAGAAAAT | (SEQ ID NO: 1928) |
| hCV25767872 | CACCATGTGTGTGTTCCAC | (SEQ ID NO: 1931) |

TABLE 3-continued

| | | |
|---|---|---|
| hCV25768636 | AATTTGGCCACAAAGAGC | (SEQ ID NO: 1934) |
| hCV2590858 | AGAGTGAGAATTCTGTCAAGAGA | (SEQ ID NO: 1937) |
| hCV25932979 | AAAGAGGGAGTAAACAACTGC | (SEQ ID NO: 1940) |
| hCV25951992 | TGGAAAGATGGAGGCAG | (SEQ ID NO: 1943) |
| hCV25959466 | GCGATTCCTCAGCAGC | (SEQ ID NO: 1946) |
| hCV25959498 | ACAACATAAAACTGACTTGGAAA | (SEQ ID NO: 1949) |
| hCV25990131 | TGTTGGTAAAAGTATGTAGGATCTG | (SEQ ID NO: 1952) |
| hCV25991132 | CAGGAATGGAGACCATCC | (SEQ ID NO: 1955) |
| hCV25995678 | TCTGTCTTCCACAACCAAAA | (SEQ ID NO: 1958) |
| hCV25996277 | ACTATCTCCTTCAAAGGATGCT | (SEQ ID NO: 1961) |
| hCV26034142 | CAACCTAATTTAAGCCATCATTAACA | (SEQ ID NO: 1964) |
| hCV26034157 | CAACTCAAACAGGACACTGAA | (SEQ ID NO: 1967) |
| hCV26038139 | CAGCTGGCGAAGTTGG | (SEQ ID NO: 1970) |
| hCV2605707 | GCTGTTAATTCAGGAGGTAAAGG | (SEQ ID NO: 1973) |
| hCV26175114 | CCAGTCATCTCTGCAGAAAAG | (SEQ ID NO: 1976) |
| hCV26265231 | GGATAAATATTACAAACCCATGCTG | (SEQ ID NO: 1979) |
| hCV26338456 | ACAGAAGATACAGCAAATGGAG | (SEQ ID NO: 1982) |
| hCV26338482 | CAAACAGTAACAGGCTCAGT | (SEQ ID NO: 1985) |
| hCV26338512 | CAGGCCTCGGAAAATGAG | (SEQ ID NO: 1988) |
| hCV26338513 | CGCACTTTTAGTGGCTGA | (SEQ ID NO: 1991) |
| hCV263841 | AAGCTAATACTCCTGTCCTGAAC | (SEQ ID NO: 1994) |
| hCV26719108 | GGCAGGGGCATTGGTA | (SEQ ID NO: 1997) |
| hCV26719113 | CTTACGATTAGTTCCAACATGAATAT | (SEQ ID NO: 2000) |
| hCV26719121 | CCCACTAAGCACAGGAAAA | (SEQ ID NO: 2003) |
| hCV26719154 | ATGGTCTGTGCCCTCAA | (SEQ ID NO: 2006) |
| hCV26719227 | TGCCTTGGATATGCTTTAAAGAG | (SEQ ID NO: 2009) |
| hCV26887403 | AGCACTGGAACGATAATAAAGC | (SEQ ID NO: 2012) |
| hCV26887434 | CTTTACGACTAATTAGGTATAAAGGTTC | (SEQ ID NO: 2015) |
| hCV26887464 | GCAGGTCAGATAACTTCTTTATGG | (SEQ ID NO: 2018) |
| hCV26895255 | ACACCGTATTCAGCTGAGAT | (SEQ ID NO: 2021) |
| hCV2699725 | GTACCTCTTGGTCTCTCTCG | (SEQ ID NO: 2024) |
| hCV27020269 | CCAGTTTTGCACATTTAAAGATACC | (SEQ ID NO: 2027) |
| hCV2706410 | CCTCCATGTCATCCTACA | (SEQ ID NO: 2030) |
| hCV27102953 | ATTTAGTGTAATGGGCAAGACA | (SEQ ID NO: 2033) |
| hCV27102978 | CTCCTCCTGTCTCCGTG | (SEQ ID NO: 2036) |
| hCV27103080 | TGGGATGTGCAACCCT | (SEQ ID NO: 2039) |
| hCV27103182 | GGCATCTCTCAATCCCTACA | (SEQ ID NO: 2042) |
| hCV27103188 | GTTTGGACAATGACTTGGAAAC | (SEQ ID NO: 2045) |
| hCV27103189 | AGAGGTCAAGCCAATGAAAC | (SEQ ID NO: 2048) |
| hCV27103207 | GGCTGCCAGGGACAC | (SEQ ID NO: 2051) |

TABLE 3-continued

| | | |
|---|---|---|
| hCV2716314 | GGCATACAAATTCAAAATACTGTATC | (SEQ ID NO: 2054) |
| hCV2734332 | GCCATGTTGACTCGAGAAC | (SEQ ID NO: 2057) |
| hCV2744023 | CTACCTGTGTCTGTATTTCTTTAAAC | (SEQ ID NO: 2060) |
| hCV27474895 | GAGGATACTGAAGTAGCAAACG | (SEQ ID NO: 2063) |
| hCV27474984 | CTTGAGTTACACCAGACCTG | (SEQ ID NO: 2066) |
| hCV27476043 | CAGGCCAGGTCAACG | (SEQ ID NO: 2069) |
| hCV27477533 | GAGGTTCCATGGAGTAAACAATT | (SEQ ID NO: 2072) |
| hCV27480803 | TGCACTAGAAACCTGCCA | (SEQ ID NO: 2075) |
| hCV27490984 | CTTACTTAGGTCACTTTCAGCG | (SEQ ID NO: 2078) |
| hCV27502514 | ATTGGCGAGTTATCTAATGTCTC | (SEQ ID NO: 2081) |
| hCV27833944 | CTGCTAGGGACTAACCTTGA | (SEQ ID NO: 2084) |
| hCV27878067 | CCAACTGACCCAAAGGC | (SEQ ID NO: 2087) |
| hCV27902808 | CAGGCCTGAAGTCTAGGTT | (SEQ ID NO: 2090) |
| hCV27904396 | ACTACACTACTATGCAATATATCTATGTG | (SEQ ID NO: 2093) |
| hCV27937396 | GCCTGAATTCTGAGAAGACATAA | (SEQ ID NO: 2096) |
| hCV27956129 | CCATTTATGCAAAAGCAGAATCC | (SEQ ID NO: 2099) |
| hCV2811695 | GTGTTGTATTTGTATGTGTGTCG | (SEQ ID NO: 2102) |
| hCV2852784 | CCACAGCTCTTCTACTCCACT | (SEQ ID NO: 2105) |
| hCV2879752 | GGCCTCCTGCTCCAG | (SEQ ID NO: 2108) |
| hCV2892855 | GGTAATCATTTAACACATTTCATGTTCT | (SEQ ID NO: 2111) |
| hCV2892869 | GTGCCAGTCCTTGTGC | (SEQ ID NO: 2114) |
| hCV2892877 | GAGCTCTGGACCTGGAAGTA | (SEQ ID NO: 2117) |
| hCV2892893 | AGTGTGCTCATGATGAAAGAAAT | (SEQ ID NO: 2120) |
| hCV2892905 | CGTGTGATATGACTTTCATTTAGAACA | (SEQ ID NO: 2123) |
| hCV2892918 | TGCATCCACATAAAATGCTACA | (SEQ ID NO: 2126) |
| hCV2892926 | GTTCAAGTTAAATGATAGGGTAATACT | (SEQ ID NO: 2129) |
| hCV2892927 | GTACTTTCTGTTCAACATCTTTTAAGA | (SEQ ID NO: 2132) |
| hCV28960679 | CCAGACCTCATATTTTCCTTCAC | (SEQ ID NO: 2135) |
| hCV2915511 | CTGGCTCCTTCTCCGTT | (SEQ ID NO: 2138) |
| hCV29210363 | GCCATCTACAGGCTTACTCAC | (SEQ ID NO: 2141) |
| hCV29269378 | ATTTGCTTTTGACCACAACG | (SEQ ID NO: 2144) |
| hCV29271569 | CCAGCCTCAGGTTAAGGATT | (SEQ ID NO: 2147) |
| hCV29521317 | CCATTGATACTGCATTAAACCATG | (SEQ ID NO: 2150) |
| hCV2969899 | GCATCCTGTCAAATACTCTCATTATAC | (SEQ ID NO: 2153) |
| hCV29821005 | GCAAACTAAAGCAACAATAAGACAT | (SEQ ID NO: 2156) |
| hCV2986575 | CCTTTGTACTTTAAATCATCTCTAGGA | (SEQ ID NO: 2159) |
| hCV29983641 | AGAAAATTAAGCCAGGAGAAGTTAG | (SEQ ID NO: 2162) |
| hCV30002208 | GCTTTCAGGCAATTTTGAGG | (SEQ ID NO: 2165) |
| hCV30040828 | GGGGTGAAGAAGAAACCTCT | (SEQ ID NO: 2168) |
| hCV30205817 | GATGAAGTAGTTCATTTTGAATGGT | (SEQ ID NO: 2171) |

TABLE 3-continued

| | | |
|---|---|---|
| hCV30440155 | CTTTGGAGTCTGCTTGTACG | (SEQ ID NO: 2174) |
| hCV30505633 | ACGCTTAACAAAGGTGTTAGAAT | (SEQ ID NO: 2177) |
| hCV30548253 | GAGAGATAGAGGCAAAGGAAAAG | (SEQ ID NO: 2180) |
| hCV30562347 | GGCTGTCATTTCAGAAGCG | (SEQ ID NO: 2183) |
| hCV305844 | CTGTGCCCTTCCTGC | (SEQ ID NO: 2186) |
| hCV30626715 | CAGGATGTCTGCCATTATTTCA | (SEQ ID NO: 2189) |
| hCV30690777 | CGTGTGCCTGAGAAGC | (SEQ ID NO: 2192) |
| hCV30690778 | AGGCAGAGTTTCCACTCAA | (SEQ ID NO: 2195) |
| hCV30690780 | TGTTCATTGACAGATGAGTGG | (SEQ ID NO: 2198) |
| hCV30690784 | AGCGATGGCCTTAGGTATT | (SEQ ID NO: 2201) |
| hCV30699692 | GGGAAAGAACCACCTCGATATA | (SEQ ID NO: 2204) |
| hCV30711231 | GTGTATGTGTGTGTGAGAG | (SEQ ID NO: 2207) |
| hCV30922162 | AACTGTTACTAGAGACAAGGGATAT | (SEQ ID NO: 2210) |
| hCV31056155 | GTTTTCTCTTTGTTACTAATATGTCACAG | (SEQ ID NO: 2213) |
| hCV31199195 | GAGATATCAATTGAAAACGGACATG | (SEQ ID NO: 2216) |
| hCV31475431 | GTATTGTGATTGGGGAACTTCA | (SEQ ID NO: 2219) |
| hCV31523557 | GGTAGTTTGTTCCACAGCG | (SEQ ID NO: 2222) |
| hCV31523608 | TTAAATGAGTTCCACTGCCC | (SEQ ID NO: 2225) |
| hCV31523638 | TCTTCTGCCTCTCTCATACG | (SEQ ID NO: 2228) |
| hCV31523643 | TGCAAACCATGCTGGATTAG | (SEQ ID NO: 2231) |
| hCV31523650 | CTCAACTTTTAACCAGTACTGTTCT | (SEQ ID NO: 2234) |
| hCV31523658 | TGCTAATACTGCATTTCTTACAAAG | (SEQ ID NO: 2237) |
| hCV3164397 | CTTGTGCCTTACAGAATCCA | (SEQ ID NO: 2240) |
| hCV3170967 | GGAGGGTGAGGTCAAGG | (SEQ ID NO: 2243) |
| hCV31714450 | CACCTTGACCTTGGACTTT | (SEQ ID NO: 2246) |
| hCV31749285 | GGTTGGAATTGAGGCTTATGT | (SEQ ID NO: 2249) |
| hCV3180954 | CCTGGGAGCCTTTGG | (SEQ ID NO: 2252) |
| hCV31863982 | CAAATCCTTTGACAATCACTGC | (SEQ ID NO: 2255) |
| hCV3187716 | CCTTCAATTCTGAAAAGTAGCTAAG | (SEQ ID NO: 2258) |
| hCV31965333 | CAGCCCTTCAGAAGAAAACAA | (SEQ ID NO: 2261) |
| hCV31997958 | CCCTGCTGGAGAAAATCG | (SEQ ID NO: 2264) |
| hCV3205858 | AGTGCTCACTCAGAATAAAATGT | (SEQ ID NO: 2267) |
| hCV3210786 | CCCATGAATATTGTACTTAGGAAT | (SEQ ID NO: 2270) |
| hCV3216426 | GTTATTTTCAGAGTCTTGAATATTATTGT | (SEQ ID NO: 2273) |
| hCV3216649 | GCTTGTACATCGTACTTAACAGC | (SEQ ID NO: 2276) |
| hCV32209605 | GTGAAATTACTCCTTCATCAGGA | (SEQ ID NO: 2279) |
| hCV32209620 | TTCAGGCTTTTATGTGTGCATA | (SEQ ID NO: 2282) |
| hCV32209621 | TGCATGTCTTGGTATTTATCCG | (SEQ ID NO: 2285) |
| hCV32212664 | GATTGGAAGCATTTCCCATAAC | (SEQ ID NO: 2288) |
| hCV32291301 | TCAGGTTGGTCAGTGCTC | (SEQ ID NO: 2291) |

TABLE 3-continued

| | | |
|---|---|---|
| hCV3230016 | GCCAGCACAGACCATCC | (SEQ ID NO: 2294) |
| hCV3230030 | GGGCAAAACCCACAGTAAAG | (SEQ ID NO: 2297) |
| hCV3230038 | CCAGGATGAGAGGGCA | (SEQ ID NO: 2300) |
| hCV3230083 | ACAACTTTCTCATCTTGATTGAATTTC | (SEQ ID NO: 2303) |
| hCV3230084 | TGAGAATCTCACCAGAATCAATATAAT | (SEQ ID NO: 2306) |
| hCV3230096 | CAGAAGCATGTGATTATCATTCAAATT | (SEQ ID NO: 2309) |
| hCV3230099 | GAACGCCAATGAAGACTGT | (SEQ ID NO: 2312) |
| hCV3230113 | AAATGAAGACTATAAGTGCACGAA | (SEQ ID NO: 2315) |
| hCV3230119 | GCCACTACTTGGTTATTTTCTGC | (SEQ ID NO: 2318) |
| hCV3230131 | CCGGTGTTGTTTCAGCATAT | (SEQ ID NO: 2321) |
| hCV3230136 | CTAATTATGTCCACAGCCACTAC | (SEQ ID NO: 2324) |
| hCV3272537 | AATTTGACACTAGTCATAGCCAA | (SEQ ID NO: 2327) |
| hCV356522 | ACCAAGCATGAACAGGATATATTAT | (SEQ ID NO: 2330) |
| hCV4041 | GAAGTCCATCACATCTCCCT | (SEQ ID NO: 2333) |
| hCV470708 | CAACCCTCATTCCAGCTA | (SEQ ID NO: 2336) |
| hCV491830 | TCCAGCAGCCGCAA | (SEQ ID NO: 2339) |
| hCV505733 | CACGGTGGCATAAGCG | (SEQ ID NO: 2342) |
| hCV540410 | ACTCACTCTGACTTCAGTTTCTTAA | (SEQ ID NO: 2345) |
| hCV596326 | CCTGAATTTGACTATATTGATTACATCG | (SEQ ID NO: 2348) |
| hCV596330 | CATCCCTGAATGGAAGTCTG | (SEQ ID NO: 2351) |
| hCV596331 | GTCCACATCAGGAAAATCAGC | (SEQ ID NO: 2354) |
| hCV596335 | CCCTGGAATAAGGTAAGAAATGAC | (SEQ ID NO: 2357) |
| hCV596336 | CCCAGTCTCCATCCACTTT | (SEQ ID NO: 2360) |
| hCV596337 | GGAAGTGCACCCTACAATTTAAC | (SEQ ID NO: 2363) |
| hCV596663 | CACCCTATCCTTCCTCGAC | (SEQ ID NO: 2366) |
| hCV596669 | GTATTTGGGACTACTTCCTGAC | (SEQ ID NO: 2369) |
| hCV7422466 | TGCTACAATTATGGAAACCCTAAC | (SEQ ID NO: 2372) |
| hCV7429782 | GCAAGAGATGTATCTCAACTACAAT | (SEQ ID NO: 2375) |
| hCV7429793 | GCCTTGTGCTATGGAGACT | (SEQ ID NO: 2378) |
| hCV7459627 | CTGAGTTGGAGGTCCAC | (SEQ ID NO: 2381) |
| hCV7504118 | CTCAACCAGCTTGACACC | (SEQ ID NO: 2384) |
| hCV7574127 | GGTCTTCTGAGATGGATAAATATTCAG | (SEQ ID NO: 2387) |
| hCV7581501 | AACCCTCACAACCACCTTAG | (SEQ ID NO: 2390) |
| hCV7584272 | ACACCACCCAGCTCG | (SEQ ID NO: 2393) |
| hCV7625318 | CAGGGCATCGGAGC | (SEQ ID NO: 2396) |
| hCV788647 | GCACATGGCATGATTCTATTTAC | (SEQ ID NO: 2399) |
| hCV813581 | TGCAGCAAAATAACAGTGTGA | (SEQ ID NO: 2402) |
| hCV815038 | CCTGACTCAGCAATTAATAGTCA | (SEQ ID NO: 2405) |
| hCV8241630 | TCTCTACAAAGCTAAATCAGACAC | (SEQ ID NO: 2408) |
| hCV8361354 | CATGGCCATCGCTCAC | (SEQ ID NO: 2411) |

TABLE 3-continued

| | | |
|---|---|---|
| hCV837462 | TGGCATACTTTCGATATACTCC | (SEQ ID NO: 2414) |
| hCV8598986 | GACTGTGGTGTCTGAAACTT | (SEQ ID NO: 2417) |
| hCV8688111 | AAGAACTTGGGGATTTTCCATAG | (SEQ ID NO: 2420) |
| hCV8703249 | CTTTTATGGATCTTTCTAGTCTTGTTTA | (SEQ ID NO: 2423) |
| hCV8717752 | CCGGCTCCATCACCG | (SEQ ID NO: 2426) |
| hCV8717873 | ACAGAACCACCTTCCC | (SEQ ID NO: 2429) |
| hCV8717893 | GACAGTTCGGTGAAGTGG | (SEQ ID NO: 2432) |
| hCV8717916 | TGAGAAGAAGGCCTTTCTG | (SEQ ID NO: 2435) |
| hCV8717949 | TCGTAAGTCTCTCCTCTCTTC | (SEQ ID NO: 2438) |
| hCV8726802 | CAATAAAAGTGACTCTCAGCG | (SEQ ID NO: 2441) |
| hCV8727391 | GGAGCTTCTTCATTTACCTTT | (SEQ ID NO: 2444) |
| hCV8827309 | CTTTCTCAGCAAGAGCAT | (SEQ ID NO: 2447) |
| hCV8856223 | AGACATTTTCTCAAGATCATGGG | (SEQ ID NO: 2450) |
| hCV8857351 | GATAGATAGATAGATAGATAGAGATTTTGAGA | (SEQ ID NO: 2453) |
| hCV8911768 | GGAAAGCAGGGTGAGACTA | (SEQ ID NO: 2456) |
| hCV8919442 | AGTCAAGAACATGCTAAGCG | (SEQ ID NO: 2459) |
| hCV8919444 | TGGTGCTGGAGAATTCAA | (SEQ ID NO: 2462) |
| hCV8919450 | TCCGAAACTCATCATTGAAC | (SEQ ID NO: 2465) |
| hCV8919451 | TGAGTTTCGGAATGACCTG | (SEQ ID NO: 2468) |
| hCV8941510 | GGTAGGGTGAACCGGC | (SEQ ID NO: 2471) |
| hCV8957432 | CCATTTCTTAAGACTTTCTGCTC | (SEQ ID NO: 2474) |
| hCV9102827 | TGTAAGGGATGAGAAGGATA | (SEQ ID NO: 2477) |
| hCV9114656 | CCATCACTGGAGTATTTTTAGTTATAT | (SEQ ID NO: 2480) |
| hCV916106 | CATCACAAGCATAGCAAAGATAC | (SEQ ID NO: 2483) |
| hCV916107 | GAAGAATCCGAGAAGTCTGATA | (SEQ ID NO: 2486) |
| hCV926518 | GAGTTAACGTGGACATGAAGTAT | (SEQ ID NO: 2489) |
| hCV9327878 | TCATGAATGTCCATTTCTGC | (SEQ ID NO: 2492) |
| hCV9493081 | TGGCAGTAGTGCGGTTA | (SEQ ID NO: 2495) |
| hCV949676 | CATTAGCCTGGGAAATAAATAAT | (SEQ ID NO: 2498) |
| hCV9596963 | TGCCCCAGCCAGAG | (SEQ ID NO: 2501) |
| hCV9680592 | TGTACATGAAAATACAGGATTACG | (SEQ ID NO: 2504) |
| hCV97631 | TCACAGGCAGCAGATTCTA | (SEQ ID NO: 2507) |
| hCV9860072 | CATAGACACCATGTTCCCG | (SEQ ID NO: 2510) |
| hDV70662128 | AGAGACCATATCAGAGGCAG | (SEQ ID NO: 2513) |
| hDV70683187 | AATTTTCAAAGTTCCTTCTCTAGAATG | (SEQ ID NO: 2516) |
| hDV70683212 | CCCGCAATGAACTTTAATTCTC | (SEQ ID NO: 2519) |
| hDV70683382 | AGAATGTTTTCCTCCAGTTCAG | (SEQ ID NO: 2522) |
| hDV70941043 | GAAGAAATACTTGACTTGAAGAGAAATC | (SEQ ID NO: 2525) |
| hDV70965621 | GCTCCCGTTCCACTCC | (SEQ ID NO: 2528) |
| hDV71075942 | AGCCAAGGGGTCACC | (SEQ ID NO: 2531) |

TABLE 3-continued

| | | |
|---|---|---|
| hDV76976792 | CAATTTAAGCCAGAATCAGGTAAAT | (SEQ ID NO: 2534) |
| hDV76976795 | AAGTGGACAAAGCAGTGAC | (SEQ ID NO: 2537) |
| hCV1841974 | AGCCCACCTATGCCC | (SEQ ID NO: 2540) |
| hCV1952126 | TCGGTCTCCTTTCTGAGTTG | (SEQ ID NO: 2543) |
| hCV22272816 | TCTGTTCCACCACCTCTC | (SEQ ID NO: 2546) |
| hCV25597241 | GACAGAGGCAGAGAGAGAG | (SEQ ID NO: 2549) |
| hCV30500334 | CGCATCTACTTTCTGTCTGTATG | (SEQ ID NO: 2552) |
| hCV30747430 | GGAAACTTCTCTTTGGGACTT | (SEQ ID NO: 2555) |
| Marker | Common Primer | |
| hCV10008773 | CGGCTCGATTGTCTCATAC | (SEQ ID NO: 1590) |
| hCV11342584 | AGACTGCAACCTGGGAAATCCTATAG | (SEQ ID NO: 1593) |
| hCV11466393 | CCTTCATGCATGGAAATTC | (SEQ ID NO: 1596) |
| hCV11503414 | CCCAAAGAGTTAGGCATAACATTTAGCAT | (SEQ ID NO: 1599) |
| hCV11503431 | CATGGATGCTTGTTGACACATTAACCT | (SEQ ID NO: 1602) |
| hCV11503469 | CTCAGCTAATCAGTTGTCAATCAAGTCA | (SEQ ID NO: 1605) |
| hCV11503470 | AAGCTTAGATTTGTTTTCTCACATA | (SEQ ID NO: 1608) |
| hCV11541681 | CTGGACGCGGTATGTAGAC | (SEQ ID NO: 1611) |
| hCV11559107 | CTGAATGCAAGCTGATGACT | (SEQ ID NO: 1614) |
| hCV11629656 | TGAATTTGGGAGGCACTTAG | (SEQ ID NO: 1617) |
| hCV11629657 | AAGTGCCTCCCAAATTCAC | (SEQ ID NO: 1620) |
| hCV11633415 | CCCTCATTTTAGCATGTAGCAGTTCA | (SEQ ID NO: 1623) |
| hCV11726971 | TTTTGGGAGGTGATAGCCAGAATCA | (SEQ ID NO: 1626) |
| hCV11786147 | GCACGGACATACTCGGAATCATC | (SEQ ID NO: 1629) |
| hCV11786258 | GCGGGGATGGTATTCACAACATTTA | (SEQ ID NO: 1632) |
| hCV11853483 | CCCAATGCCTGTGCTCTTAAC | (SEQ ID NO: 1635) |
| hCV11853496 | TCATTGTGTGCTACTCCCACTTCA | (SEQ ID NO: 1638) |
| hCV11922386 | CACTGCTGGACAGCAATCTGT | (SEQ ID NO: 1641) |
| hCV11942562 | GGCAGCCTGGTTGATGAGT | (SEQ ID NO: 1644) |
| hCV11962159 | TCAAGCAGTGGTGATCTCAG | (SEQ ID NO: 1647) |
| hCV11975250 | GATGAACCCACAGAAAATGAT | (SEQ ID NO: 1650) |
| hCV11975296 | CTCCACCTGCATTTCAGAG | (SEQ ID NO: 1653) |
| hCV11975651 | GCCTTTTGCATGCCTTAACACT | (SEQ ID NO: 1656) |
| hCV11975658 | GTCTGACCTAGGCTAATGTCTAACACT | (SEQ ID NO: 1659) |
| hCV1198623 | TGTGTCAGGTGGGATGAGA | (SEQ ID NO: 1662) |
| hCV1202883 | AGCCTCTCCTGACTGTCATC | (SEQ ID NO: 1665) |
| hCV12066124 | GGTACGTTGGCTTCAATGGAATTG | (SEQ ID NO: 1668) |
| hCV12073840 | GTGACATCAGCTCTGTGTTGAGAT | (SEQ ID NO: 1671) |
| hCV12086148 | CCTTCTCCCTCTTGCCTTCACT | (SEQ ID NO: 1674) |
| hCV12092542 | AACAGTTAAGATGTTGGAATACCT | (SEQ ID NO: 1677) |
| hCV12098639 | GACTCGGACCCTGACTGA | (SEQ ID NO: 1680) |

TABLE 3-continued

| | | |
|---|---|---|
| hCV134275 | CCAATCTTCCTTACCCGATTTCTTCT | (SEQ ID NO: 1683) |
| hCV134278 | GGAGCCACCCGACACTTAC | (SEQ ID NO: 1686) |
| hCV1376206 | GCAGCAATTCCTGTTTGATGTC | (SEQ ID NO: 1689) |
| hCV1376207 | TCACCGGACATCAAACAGGAATTG | (SEQ ID NO: 1692) |
| hCV1376227 | GCCCATCCCGAGTCAAATTCT | (SEQ ID NO: 1695) |
| hCV1376246 | CTGTGCCTCCTTAACAGACTTTCAG | (SEQ ID NO: 1698) |
| hCV1376342 | TCAGGGAGCCTAGATATCTCA | (SEQ ID NO: 1701) |
| hCV1420741 | CCAGCATTCGTGGACTCAA | (SEQ ID NO: 1704) |
| hCV1455329 | GGGGCACTTACACAGCTATAGACA | (SEQ ID NO: 1707) |
| hCV1547677 | TGATTCTGGAATGATGGTAAGTC | (SEQ ID NO: 1710) |
| hCV15755949 | GGTGAAGAATGTTTGGCTCCTAGAAATA | (SEQ ID NO: 1713) |
| hCV15793897 | CAGAGTCTAGGCAATTTTTACAAC | (SEQ ID NO: 1716) |
| hCV15860433 | CCTGTACTTTATCTGGCAATCCTACCT | (SEQ ID NO: 1719) |
| hCV15864094 | GACCCAAGTGTCATTCTCAGTAGACA | (SEQ ID NO: 1722) |
| hCV15871021 | CATGTCTGAGGGTGATATTTATTC | (SEQ ID NO: 1725) |
| hCV15885425 | TCCACCTCTTCCCGTGAGAAAG | (SEQ ID NO: 1728) |
| hCV15947925 | CACCGCTTACCTCCCTTCTG | (SEQ ID NO: 1731) |
| hCV15949414 | TCTTGCAGGTGGAACAGAT | (SEQ ID NO: 1734) |
| hCV15952952 | CACACACACACGAAACAATACTAC | (SEQ ID NO: 1737) |
| hCV15953063 | GGATCCCGGCAGTGACT | (SEQ ID NO: 1740) |
| hCV15956034 | CACGGGGCCTAGGATGGTATATT | (SEQ ID NO: 1743) |
| hCV15956054 | CGGCTTTGCACCTCTGTTCTT | (SEQ ID NO: 1746) |
| hCV15956055 | GGGTCTGTGTGTGGGTACTG | (SEQ ID NO: 1749) |
| hCV15956059 | GGTGCAAAGCCGGAGAGAA | (SEQ ID NO: 1752) |
| hCV15956077 | CCTCTCATGGGAGATGAACAGTACA | (SEQ ID NO: 1755) |
| hCV15968043 | GAGAAAGGTGTATCTTTTGTAATGTCTGACAGAT | (SEQ ID NO: 1758) |
| hCV15977624 | CTCCCATCAGCCTAGGATCATG | (SEQ ID NO: 1761) |
| hCV15990789 | GCCAGTGCCTTCCTACAA | (SEQ ID NO: 1764) |
| hCV16000557 | CCCCTGCGTGATCATTAAAGTG | (SEQ ID NO: 1767) |
| hCV1605386 | GCACCATTGCCCTCCAG | (SEQ ID NO: 1770) |
| hCV16135173 | GCCTGCTACATTTGAACTTGCTCTTA | (SEQ ID NO: 1773) |
| hCV16170613 | CCTATAAACAGCATGTGATCATATT | (SEQ ID NO: 1776) |
| hCV16172935 | GAGCAAGCTCAGAAAATTTTTAT | (SEQ ID NO: 1779) |
| hCV16177220 | TGATTGTGAGGTTCTAAAAGAGATA | (SEQ ID NO: 1782) |
| hCV16180170 | CAAAGGACTCACAGGAATGAC | (SEQ ID NO: 1785) |
| hCV1650632 | CTTCAAAGGTGATGACATC | (SEQ ID NO: 1788) |
| hCV1678674 | ACTATTCATAGATGCCTGTCACTATTCAGAA | (SEQ ID NO: 1791) |
| hCV1678682 | TGGGGAAGGCCTGATGTCA | (SEQ ID NO: 1794) |
| hCV1703855 | CAAGTGAAACATGGCGTCTTGT | (SEQ ID NO: 1797) |
| hCV1703867 | CCATCACCCAGGGATTTCAACTTAC | (SEQ ID NO: 1800) |

TABLE 3-continued

| | | |
|---|---|---|
| hCV1703892 | GCTTCTACCGCTTCCCTCTACT | (SEQ ID NO: 1803) |
| hCV1703910 | CCTTGCATCTTCGTATACTGTTAATTCTAAACC | (SEQ ID NO: 1806) |
| hCV1723643 | TCCACACGCACAAGATGA | (SEQ ID NO: 1809) |
| hCV1825046 | CTTCGAAGAAGACATGGGCTCTAGA | (SEQ ID NO: 1812) |
| hCV1833991 | CCTCTCCAACATCCTCTCCTTGTTAT | (SEQ ID NO: 1815) |
| hCV1834242 | CTTACCATCTTTGGTTCTTGCCATCTT | (SEQ ID NO: 1818) |
| hCV1841975 | GCTAGTGCCACTGTTTGTCTATG | (SEQ ID NO: 1821) |
| hCV1842260 | TTATCCAAATTTCACCATCTCA | (SEQ ID NO: 1824) |
| hCV1859855 | GGAAGGAGGCTGGTGTGT | (SEQ ID NO: 1827) |
| hCV1874482 | CCCTTTTTGCAGCTGTATTC | (SEQ ID NO: 1830) |
| hCV18996 | TGCTGCCCCATTTTCTAATA | (SEQ ID NO: 1833) |
| hCV1900162 | TGTTCTTTGGTGGGTAACTTTA | (SEQ ID NO: 1836) |
| hCV1937195 | GGCCTCTTCCCTTTGATTA | (SEQ ID NO: 1839) |
| hCV1974936 | AGGCTTAGACAAGGTGGTGACTTAC | (SEQ ID NO: 1842) |
| hCV1974951 | TCCTCCATGCTGGGTACCTC | (SEQ ID NO: 1845) |
| hCV1974967 | AGGGTCCACGTCTGACAAGT | (SEQ ID NO: 1848) |
| hCV2017876 | TCCAGACAGCAGAGGATTACTGG | (SEQ ID NO: 1851) |
| hCV2086329 | CTTGCCTGCATTTTTAACAC | (SEQ ID NO: 1854) |
| hCV2103346 | ACTGGTGTGGTCAACGTGTATCA | (SEQ ID NO: 1857) |
| hCV2103392 | CCATAATGCAATGTGGCAAGTTCTAC | (SEQ ID NO: 1860) |
| hCV2144411 | CCCGTGTGCTTCTGTTTC | (SEQ ID NO: 1863) |
| hCV2211618 | AGTGTGGCTAGCTTGCTCTATAT | (SEQ ID NO: 1866) |
| hCV22272267 | CCTCTAGAAAGAAAATGGACTGTAT | (SEQ ID NO: 1869) |
| hCV2288095 | CGAGGAAGGATAGGGTGGTATTGT | (SEQ ID NO: 1872) |
| hCV2303891 | TGGATGAACAAGAAACAAGTGT | (SEQ ID NO: 1875) |
| hCV233148 | CCGCTGACAATCACAGTGTT | (SEQ ID NO: 1878) |
| hCV2403368 | GGCATCGGCACATAGTAGA | (SEQ ID NO: 1881) |
| hCV2456747 | TTCTTCACAGCTTCCATTAGTAAG | (SEQ ID NO: 1884) |
| hCV2494846 | CAACAGGCAGGTTTCTTCTC | (SEQ ID NO: 1887) |
| hCV2532034 | TCCCATAGAAAAATGCACTAAG | (SEQ ID NO: 1890) |
| hCV25473516 | GCACATGCGCAATAGC | (SEQ ID NO: 1893) |
| hCV25474413 | GGCTTCTGCAGAGCTGTAAGA | (SEQ ID NO: 1896) |
| hCV25474414 | AAGAAATAGGGAGAGAGGGGAGTAGT | (SEQ ID NO: 1899) |
| hCV25596789 | TTTAAGCCTTCTACCTACAACATTAC | (SEQ ID NO: 1902) |
| hCV25602230 | ACGTCCGAGACACAGTC | (SEQ ID NO: 1905) |
| hCV25611352 | AGAAACTTTTCTTTGCTGATGA | (SEQ ID NO: 1908) |
| hCV25615302 | GGGTTGGGCTTAATGACTT | (SEQ ID NO: 1911) |
| hCV25620145 | GGGCTAACTCTTTGCATGTTC | (SEQ ID NO: 1914) |
| hCV25634754 | GCAAACTAAGGGACCACCTGAATC | (SEQ ID NO: 1917) |
| hCV25649928 | TTCTTAAAGGGTCATGAAACTTAC | (SEQ ID NO: 1920) |

TABLE 3-continued

| | | |
|---|---|---|
| hCV25748719 | AACCTCCAGCTTTCAGACAC | (SEQ ID NO: 1923) |
| hCV2575036 | TTGGCTCTGGAGAATGAGA | (SEQ ID NO: 1926) |
| hCV25752810 | AATGCAGTAATTTGTGAGTTTTACTAC | (SEQ ID NO: 1929) |
| hCV25767872 | AATCCAGAGCTTCAGATTCTG | (SEQ ID NO: 1932) |
| hCV25768636 | CCCCGCCAGACATCTT | (SEQ ID NO: 1935) |
| hCV2590858 | GGTGAAGCCCACGATATCT | (SEQ ID NO: 1938) |
| hCV25932979 | TCCCTTCTTGGACTTCACATTGATGA | (SEQ ID NO: 1941) |
| hCV25951992 | GAGGGCACCAATCATTACA | (SEQ ID NO: 1944) |
| hCV25959466 | TGTGCTGATCAGCAAAGTGT | (SEQ ID NO: 1947) |
| hCV25959498 | AATGGGCTGGCTACCAT | (SEQ ID NO: 1950) |
| hCV25990131 | CCATTTATAGAATGAGTGAGATGATAT | (SEQ ID NO: 1953) |
| hCV25991132 | AGTAAAGGGCAGGAACATAGAG | (SEQ ID NO: 1956) |
| hCV25995678 | TGTGGTTGTAAGAATCAATCCTAA | (SEQ ID NO: 1959) |
| hCV25996277 | GCACAGAGCTTAGGAGACATAG | (SEQ ID NO: 1962) |
| hCV26034142 | GCAACAGGCTGATGTTCATATATTTCTCTT | (SEQ ID NO: 1965) |
| hCV26034157 | ATACGACGATCATGAGCCATGTCTA | (SEQ ID NO: 1968) |
| hCV26038139 | TGCCATGTAGCCATCTTGAGTGTA | (SEQ ID NO: 1971) |
| hCV2605707 | CTTGGAGGCCAGAACAATAGGTAGAA | (SEQ ID NO: 1974) |
| hCV26175114 | GGATCACACTTCACCATCTG | (SEQ ID NO: 1977) |
| hCV26265231 | TGACCCAAATCCTTTTCTCACCATACT | (SEQ ID NO: 1980) |
| hCV26338456 | AGGTGTTCCTGATGTCATTTCACAGTA | (SEQ ID NO: 1983) |
| hCV26338482 | CATCTCAAGGGTAGGGAGAAGTCAA | (SEQ ID NO: 1986) |
| hCV26338512 | TTTGAAACGCCCGACATTCTTCTATTC | (SEQ ID NO: 1989) |
| hCV26338513 | GGGCAGTACAGGACATACATTCTC | (SEQ ID NO: 1992) |
| hCV263841 | AAGTTCTTTGCTCCGACTTCT | (SEQ ID NO: 1995) |
| hCV26719108 | CCTTTACCCACCTTCCTCTGTATCT | (SEQ ID NO: 1998) |
| hCV26719113 | TCTTCCACCATCCCAAAGTTACTAAACA | (SEQ ID NO: 2001) |
| hCV26719121 | CAGTTGAAGTGGACAGGCATTACT | (SEQ ID NO: 2004) |
| hCV26719154 | CCTATTGCTCCCACTCTTCCTACTAC | (SEQ ID NO: 2007) |
| hCV26719227 | AAACATTTGCCACAAGGCAAGTTTTG | (SEQ ID NO: 2010) |
| hCV26887403 | CCTTGCAAATAACCATTAAGACCCTTACA | (SEQ ID NO: 2013) |
| hCV26887434 | GTTGCTAAATCTCCCATTTCTGCTCTTAT | (SEQ ID NO: 2016) |
| hCV26887464 | CTGTTCCATTCTCCCCAGAGACTA | (SEQ ID NO: 2019) |
| hCV26895255 | GTCTGGGGTGAATCCAGTCAT | (SEQ ID NO: 2022) |
| hCV2699725 | GGAGCATGTTGTGTTTCTGATTGTA | (SEQ ID NO: 2025) |
| hCV27020269 | GGCTCTCTGCCCCATGAAC | (SEQ ID NO: 2028) |
| hCV2706410 | TGCCGAGTCTGAGAAGATTC | (SEQ ID NO: 2031) |
| hCV27102953 | CACAGCCTGTATCGGTTTGAACTAAC | (SEQ ID NO: 2034) |
| hCV27102978 | GATTTGGAGCTGGGTCACTCAC | (SEQ ID NO: 2037) |
| hCV27103080 | GTTCCAGGACAACCCTCAGATACT | (SEQ ID NO: 2040) |

TABLE 3-continued

| | | |
|---|---|---|
| hCV27103182 | GCATCTGAGTTTGCCTGACACA | (SEQ ID NO: 2043) |
| hCV27103188 | CCTGAACCCAGGAGGTCATCT | (SEQ ID NO: 2046) |
| hCV27103189 | GGGGCAGATGTGAATTAGTGTCT | (SEQ ID NO: 2049) |
| hCV27103207 | CTGTGGTACCCCTTGGAGGAG | (SEQ ID NO: 2052) |
| hCV2716314 | GGTGTCTTGGTGATCTCACATAA | (SEQ ID NO: 2055) |
| hCV2734332 | TGTGAGGGAGGCTGTCTACT | (SEQ ID NO: 2058) |
| hCV2744023 | ATCTGCCTTCTTAGTGAATTGAT | (SEQ ID NO: 2061) |
| hCV27474895 | GAGTTCGGTATGCATCCTCACAT | (SEQ ID NO: 2064) |
| hCV27474984 | TCAGCCGTTCAGACAATATTGTTA | (SEQ ID NO: 2067) |
| hCV27476043 | CAGGACCCTCCCTCAGAGAC | (SEQ ID NO: 2070) |
| hCV27477533 | CATTGCCTTTTATGAGGCTCAAACATA | (SEQ ID NO: 2073) |
| hCV27480803 | CATCCAAGGGTATACTGTGCCATTAT | (SEQ ID NO: 2076) |
| hCV27490984 | GTCTGGAAACAACTCGGAGGATACT | (SEQ ID NO: 2079) |
| hCV27502514 | CTCACAATTGCATAGTGCCCTCTTA | (SEQ ID NO: 2082) |
| hCV27833944 | CAACTTGTATTCCTCTGCAGGATTTACTG | (SEQ ID NO: 2085) |
| hCV27878067 | CCAGAATGCAACAGGTAAATATAACATCAAATCC | (SEQ ID NO: 2088) |
| hCV27902808 | CCCCAGCACCAGGATTCAG | (SEQ ID NO: 2091) |
| hCV27904396 | ACCTTCCCCTGATTTCCTGACATAT | (SEQ ID NO: 2094) |
| hCV27937396 | AGGCCAATCTTAGGTTCTACAAACAGT | (SEQ ID NO: 2097) |
| hCV27956129 | GACATTTGGCTTGGTTCCAAGTCTT | (SEQ ID NO: 2100) |
| hCV2811695 | GGTTTATGAGCAGCAGGCATACA | (SEQ ID NO: 2103) |
| hCV2852784 | GAGGCTCTTGGGGTACTT | (SEQ ID NO: 2106) |
| hCV2879752 | TCCCAGCCCCACAAGAG | (SEQ ID NO: 2109) |
| hCV2892855 | GCATCTCAGGAAATTCAGCACAACT | (SEQ ID NO: 2112) |
| hCV2892869 | CTGCCACTCTCGCATGTCATT | (SEQ ID NO: 2115) |
| hCV2892877 | CCAGAGCCTGGGCTATCT | (SEQ ID NO: 2118) |
| hCV2892893 | TTGTCCCTCATCCTTGTCATCACT | (SEQ ID NO: 2121) |
| hCV2892905 | CATGGCTTCCTGTAATGGAAACACAT | (SEQ ID NO: 2124) |
| hCV2892918 | CATCTCCCAGCTGAGTCAACAAC | (SEQ ID NO: 2127) |
| hCV2892926 | GAACGATTAGAATGCTGAACTTTCACATTTAGAC | (SEQ ID NO: 2130) |
| hCV2892927 | CAGTGTTAATGAGTGTAGACCTCAGAGAT | (SEQ ID NO: 2133) |
| hCV28960679 | CGGCCTGGCTGCTAACA | (SEQ ID NO: 2136) |
| hCV2915511 | GGGACTGAGGCTCCAACTAC | (SEQ ID NO: 2139) |
| hCV29210363 | GCTGCTATAATAAAGTTGCTCCTTCAAGTA | (SEQ ID NO: 2142) |
| hCV29269378 | CACTCAAGTACTCAAGCCTCTTTTATAAGC | (SEQ ID NO: 2145) |
| hCV29271569 | AACTCCCGACCCCAGGTAATC | (SEQ ID NO: 2148) |
| hCV29521317 | TCTTTGTGTTGCCTGCCTATG | (SEQ ID NO: 2151) |
| hCV2969899 | CACCTGAGACAGAATTGGGTCTAAC | (SEQ ID NO: 2154) |
| hCV29821005 | CTCCTGTTGCTTCACATCCTCTCTA | (SEQ ID NO: 2157) |
| hCV2986575 | ATGGTTGCATCTCTACTGAACATGTACA | (SEQ ID NO: 2160) |

TABLE 3-continued

| | | |
|---|---|---|
| hCV29983641 | CCCTCCCCATTTGTTGTCATGA | (SEQ ID NO: 2163) |
| hCV30002208 | GAGGCCTCTGTCTTTGGTTTTGTA | (SEQ ID NO: 2166) |
| hCV30040828 | GACAGTGAATGGGTCAGCACATAC | (SEQ ID NO: 2169) |
| hCV30205817 | CCCCAACTGCAGCTCCTAAATATTATAC | (SEQ ID NO: 2172) |
| hCV30440155 | GGAAGATGGTGCTTGCAAAGAAGAT | (SEQ ID NO: 2175) |
| hCV30505633 | CAGGCAGAAGAATAAGGGTTGAA | (SEQ ID NO: 2178) |
| hCV30548253 | TTCATCTGGTTCTCCTCTGGATAGTCT | (SEQ ID NO: 2181) |
| hCV30562347 | GCCTTCAGAACAATGCCTGATACAT | (SEQ ID NO: 2184) |
| hCV305844 | GACCCTGAGCCCAAAGAAACT | (SEQ ID NO: 2187) |
| hCV30626715 | GGAGACCCAATTGATTAATGCTCATGT | (SEQ ID NO: 2190) |
| hCV30690777 | GCCCACAGCATACAGTAACACTA | (SEQ ID NO: 2193) |
| hCV30690778 | AAGGCCTATGCCCATGATTTCTACT | (SEQ ID NO: 2196) |
| hCV30690780 | GTACTCTTTATCTGGCTTGTTCATTTAGCA | (SEQ ID NO: 2199) |
| hCV30690784 | GTGTTTCCCTGTGTGTGTGATGTAT | (SEQ ID NO: 2202) |
| hCV30699692 | CCTCGAGGCCCACTGTTTTATAATAC | (SEQ ID NO: 2205) |
| hCV30711231 | TCTAAGCCATCCAGTTTGTGGTACTT | (SEQ ID NO: 2208) |
| hCV30922162 | CTCTGAAATCTGTCAGTTTTGTTTCATG | (SEQ ID NO: 2211) |
| hCV31056155 | CAAGAAATCTATCAACAGGAGCTTGGTTAT | (SEQ ID NO: 2214) |
| hCV31199195 | CAAGGAATCCTACCTCACCTTCTCATA | (SEQ ID NO: 2217) |
| hCV31475431 | GGAGTCCTGGAGAGCAGAGTC | (SEQ ID NO: 2220) |
| hCV31523557 | GGCAACACCCTCACAGATACAC | (SEQ ID NO: 2223) |
| hCV31523608 | CTGTGCACGTGGTAACTAATTGACT | (SEQ ID NO: 2226) |
| hCV31523638 | GGAGATTCCAATGGTGTTAGTCAATATGT | (SEQ ID NO: 2229) |
| hCV31523643 | GGGCCCCTTCAGTCACAGTA | (SEQ ID NO: 2232) |
| hCV31523650 | CGAATTCCTTAAGGGCACCTTATCTT | (SEQ ID NO: 2235) |
| hCV31523658 | TGACACAGAGGCACAACATAAGC | (SEQ ID NO: 2238) |
| hCV3164397 | GAGCAGTTGCTCTTCATCATC | (SEQ ID NO: 2241) |
| hCV3170967 | TCATCTTCCTCTTCCTCTGTGT | (SEQ ID NO: 2244) |
| hCV31714450 | CAGGGTGCTATAACAGAATGCAATAGAC | (SEQ ID NO: 2247) |
| hCV31749285 | GGAAGGAATGAAAGCTTTGGGTTTGA | (SEQ ID NO: 2250) |
| hCV3180954 | CAACCATATCCTGGTGTGTG | (SEQ ID NO: 2253) |
| hCV31863982 | CTGCTTTCAAACCACAAATTCATGTGT | (SEQ ID NO: 2256) |
| hCV3187716 | TTTGAGGTTGAGTGACATGTTC | (SEQ ID NO: 2259) |
| hCV31965333 | GTGCTGGAGCAATTTGGTTCAGATA | (SEQ ID NO: 2262) |
| hCV31997958 | CGTGTGAGGGACAGAGAGAA | (SEQ ID NO: 2265) |
| hCV3205858 | TGTGAGAGCAACAGCTTGAAT | (SEQ ID NO: 2268) |
| hCV3210786 | CCTCCCTTGCTCAGTCACT | (SEQ ID NO: 2271) |
| hCV3216426 | ACAGACAGTGGACAGACAATCT | (SEQ ID NO: 2274) |
| hCV3216649 | GCCACGTGGTAAAAATGACT | (SEQ ID NO: 2277) |
| hCV32209605 | CTCTTTGACAATGCAATGGTCACT | (SEQ ID NO: 2280) |

TABLE 3-continued

| | | |
|---|---|---|
| hCV32209620 | GAAGCAACAGGAGCTCTCATTCAT | (SEQ ID NO: 2283) |
| hCV32209621 | GGTGCTTTCTAGTTTTGGCAATTATGAGT | (SEQ ID NO: 2286) |
| hCV32212664 | CTAGGTTCCTGGAAGCAGCTCTTAT | (SEQ ID NO: 2289) |
| hCV32291301 | CTTCACCGCCATGTGACTTTATGAA | (SEQ ID NO: 2292) |
| hCV3230016 | ATATTGGTTACTCACAGGTGAAAT | (SEQ ID NO: 2295) |
| hCV3230030 | GTGTTTCTGTTTAGCCTGTTAGCTATACAAA | (SEQ ID NO: 2298) |
| hCV3230038 | GGGATGAAGGATTGAAGGTTAGAACAATT | (SEQ ID NO: 2301) |
| hCV3230083 | CGGCATGTGGCGGTATTC | (SEQ ID NO: 2304) |
| hCV3230084 | TCCCAGGATTCGGGCTATACC | (SEQ ID NO: 2307) |
| hCV3230096 | GTCAAGAAAGGCCCTGCGTTTAT | (SEQ ID NO: 2310) |
| hCV3230099 | TTCCCTTCGTCATCAGTCACACTTA | (SEQ ID NO: 2313) |
| hCV3230113 | GTGGGACCAGTTATGACAAGAATAATCATTATAGTAC | (SEQ ID NO: 2316) |
| hCV3230119 | AAACTCCCGTTCTATGATCGTTGTAGTT | (SEQ ID NO: 2319) |
| hCV3230131 | GAGAGGCCTGGAACCTCAGATAC | (SEQ ID NO: 2322) |
| hCV3230136 | CATCCTTGGAGTGAGGACCTG | (SEQ ID NO: 2325) |
| hCV3272537 | TGGTGGCACACACCTATAGTC | (SEQ ID NO: 2328) |
| hCV356522 | AACCCAGACTGGTTTGATATAGTATCT | (SEQ ID NO: 2331) |
| hCV4041 | CCGTTTTGTTTTTTGTTTTGTA | (SEQ ID NO: 2334) |
| hCV470708 | AGTGCTGGAGCCAAGATAAC | (SEQ ID NO: 2337) |
| hCV491830 | CCTGGCCACATTCATCAT | (SEQ ID NO: 2340) |
| hCV505733 | TGATCTGACTCCAAGCTGAGTTTAC | (SEQ ID NO: 2343) |
| hCV540410 | TGTACTGAATGGTGTCATTTACTC | (SEQ ID NO: 2346) |
| hCV596326 | ACTGGGGTTTACTGCTCCAATTACT | (SEQ ID NO: 2349) |
| hCV596330 | CCTTGGAATCTAGAAGGCCTTTTAGTCT | (SEQ ID NO: 2352) |
| hCV596331 | CCATTTGCCAATGAGAAATATCAGGTTACT | (SEQ ID NO: 2355) |
| hCV596335 | GTTCACCTGGCCAGAGATCAGA | (SEQ ID NO: 2358) |
| hCV596336 | CTTTGCATGTTATCTGCCACTGAGAT | (SEQ ID NO: 2361) |
| hCV596337 | CAGTGACAAGGGAAGATTGACACAT | (SEQ ID NO: 2364) |
| hCV596663 | GAGGGATAAATACATCAATGGCACAAAGA | (SEQ ID NO: 2367) |
| hCV596669 | GCAGGGATGTCAAGGGACTAGA | (SEQ ID NO: 2370) |
| hCV7422466 | GTTTGGGATGGCACAATGATTTATG | (SEQ ID NO: 2373) |
| hCV7429782 | ATCCTCCAATCTTCCTCCCCATATC | (SEQ ID NO: 2376) |
| hCV7429793 | CTCTGGCTTGAAGGGCAAAGAC | (SEQ ID NO: 2379) |
| hCV7459627 | TGCCACATGCTTCTTCTAAC | (SEQ ID NO: 2382) |
| hCV7504118 | AAACAGTTCGAGGATACACACAATCTCA | (SEQ ID NO: 2385) |
| hCV7574127 | GAAACAGTTGGTCAAACTGACAAGA | (SEQ ID NO: 2388) |
| hCV7581501 | TCCATCCACCGCTTACTG | (SEQ ID NO: 2391) |
| hCV7584272 | TGGCTCAGTTCTTTTTCTTCTAT | (SEQ ID NO: 2394) |
| hCV7625318 | TCAAGCTGAGGGTGGTCTAG | (SEQ ID NO: 2397) |
| hCV788647 | TGTCCACTCCTGGCACACTT | (SEQ ID NO: 2400) |

TABLE 3-continued

| | | |
|---|---|---|
| hCV813581 | GAGCATATTCCCCACCACAGTT | (SEQ ID NO: 2403) |
| hCV815038 | CATTTTGCACCCAACCACAACT | (SEQ ID NO: 2406) |
| hCV8241630 | CCTCTCAAGCAAATACGCCTTGAA | (SEQ ID NO: 2409) |
| hCV8361354 | GCAATGCACGTGACCATCTT | (SEQ ID NO: 2412) |
| hCV837462 | TGGACATATGCTATTGACTTTAAAA | (SEQ ID NO: 2415) |
| hCV8598986 | GGAGGCCCTGCCAGATG | (SEQ ID NO: 2418) |
| hCV8688111 | GTCACAGATCATTTATCACAGTGTACCAT | (SEQ ID NO: 2421) |
| hCV8703249 | AAGCTAGAGGATGGTCCCAGTTTTAC | (SEQ ID NO: 2424) |
| hCV8717752 | GGCAGAAGTGACAGTAGGTTAGTCT | (SEQ ID NO: 2427) |
| hCV8717873 | TGTGAAAGAACCAACTGAATTAAA | (SEQ ID NO: 2430) |
| hCV8717893 | CGCTGAACTGACCGTCTCATTC | (SEQ ID NO: 2433) |
| hCV8717916 | TTGTACCCCAGGTTGAAAAT | (SEQ ID NO: 2436) |
| hCV8717949 | GGGAACAGGTGTTCACATCA | (SEQ ID NO: 2439) |
| hCV8726802 | CCAGGTGGTGGATTCTTAAGT | (SEQ ID NO: 2442) |
| hCV8727391 | TTCCTAGGCCCAAACAGA | (SEQ ID NO: 2445) |
| hCV8827309 | AAGTTGGATCGAGTTATAACAACTATA | (SEQ ID NO: 2448) |
| hCV8856223 | CCTGCTTTGCGTCTGAAGAGATAT | (SEQ ID NO: 2451) |
| hCV8857351 | AGCCTGCTGTCCTGCTCTAT | (SEQ ID NO: 2454) |
| hCV8911768 | CTGATTTTGCTCCAATAGGCACTTTT | (SEQ ID NO: 2457) |
| hCV8919442 | GGTGTCTCCCAACTTTATGTG | (SEQ ID NO: 2460) |
| hCV8919444 | GGTGTCTCCCAACTTTATGTG | (SEQ ID NO: 2463) |
| hCV8919450 | CAAGGTTATTGACAGTGAACTTACT | (SEQ ID NO: 2466) |
| hCV8919451 | TTTGAACCTCCAGAATCTACAG | (SEQ ID NO: 2469) |
| hCV8941510 | GGGCTACTTCACCAAAGAGAA | (SEQ ID NO: 2472) |
| hCV8957432 | CCTGACTGGCAAGGTTTAAA | (SEQ ID NO: 2475) |
| hCV9102827 | TGCTGACTCCAGCTCTTTC | (SEQ ID NO: 2478) |
| hCV9114656 | ATATTCGGATCTGTTTTCAACTTA | (SEQ ID NO: 2481) |
| hCV916106 | GTGGTTGTCTGCAGTTTTCAAATGTT | (SEQ ID NO: 2484) |
| hCV916107 | TTCAGCTTTTTATTGAACACATTATA | (SEQ ID NO: 2487) |
| hCV926518 | CCCAGCTGCCAAATTTC | (SEQ ID NO: 2490) |
| hCV9327878 | TGACCTGAACGACTTCACAG | (SEQ ID NO: 2493) |
| hCV9493081 | TTCATCCCTGGCTTCACAGTACAT | (SEQ ID NO: 2496) |
| hCV949676 | CACCCCCACTTGTCAAAT | (SEQ ID NO: 2499) |
| hCV9596963 | GGCCCTCCAGGATCTG | (SEQ ID NO: 2502) |
| hCV9680592 | TTTGAACAGGCACTCACTAATAG | (SEQ ID NO: 2505) |
| hCV97631 | GCACACACACGTCATCATATCTTCA | (SEQ ID NO: 2508) |
| hCV9860072 | GCTCTCCCTGTTTCAGACAT | (SEQ ID NO: 2511) |
| hDV70662128 | GCGGACGGGAAGATGTTGAT | (SEQ ID NO: 2514) |
| hDV70683187 | CTGTAAGCAGTTTGGGCTCTTTTAAT | (SEQ ID NO: 2517) |
| hDV70683212 | CCAGCCAGGCAAGGTTAAGTC | (SEQ ID NO: 2520) |

TABLE 3-continued

| | | |
|---|---|---|
| hDV70683382 | CAACTACTCTTAGAATTAAAGGCACAGCT | (SEQ ID NO: 2523) |
| hDV70941043 | AGGAAGAAGGCTCCTGTGTTCTAAT | (SEQ ID NO: 2526) |
| hDV70965621 | GGGAGTGGAACACAGGTGAGA | (SEQ ID NO: 2529) |
| hDV71075942 | TGCCAGAGGCGCATGTG | (SEQ ID NO: 2532) |
| hDV76976792 | GGCAGGCATTCTCAAGAATCCT | (SEQ ID NO: 2535) |
| hDV76976795 | GAACTGAAATCCTCCAAGTCGATCTAG | (SEQ ID NO: 2538) |
| hCV1841974 | CCCTCAGCCAGCCACTATG | (SEQ ID NO: 2541) |
| hCV1952126 | GGTCACTTCTAGTCTGGTATCCATTATCAT | (SEQ ID NO: 2544) |
| hCV22272816 | CGGCGCTGGTGAGAC | (SEQ ID NO: 2547) |
| hCV25597241 | TCCTGCTTTGCTCTGGTATCA | (SEQ ID NO: 2550) |
| hCV30500334 | AGTGTGGAGGGACCCTGATAAC | (SEQ ID NO: 2553) |
| hCV30747430 | AAGCTTATGGTGGTCCCAGTTAGT | (SEQ ID NO: 2556) |

TABLE 4

| Interrogated SNP | Interrogated rs | LD SNP | LD SNP rs | Power | Threshold $r^2$ | $r^2$ |
|---|---|---|---|---|---|---|
| hCV11503414 | rs2066865 | hCV11503416 | rs2066864 | 0.51 | 0.528621503 | 1 |
| hCV11503414 | rs2066865 | hCV11503431 | rs2066861 | 0.51 | 0.528621503 | 1 |
| hCV11503414 | rs2066865 | hCV11853483 | rs12644950 | 0.51 | 0.528621503 | 1 |
| hCV11503414 | rs2066865 | hCV11853489 | rs7681423 | 0.51 | 0.528621503 | 1 |
| hCV11503414 | rs2066865 | hCV11853496 | rs7654093 | 0.51 | 0.528621503 | 1 |
| hCV11503414 | rs2066865 | hCV27020277 | rs6825454 | 0.51 | 0.528621503 | 0.9115 |
| hCV11503414 | rs2066865 | hCV2892859 | rs13130318 | 0.51 | 0.528621503 | 0.8654 |
| hCV11503414 | rs2066865 | hCV2892869 | rs13109457 | 0.51 | 0.528621503 | 0.9571 |
| hCV11503414 | rs2066865 | hCV2892877 | rs6050 | 0.51 | 0.528621503 | 0.9148 |
| hCV11503414 | rs2066865 | hCV31863982 | rs7659024 | 0.51 | 0.528621503 | 1 |
| hCV11503431 | rs2066861 | hCV11503414 | rs2066865 | 0.51 | 0.521395339 | 1 |
| hCV11503431 | rs2066861 | hCV11503416 | rs2066864 | 0.51 | 0.521395339 | 1 |
| hCV11503431 | rs2066861 | hCV11853483 | rs12644950 | 0.51 | 0.521395339 | 1 |
| hCV11503431 | rs2066861 | hCV11853489 | rs7681423 | 0.51 | 0.521395339 | 1 |
| hCV11503431 | rs2066861 | hCV11853496 | rs7654093 | 0.51 | 0.521395339 | 1 |
| hCV11503431 | rs2066861 | hCV15860433 | rs2070006 | 0.51 | 0.521395339 | 0.5225 |
| hCV11503431 | rs2066861 | hCV27020269 | rs7659613 | 0.51 | 0.521395339 | 0.5225 |
| hCV11503431 | rs2066861 | hCV27020277 | rs6825454 | 0.51 | 0.521395339 | 0.9115 |
| hCV11503431 | rs2066861 | hCV2892859 | rs13130318 | 0.51 | 0.521395339 | 0.8654 |
| hCV11503431 | rs2066861 | hCV2892869 | rs13109457 | 0.51 | 0.521395339 | 0.9571 |
| hCV11503431 | rs2066861 | hCV2892877 | rs6050 | 0.51 | 0.521395339 | 0.9148 |
| hCV11503431 | rs2066861 | hCV31863982 | rs7659024 | 0.51 | 0.521395339 | 1 |
| hCV11853483 | rs12644950 | hCV11503414 | rs2066865 | 0.51 | 0.506269027 | 1 |
| hCV11853483 | rs12644950 | hCV11503416 | rs2066864 | 0.51 | 0.506269027 | 1 |
| hCV11853483 | rs12644950 | hCV11503431 | rs2066861 | 0.51 | 0.506269027 | 1 |
| hCV11853483 | rs12644950 | hCV11853489 | rs7681423 | 0.51 | 0.506269027 | 1 |
| hCV11853483 | rs12644950 | hCV11853496 | rs7654093 | 0.51 | 0.506269027 | 1 |
| hCV11853483 | rs12644950 | hCV27020277 | rs6825454 | 0.51 | 0.506269027 | 0.9041 |
| hCV11853483 | rs12644950 | hCV2892859 | rs13130318 | 0.51 | 0.506269027 | 0.8547 |
| hCV11853483 | rs12644950 | hCV2892869 | rs13109457 | 0.51 | 0.506269027 | 0.9537 |
| hCV11853483 | rs12644950 | hCV2892877 | rs6050 | 0.51 | 0.506269027 | 0.9079 |
| hCV11853483 | rs12644950 | hCV31863982 | rs7659024 | 0.51 | 0.506269027 | 1 |
| hCV11853496 | rs7654093 | hCV11503414 | rs2066865 | 0.51 | 0.521395339 | 1 |
| hCV11853496 | rs7654093 | hCV11503416 | rs2066864 | 0.51 | 0.521395339 | 1 |
| hCV11853496 | rs7654093 | hCV11503431 | rs2066861 | 0.51 | 0.521395339 | 1 |
| hCV11853496 | rs7654093 | hCV11853483 | rs12644950 | 0.51 | 0.521395339 | 1 |
| hCV11853496 | rs7654093 | hCV11853489 | rs7681423 | 0.51 | 0.521395339 | 1 |
| hCV11853496 | rs7654093 | hCV27020277 | rs6825454 | 0.51 | 0.521395339 | 0.9109 |
| hCV11853496 | rs7654093 | hCV2892859 | rs13130318 | 0.51 | 0.521395339 | 0.8643 |
| hCV11853496 | rs7654093 | hCV2892869 | rs13109457 | 0.51 | 0.521395339 | 0.9568 |
| hCV11853496 | rs7654093 | hCV2892877 | rs6050 | 0.51 | 0.521395339 | 0.9143 |
| hCV11853496 | rs7654093 | hCV31863982 | rs7659024 | 0.51 | 0.521395339 | 1 |
| hCV1198623 | rs2638504 | hCV16269565 | rs2682338 | 0.51 | 0.946056388 | 0.9622 |
| hCV1198623 | rs2638504 | hCV444705 | rs6580917 | 0.51 | 0.946056388 | 0.9614 |
| hCV12066124 | rs2036914 | hCV2103343 | rs4241824 | 0.51 | 0.734459115 | 0.9351 |
| hCV12066124 | rs2036914 | hCV25474413 | rs3822057 | 0.51 | 0.734459115 | 0.9351 |
| hCV15860433 | rs2070006 | hCV27020269 | rs7659613 | 0.51 | 0.884364576 | 1 |
| hCV15860433 | rs2070006 | hCV2892870 | rs2070011 | 0.51 | 0.884364576 | 0.9647 |
| hCV15885425 | rs2290754 | hCV15760229 | rs3006939 | 0.51 | 0.641487193 | 0.6943 |

TABLE 4-continued

| Interrogated SNP | Interrogated rs | LD SNP | LD SNP rs | Power | Threshold $r^2$ | $r^2$ |
|---|---|---|---|---|---|---|
| hCV15885425 | rs2290754 | hCV15760238 | rs3006936 | 0.51 | 0.641487193 | 0.7059 |
| hCV15885425 | rs2290754 | hCV15823024 | rs2125230 | 0.51 | 0.641487193 | 1 |
| hCV15885425 | rs2290754 | hCV15965338 | rs2291410 | 0.51 | 0.641487193 | 1 |
| hCV15885425 | rs2290754 | hCV16082410 | rs2881275 | 0.51 | 0.641487193 | 1 |
| hCV15885425 | rs2290754 | hCV1678656 | rs1458024 | 0.51 | 0.641487193 | 1 |
| hCV15885425 | rs2290754 | hCV1678674 | rs1458023 | 0.51 | 0.641487193 | 0.8095 |
| hCV15885425 | rs2290754 | hCV1678682 | rs320339 | 0.51 | 0.641487193 | 0.8718 |
| hCV15885425 | rs2290754 | hCV26034158 | rs4515770 | 0.51 | 0.641487193 | 0.6976 |
| hCV15885425 | rs2290754 | hCV26719082 | rs10927046 | 0.51 | 0.641487193 | 0.8715 |
| hCV15885425 | rs2290754 | hCV26719085 | rs10927047 | 0.51 | 0.641487193 | 0.8649 |
| hCV15885425 | rs2290754 | hCV26719107 | rs7538011 | 0.51 | 0.641487193 | 0.81 |
| hCV15885425 | rs2290754 | hCV26719113 | rs7517340 | 0.51 | 0.641487193 | 0.9318 |
| hCV15885425 | rs2290754 | hCV26719116 | rs10927039 | 0.51 | 0.641487193 | 0.8711 |
| hCV15885425 | rs2290754 | hCV26719120 | rs10927040 | 0.51 | 0.641487193 | 1 |
| hCV15885425 | rs2290754 | hCV26719121 | rs10927041 | 0.51 | 0.641487193 | 0.8181 |
| hCV15885425 | rs2290754 | hCV26719149 | rs6675851 | 0.51 | 0.641487193 | 1 |
| hCV15885425 | rs2290754 | hCV26719162 | rs4132509 | 0.51 | 0.641487193 | 1 |
| hCV15885425 | rs2290754 | hCV26719176 | rs10927076 | 0.51 | 0.641487193 | 1 |
| hCV15885425 | rs2290754 | hCV26719192 | rs10803161 | 0.51 | 0.641487193 | 1 |
| hCV15885425 | rs2290754 | hCV26719201 | rs4478795 | 0.51 | 0.641487193 | 0.7462 |
| hCV15885425 | rs2290754 | hCV26719219 | rs9782958 | 0.51 | 0.641487193 | 1 |
| hCV15885425 | rs2290754 | hCV26719222 | rs4553169 | 0.51 | 0.641487193 | 1 |
| hCV15885425 | rs2290754 | hCV26719227 | rs10927065 | 0.51 | 0.641487193 | 0.8095 |
| hCV15885425 | rs2290754 | hCV26719232 | rs10803158 | 0.51 | 0.641487193 | 1 |
| hCV15885425 | rs2290754 | hCV26719233 | rs10927067 | 0.51 | 0.641487193 | 1 |
| hCV15885425 | rs2290754 | hCV27498250 | rs3766673 | 0.51 | 0.641487193 | 0.8792 |
| hCV15885425 | rs2290754 | hCV29210363 | rs6656918 | 0.51 | 0.641487193 | 0.6952 |
| hCV15885425 | rs2290754 | hCV29542869 | rs7534117 | 0.51 | 0.641487193 | 1 |
| hCV15885425 | rs2290754 | hCV29560960 | rs7519673 | 0.51 | 0.641487193 | 0.8095 |
| hCV15885425 | rs2290754 | hCV29741723 | rs7517921 | 0.51 | 0.641487193 | 0.7042 |
| hCV15885425 | rs2290754 | hCV29994467 | rs6694738 | 0.51 | 0.641487193 | 0.81 |
| hCV15885425 | rs2290754 | hCV30084348 | rs9287269 | 0.51 | 0.641487193 | 1 |
| hCV15885425 | rs2290754 | hCV30372886 | rs9782883 | 0.51 | 0.641487193 | 1 |
| hCV15885425 | rs2290754 | hCV30690780 | rs10737888 | 0.51 | 0.641487193 | 0.7059 |
| hCV15885425 | rs2290754 | hCV31523557 | rs10754807 | 0.51 | 0.641487193 | 1 |
| hCV15885425 | rs2290754 | hCV31523563 | rs10927051 | 0.51 | 0.641487193 | 0.923 |
| hCV15885425 | rs2290754 | hCV31523638 | rs12037013 | 0.51 | 0.641487193 | 0.8715 |
| hCV15885425 | rs2290754 | hCV31523639 | rs12034588 | 0.51 | 0.641487193 | 1 |
| hCV15885425 | rs2290754 | hCV31523643 | rs6671475 | 0.51 | 0.641487193 | 0.9347 |
| hCV15885425 | rs2290754 | hCV31523650 | rs12048930 | 0.51 | 0.641487193 | 0.8181 |
| hCV15885425 | rs2290754 | hCV31523658 | rs12047209 | 0.51 | 0.641487193 | 0.7481 |
| hCV15885425 | rs2290754 | hCV31523688 | rs12049228 | 0.51 | 0.641487193 | 1 |
| hCV15885425 | rs2290754 | hCV31523691 | rs12021907 | 0.51 | 0.641487193 | 0.8095 |
| hCV15885425 | rs2290754 | hCV31523707 | rs10803152 | 0.51 | 0.641487193 | 0.8652 |
| hCV15885425 | rs2290754 | hCV31523710 | rs10927059 | 0.51 | 0.641487193 | 1 |
| hCV15885425 | rs2290754 | hCV31523723 | rs12140040 | 0.51 | 0.641487193 | 0.7484 |
| hCV15885425 | rs2290754 | hCV31523736 | rs12124113 | 0.51 | 0.641487193 | 0.8091 |
| hCV15885425 | rs2290754 | hCV31523740 | rs12032342 | 0.51 | 0.641487193 | 1 |
| hCV15885425 | rs2290754 | hCV31523744 | rs12031994 | 0.51 | 0.641487193 | 0.8095 |
| hCV15885425 | rs2290754 | hCV804126 | rs320320 | 0.51 | 0.641487193 | 1 |
| hCV15885425 | rs2290754 | hCV97631 | rs1538773 | 0.51 | 0.641487193 | 0.7059 |
| hCV15885425 | rs2290754 | hDV71836703 | rs6429433 | 0.51 | 0.641487193 | 0.81 |
| hCV16000557 | rs2377041 | hCV1642008 | rs1563471 | 0.51 | 0.48606158 | 0.8362 |
| hCV16000557 | rs2377041 | hCV1974943 | rs6672381 | 0.51 | 0.48606158 | 0.4957 |
| hCV16000557 | rs2377041 | hCV1974944 | rs6667605 | 0.51 | 0.48606158 | 0.4885 |
| hCV16000557 | rs2377041 | hCV27102953 | rs4648360 | 0.51 | 0.48606158 | 0.8987 |
| hCV16000557 | rs2377041 | hCV27102978 | rs7537581 | 0.51 | 0.48606158 | 0.8288 |
| hCV16000557 | rs2377041 | hCV27103080 | rs4648459 | 0.51 | 0.48606158 | 1 |
| hCV16000557 | rs2377041 | hCV27103144 | rs11584658 | 0.51 | 0.48606158 | 0.8636 |
| hCV16000557 | rs2377041 | hCV27103182 | rs4609377 | 0.51 | 0.48606158 | 0.7742 |
| hCV16000557 | rs2377041 | hCV27103185 | rs10797389 | 0.51 | 0.48606158 | 0.8506 |
| hCV16000557 | rs2377041 | hCV27103186 | rs4648481 | 0.51 | 0.48606158 | 0.8659 |
| hCV16000557 | rs2377041 | hCV27103188 | rs7511879 | 0.51 | 0.48606158 | 0.7719 |
| hCV16000557 | rs2377041 | hCV27103189 | rs12031493 | 0.51 | 0.48606158 | 0.738 |
| hCV16000557 | rs2377041 | hCV27103192 | rs6680471 | 0.51 | 0.48606158 | 0.6533 |
| hCV16000557 | rs2377041 | hCV27103207 | rs6424062 | 0.51 | 0.48606158 | 1 |
| hCV16000557 | rs2377041 | hCV31475436 | rs4486391 | 0.51 | 0.48606158 | 0.503 |
| hCV16000557 | rs2377041 | hCV31965210 | rs10909880 | 0.51 | 0.48606158 | 0.8659 |
| hCV16000557 | rs2377041 | hCV31965333 | rs10797390 | 0.51 | 0.48606158 | 0.7352 |
| hCV16000557 | rs2377041 | hCV788647 | rs729045 | 0.51 | 0.48606158 | 0.5863 |
| hCV16000557 | rs2377041 | hCV8725828 | rs1456461 | 0.51 | 0.48606158 | 0.5812 |
| hCV1678674 | rs1458023 | hCV15823024 | rs2125230 | 0.51 | 0.6955117 | 0.8095 |
| hCV1678674 | rs1458023 | hCV15885425 | rs2290754 | 0.51 | 0.6955117 | 0.8095 |
| hCV1678674 | rs1458023 | hCV15965338 | rs2291410 | 0.51 | 0.6955117 | 0.8095 |
| hCV1678674 | rs1458023 | hCV16082410 | rs2881275 | 0.51 | 0.6955117 | 0.8095 |
| hCV1678674 | rs1458023 | hCV1678656 | rs1458024 | 0.51 | 0.6955117 | 0.8095 |
| hCV1678674 | rs1458023 | hCV1678682 | rs320339 | 0.51 | 0.6955117 | 0.7908 |
| hCV1678674 | rs1458023 | hCV26719082 | rs10927046 | 0.51 | 0.6955117 | 0.9284 |

TABLE 4-continued

| Interrogated SNP | Interrogated rs | LD SNP | LD SNP rs | Power | Threshold $r^2$ | $r^2$ |
| --- | --- | --- | --- | --- | --- | --- |
| hCV1678674 | rs1458023 | hCV26719085 | rs10927047 | 0.51 | 0.6955117 | 0.9242 |
| hCV1678674 | rs1458023 | hCV26719107 | rs7538011 | 0.51 | 0.6955117 | 0.8655 |
| hCV1678674 | rs1458023 | hCV26719113 | rs7517340 | 0.51 | 0.6955117 | 0.721 |
| hCV1678674 | rs1458023 | hCV26719116 | rs10927039 | 0.51 | 0.6955117 | 0.7473 |
| hCV1678674 | rs1458023 | hCV26719120 | rs10927040 | 0.51 | 0.6955117 | 0.7884 |
| hCV1678674 | rs1458023 | hCV26719149 | rs6675851 | 0.51 | 0.6955117 | 0.8095 |
| hCV1678674 | rs1458023 | hCV26719162 | rs4132509 | 0.51 | 0.6955117 | 0.8095 |
| hCV1678674 | rs1458023 | hCV26719176 | rs10927076 | 0.51 | 0.6955117 | 0.776 |
| hCV1678674 | rs1458023 | hCV26719192 | rs10803161 | 0.51 | 0.6955117 | 0.7993 |
| hCV1678674 | rs1458023 | hCV26719201 | rs4478795 | 0.51 | 0.6955117 | 0.9 |
| hCV1678674 | rs1458023 | hCV26719219 | rs9782958 | 0.51 | 0.6955117 | 0.8095 |
| hCV1678674 | rs1458023 | hCV26719222 | rs4553169 | 0.51 | 0.6955117 | 0.8086 |
| hCV1678674 | rs1458023 | hCV26719227 | rs10927065 | 0.51 | 0.6955117 | 1 |
| hCV1678674 | rs1458023 | hCV26719232 | rs10803158 | 0.51 | 0.6955117 | 0.8095 |
| hCV1678674 | rs1458023 | hCV26719233 | rs10927067 | 0.51 | 0.6955117 | 0.8095 |
| hCV1678674 | rs1458023 | hCV29542869 | rs7534117 | 0.51 | 0.6955117 | 0.8095 |
| hCV1678674 | rs1458023 | hCV29560960 | rs7519673 | 0.51 | 0.6955117 | 1 |
| hCV1678674 | rs1458023 | hCV29994467 | rs6694738 | 0.51 | 0.6955117 | 0.8655 |
| hCV1678674 | rs1458023 | hCV30084348 | rs9287269 | 0.51 | 0.6955117 | 0.8095 |
| hCV1678674 | rs1458023 | hCV30372886 | rs9782883 | 0.51 | 0.6955117 | 0.8095 |
| hCV1678674 | rs1458023 | hCV31523557 | rs10754807 | 0.51 | 0.6955117 | 0.8091 |
| hCV1678674 | rs1458023 | hCV31523638 | rs12037013 | 0.51 | 0.6955117 | 0.9284 |
| hCV1678674 | rs1458023 | hCV31523639 | rs12034588 | 0.51 | 0.6955117 | 0.7993 |
| hCV1678674 | rs1458023 | hCV31523643 | rs6671475 | 0.51 | 0.6955117 | 0.7467 |
| hCV1678674 | rs1458023 | hCV31523658 | rs12047209 | 0.51 | 0.6955117 | 0.9286 |
| hCV1678674 | rs1458023 | hCV31523688 | rs12049228 | 0.51 | 0.6955117 | 0.7998 |
| hCV1678674 | rs1458023 | hCV31523691 | rs12021907 | 0.51 | 0.6955117 | 1 |
| hCV1678674 | rs1458023 | hCV31523707 | rs10803152 | 0.51 | 0.6955117 | 0.9244 |
| hCV1678674 | rs1458023 | hCV31523710 | rs10927059 | 0.51 | 0.6955117 | 0.8095 |
| hCV1678674 | rs1458023 | hCV31523723 | rs12140040 | 0.51 | 0.6955117 | 0.9245 |
| hCV1678674 | rs1458023 | hCV31523736 | rs12124113 | 0.51 | 0.6955117 | 1 |
| hCV1678674 | rs1458023 | hCV31523740 | rs12032342 | 0.51 | 0.6955117 | 0.8095 |
| hCV1678674 | rs1458023 | hCV31523744 | rs12031994 | 0.51 | 0.6955117 | 1 |
| hCV1678674 | rs1458023 | hCV804126 | rs320320 | 0.51 | 0.6955117 | 0.8095 |
| hCV1678674 | rs1458023 | hDV71836703 | rs6429433 | 0.51 | 0.6955117 | 0.7358 |
| hCV1678682 | rs320339 | hCV15823024 | rs2125230 | 0.51 | 0.68963884 | 0.8718 |
| hCV1678682 | rs320339 | hCV15885425 | rs2290754 | 0.51 | 0.68963884 | 0.8718 |
| hCV1678682 | rs320339 | hCV15965338 | rs2291410 | 0.51 | 0.68963884 | 0.8718 |
| hCV1678682 | rs320339 | hCV16082410 | rs2881275 | 0.51 | 0.68963884 | 0.8718 |
| hCV1678682 | rs320339 | hCV1678656 | rs1458024 | 0.51 | 0.68963884 | 0.8718 |
| hCV1678682 | rs320339 | hCV1678674 | rs1458023 | 0.51 | 0.68963884 | 0.7908 |
| hCV1678682 | rs320339 | hCV26719082 | rs10927046 | 0.51 | 0.68963884 | 0.8604 |
| hCV1678682 | rs320339 | hCV26719085 | rs10927047 | 0.51 | 0.68963884 | 0.8524 |
| hCV1678682 | rs320339 | hCV26719107 | rs7538011 | 0.51 | 0.68963884 | 0.801 |
| hCV1678682 | rs320339 | hCV26719113 | rs7517340 | 0.51 | 0.68963884 | 0.7898 |
| hCV1678682 | rs320339 | hCV26719116 | rs10927039 | 0.51 | 0.68963884 | 0.8086 |
| hCV1678682 | rs320339 | hCV26719120 | rs10927040 | 0.51 | 0.68963884 | 0.8575 |
| hCV1678682 | rs320339 | hCV26719121 | rs10927041 | 0.51 | 0.68963884 | 0.7003 |
| hCV1678682 | rs320339 | hCV26719149 | rs6675851 | 0.51 | 0.68963884 | 0.8718 |
| hCV1678682 | rs320339 | hCV26719162 | rs4132509 | 0.51 | 0.68963884 | 0.8718 |
| hCV1678682 | rs320339 | hCV26719176 | rs10927076 | 0.51 | 0.68963884 | 0.8492 |
| hCV1678682 | rs320339 | hCV26719192 | rs10803161 | 0.51 | 0.68963884 | 0.8649 |
| hCV1678682 | rs320339 | hCV26719201 | rs4478795 | 0.51 | 0.68963884 | 0.7099 |
| hCV1678682 | rs320339 | hCV26719219 | rs9782958 | 0.51 | 0.68963884 | 0.8718 |
| hCV1678682 | rs320339 | hCV26719222 | rs4553169 | 0.51 | 0.68963884 | 0.8711 |
| hCV1678682 | rs320339 | hCV26719227 | rs10927065 | 0.51 | 0.68963884 | 0.7908 |
| hCV1678682 | rs320339 | hCV26719232 | rs10803158 | 0.51 | 0.68963884 | 0.8718 |
| hCV1678682 | rs320339 | hCV26719233 | rs10927067 | 0.51 | 0.68963884 | 0.8718 |
| hCV1678682 | rs320339 | hCV27498250 | rs3766673 | 0.51 | 0.68963884 | 0.7611 |
| hCV1678682 | rs320339 | hCV29542869 | rs7534117 | 0.51 | 0.68963884 | 0.8718 |
| hCV1678682 | rs320339 | hCV29560960 | rs7519673 | 0.51 | 0.68963884 | 0.7908 |
| hCV1678682 | rs320339 | hCV29994467 | rs6694738 | 0.51 | 0.68963884 | 0.801 |
| hCV1678682 | rs320339 | hCV30084348 | rs9287269 | 0.51 | 0.68963884 | 0.8718 |
| hCV1678682 | rs320339 | hCV30372886 | rs9782883 | 0.51 | 0.68963884 | 0.8718 |
| hCV1678682 | rs320339 | hCV31523557 | rs10754807 | 0.51 | 0.68963884 | 0.8715 |
| hCV1678682 | rs320339 | hCV31523563 | rs10927051 | 0.51 | 0.68963884 | 0.7601 |
| hCV1678682 | rs320339 | hCV31523638 | rs12037013 | 0.51 | 0.68963884 | 0.8604 |
| hCV1678682 | rs320339 | hCV31523639 | rs12034588 | 0.51 | 0.68963884 | 0.8649 |
| hCV1678682 | rs320339 | hCV31523643 | rs6671475 | 0.51 | 0.68963884 | 0.8081 |
| hCV1678682 | rs320339 | hCV31523650 | rs12048930 | 0.51 | 0.68963884 | 0.7003 |
| hCV1678682 | rs320339 | hCV31523658 | rs12047209 | 0.51 | 0.68963884 | 0.732 |
| hCV1678682 | rs320339 | hCV31523688 | rs12049228 | 0.51 | 0.68963884 | 0.8652 |
| hCV1678682 | rs320339 | hCV31523691 | rs12021907 | 0.51 | 0.68963884 | 0.7908 |
| hCV1678682 | rs320339 | hCV31523707 | rs10803152 | 0.51 | 0.68963884 | 0.8529 |
| hCV1678682 | rs320339 | hCV31523710 | rs10927059 | 0.51 | 0.68963884 | 0.8718 |
| hCV1678682 | rs320339 | hCV31523723 | rs12140040 | 0.51 | 0.68963884 | 0.8585 |
| hCV1678682 | rs320339 | hCV31523736 | rs12124113 | 0.51 | 0.68963884 | 0.7903 |
| hCV1678682 | rs320339 | hCV31523740 | rs12032342 | 0.51 | 0.68963884 | 0.8718 |

TABLE 4-continued

| Interrogated SNP | Interrogated rs | LD SNP | LD SNP rs | Power | Threshold r² | r² |
|---|---|---|---|---|---|---|
| hCV1678682 | rs320339 | hCV31523744 | rs12031994 | 0.51 | 0.68963884 | 0.7908 |
| hCV1678682 | rs320339 | hCV804126 | rs320320 | 0.51 | 0.68963884 | 0.8718 |
| hCV1678682 | rs320339 | hDV71836703 | rs6429433 | 0.51 | 0.68963884 | 0.801 |
| hCV1825046 | rs2069952 | hCV11189130 | rs2065979 | 0.51 | 0.410917063 | 1 |
| hCV1825046 | rs2069952 | hCV11189164 | rs3746427 | 0.51 | 0.410917063 | 1 |
| hCV1825046 | rs2069952 | hCV11189240 | rs2038504 | 0.51 | 0.410917063 | 0.7662 |
| hCV1825046 | rs2069952 | hCV11189332 | rs2273683 | 0.51 | 0.410917063 | 0.5351 |
| hCV1825046 | rs2069952 | hCV11656979 | rs2065108 | 0.51 | 0.410917063 | 0.4805 |
| hCV1825046 | rs2069952 | hCV1207887 | rs959829 | 0.51 | 0.410917063 | 0.5351 |
| hCV1825046 | rs2069952 | hCV1207902 | rs2295352 | 0.51 | 0.410917063 | 0.5351 |
| hCV1825046 | rs2069952 | hCV1265082 | rs6088575 | 0.51 | 0.410917063 | 0.4377 |
| hCV1825046 | rs2069952 | hCV1265086 | rs2378251 | 0.51 | 0.410917063 | 0.4377 |
| hCV1825046 | rs2069952 | hCV1265087 | rs2889855 | 0.51 | 0.410917063 | 0.4377 |
| hCV1825046 | rs2069952 | hCV1265092 | rs6088578 | 0.51 | 0.410917063 | 0.4683 |
| hCV1825046 | rs2069952 | hCV1271671 | rs2093058 | 0.51 | 0.410917063 | 1 |
| hCV1825046 | rs2069952 | hCV1271676 | rs1577924 | 0.51 | 0.410917063 | 1 |
| hCV1825046 | rs2069952 | hCV1271685 | rs663550 | 0.51 | 0.410917063 | 0.9658 |
| hCV1825046 | rs2069952 | hCV1271688 | rs6058202 | 0.51 | 0.410917063 | 1 |
| hCV1825046 | rs2069952 | hCV1347930 | rs3736802 | 0.51 | 0.410917063 | 0.5132 |
| hCV1825046 | rs2069952 | hCV1347963 | rs13042358 | 0.51 | 0.410917063 | 0.7677 |
| hCV1825046 | rs2069952 | hCV1348023 | rs6087677 | 0.51 | 0.410917063 | 0.4741 |
| hCV1825046 | rs2069952 | hCV1361223 | rs3746450 | 0.51 | 0.410917063 | 0.5351 |
| hCV1825046 | rs2069952 | hCV15860322 | rs2069948 | 0.51 | 0.410917063 | 1 |
| hCV1825046 | rs2069952 | hCV16013581 | rs2253484 | 0.51 | 0.410917063 | 0.5351 |
| hCV1825046 | rs2069952 | hCV16013594 | rs2424999 | 0.51 | 0.410917063 | 0.5351 |
| hCV1825046 | rs2069952 | hCV16076405 | rs2145557 | 0.51 | 0.410917063 | 0.4122 |
| hCV1825046 | rs2069952 | hCV16179579 | rs2273684 | 0.51 | 0.410917063 | 0.4255 |
| hCV1825046 | rs2069952 | hCV16179908 | rs2273805 | 0.51 | 0.410917063 | 0.4805 |
| hCV1825046 | rs2069952 | hCV16191203 | rs2295887 | 0.51 | 0.410917063 | 0.4805 |
| hCV1825046 | rs2069952 | hCV1825004 | rs1415771 | 0.51 | 0.410917063 | 0.7327 |
| hCV1825046 | rs2069952 | hCV1825005 | rs945959 | 0.51 | 0.410917063 | 0.7327 |
| hCV1825046 | rs2069952 | hCV1825006 | rs1124511 | 0.51 | 0.410917063 | 0.7327 |
| hCV1825046 | rs2069952 | hCV1825047 | rs9574 | 0.51 | 0.410917063 | 1 |
| hCV1825046 | rs2069952 | hCV1825056 | rs6060285 | 0.51 | 0.410917063 | 1 |
| hCV1825046 | rs2069952 | hCV2142560 | rs4911449 | 0.51 | 0.410917063 | 0.5351 |
| hCV1825046 | rs2069952 | hCV2142561 | rs4911450 | 0.51 | 0.410917063 | 0.5351 |
| hCV1825046 | rs2069952 | hCV2142562 | rs4911451 | 0.51 | 0.410917063 | 0.5486 |
| hCV1825046 | rs2069952 | hCV2142566 | rs6088650 | 0.51 | 0.410917063 | 0.5351 |
| hCV1825046 | rs2069952 | hCV2142567 | rs725521 | 0.51 | 0.410917063 | 0.5351 |
| hCV1825046 | rs2069952 | hCV2142576 | rs2236271 | 0.51 | 0.410917063 | 0.5351 |
| hCV1825046 | rs2069952 | hCV2142578 | rs6088655 | 0.51 | 0.410917063 | 0.5351 |
| hCV1825046 | rs2069952 | hCV2142584 | rs3761144 | 0.51 | 0.410917063 | 0.6325 |
| hCV1825046 | rs2069952 | hCV2142586 | rs6060130 | 0.51 | 0.410917063 | 0.6325 |
| hCV1825046 | rs2069952 | hCV2142587 | rs6088664 | 0.51 | 0.410917063 | 0.6283 |
| hCV1825046 | rs2069952 | hCV2142597 | rs6120778 | 0.51 | 0.410917063 | 0.7713 |
| hCV1825046 | rs2069952 | hCV2142599 | rs6060140 | 0.51 | 0.410917063 | 0.6158 |
| hCV1825046 | rs2069952 | hCV2142611 | rs1885114 | 0.51 | 0.410917063 | 0.7713 |
| hCV1825046 | rs2069952 | hCV25619982 | rs6120838 | 0.51 | 0.410917063 | 0.5278 |
| hCV1825046 | rs2069952 | hCV25750225 | rs4911163 | 0.51 | 0.410917063 | 0.5351 |
| hCV1825046 | rs2069952 | hCV27166987 | rs6119542 | 0.51 | 0.410917063 | 0.5351 |
| hCV1825046 | rs2069952 | hCV27166995 | rs6088618 | 0.51 | 0.410917063 | 0.4255 |
| hCV1825046 | rs2069952 | hCV27167691 | rs2378333 | 0.51 | 0.410917063 | 0.4805 |
| hCV1825046 | rs2069952 | hCV27167696 | rs6088716 | 0.51 | 0.410917063 | 0.4698 |
| hCV1825046 | rs2069952 | hCV27486123 | rs3803937 | 0.51 | 0.410917063 | 0.4167 |
| hCV1825046 | rs2069952 | hCV29372811 | rs7266550 | 0.51 | 0.410917063 | 0.5351 |
| hCV1825046 | rs2069952 | hCV29372820 | rs6120739 | 0.51 | 0.410917063 | 0.5351 |
| hCV1825046 | rs2069952 | hCV29372834 | rs6060001 | 0.51 | 0.410917063 | 0.4255 |
| hCV1825046 | rs2069952 | hCV29530377 | rs6088747 | 0.51 | 0.410917063 | 1 |
| hCV1825046 | rs2069952 | hCV29620866 | rs6088724 | 0.51 | 0.410917063 | 0.4805 |
| hCV1825046 | rs2069952 | hCV29693120 | rs6060003 | 0.51 | 0.410917063 | 0.4255 |
| hCV1825046 | rs2069952 | hCV29711231 | rs6119536 | 0.51 | 0.410917063 | 0.5351 |
| hCV1825046 | rs2069952 | hCV29729418 | rs6142294 | 0.51 | 0.410917063 | 0.8242 |
| hCV1825046 | rs2069952 | hCV29747405 | rs6088640 | 0.51 | 0.410917063 | 0.5351 |
| hCV1825046 | rs2069952 | hCV29747445 | rs6060199 | 0.51 | 0.410917063 | 0.7956 |
| hCV1825046 | rs2069952 | hCV29837747 | rs6088728 | 0.51 | 0.410917063 | 0.4805 |
| hCV1825046 | rs2069952 | hCV29837748 | rs6088721 | 0.51 | 0.410917063 | 0.4805 |
| hCV1825046 | rs2069952 | hCV2988252 | rs2425005 | 0.51 | 0.410917063 | 0.5351 |
| hCV1825046 | rs2069952 | hCV2988254 | rs6060064 | 0.51 | 0.410917063 | 0.5351 |
| hCV1825046 | rs2069952 | hCV29909897 | rs6142324 | 0.51 | 0.410917063 | 1 |
| hCV1825046 | rs2069952 | hCV29982073 | rs6088580 | 0.51 | 0.410917063 | 0.4112 |
| hCV1825046 | rs2069952 | hCV3010271 | rs2889861 | 0.51 | 0.410917063 | 0.5351 |
| hCV1825046 | rs2069952 | hCV30180146 | rs6060216 | 0.51 | 0.410917063 | 0.4122 |
| hCV1825046 | rs2069952 | hCV30342055 | rs6088727 | 0.51 | 0.410917063 | 0.4805 |
| hCV1825046 | rs2069952 | hCV30360331 | rs6088568 | 0.51 | 0.410917063 | 0.4377 |
| hCV1825046 | rs2069952 | hCV30450320 | rs4911478 | 0.51 | 0.410917063 | 1 |
| hCV1825046 | rs2069952 | hCV30450323 | rs6058166 | 0.51 | 0.410917063 | 0.4122 |
| hCV1825046 | rs2069952 | hCV30485907 | rs6087653 | 0.51 | 0.410917063 | 0.5351 |
| hCV1825046 | rs2069952 | hCV30540259 | rs6087664 | 0.51 | 0.410917063 | 0.4215 |

TABLE 4-continued

| Interrogated SNP | Interrogated rs | LD SNP | LD SNP rs | Power | Threshold r² | r² |
|---|---|---|---|---|---|---|
| hCV1825046 | rs2069952 | hCV30612241 | rs6060168 | 0.51 | 0.410917063 | 0.7713 |
| hCV1825046 | rs2069952 | hCV30630342 | rs6141526 | 0.51 | 0.410917063 | 0.7713 |
| hCV1825046 | rs2069952 | hCV3249260 | rs7263157 | 0.51 | 0.410917063 | 0.5351 |
| hCV1825046 | rs2069952 | hCV3249263 | rs6088635 | 0.51 | 0.410917063 | 0.5351 |
| hCV1825046 | rs2069952 | hCV3249268 | rs6058137 | 0.51 | 0.410917063 | 0.5351 |
| hCV1825046 | rs2069952 | hCV3249269 | rs8116657 | 0.51 | 0.410917063 | 0.5351 |
| hCV1825046 | rs2069952 | hCV3249271 | rs4911164 | 0.51 | 0.410917063 | 0.5351 |
| hCV1825046 | rs2069952 | hCV3249272 | rs6087644 | 0.51 | 0.410917063 | 0.5123 |
| hCV1825046 | rs2069952 | hCV3249275 | rs6088642 | 0.51 | 0.410917063 | 0.5351 |
| hCV1825046 | rs2069952 | hCV3249278 | rs6120757 | 0.51 | 0.410917063 | 0.5351 |
| hCV1825046 | rs2069952 | hCV3249280 | rs6120758 | 0.51 | 0.410917063 | 0.5351 |
| hCV1825046 | rs2069952 | hCV3249286 | rs6088646 | 0.51 | 0.410917063 | 0.5351 |
| hCV1825046 | rs2069952 | hCV3249289 | rs2223881 | 0.51 | 0.410917063 | 0.5351 |
| hCV1825046 | rs2069952 | hCV3249290 | rs2076667 | 0.51 | 0.410917063 | 0.5351 |
| hCV1825046 | rs2069952 | hCV3249293 | rs6058154 | 0.51 | 0.410917063 | 0.7713 |
| hCV1825046 | rs2069952 | hCV599565 | rs633198 | 0.51 | 0.410917063 | 1 |
| hCV1825046 | rs2069952 | hCV7499886 | rs1415774 | 0.51 | 0.410917063 | 1 |
| hCV1825046 | rs2069952 | hCV7593320 | rs1060615 | 0.51 | 0.410917063 | 0.5042 |
| hCV1825046 | rs2069952 | hCV7593321 | rs1013677 | 0.51 | 0.410917063 | 0.5351 |
| hCV1825046 | rs2069952 | hCV7593328 | rs1018447 | 0.51 | 0.410917063 | 0.5351 |
| hCV1825046 | rs2069952 | hDV71833331 | rs6142280 | 0.51 | 0.410917063 | 0.7376 |
| hCV1825046 | rs2069952 | hDV72053898 | rs8114671 | 0.51 | 0.410917063 | 1 |
| hCV1834242 | rs11712308 | hCV11230788 | rs7643038 | 0.51 | 0.536148259 | 0.5833 |
| hCV1834242 | rs11712308 | hCV11232131 | rs2698282 | 0.51 | 0.536148259 | 0.6604 |
| hCV1834242 | rs11712308 | hCV11232160 | rs1880041 | 0.51 | 0.536148259 | 0.6884 |
| hCV1834242 | rs11712308 | hCV11232163 | rs4327424 | 0.51 | 0.536148259 | 0.6884 |
| hCV1834242 | rs11712308 | hCV11232169 | rs6438542 | 0.51 | 0.536148259 | 0.6604 |
| hCV1834242 | rs11712308 | hCV114165 | rs6807079 | 0.51 | 0.536148259 | 0.6692 |
| hCV1834242 | rs11712308 | hCV114166 | rs6794579 | 0.51 | 0.536148259 | 0.7088 |
| hCV1834242 | rs11712308 | hCV15882316 | rs2276706 | 0.51 | 0.536148259 | 0.5833 |
| hCV1834242 | rs11712308 | hCV178227 | rs13070374 | 0.51 | 0.536148259 | 0.9338 |
| hCV1834242 | rs11712308 | hCV1834240 | rs1581451 | 0.51 | 0.536148259 | 0.5833 |
| hCV1834242 | rs11712308 | hCV1834252 | rs10934498 | 0.51 | 0.536148259 | 0.6039 |
| hCV1834242 | rs11712308 | hCV1834256 | rs2472662 | 0.51 | 0.536148259 | 0.9342 |
| hCV1834242 | rs11712308 | hCV1969071 | rs7633444 | 0.51 | 0.536148259 | 0.6884 |
| hCV1834242 | rs11712308 | hCV1969072 | rs2670296 | 0.51 | 0.536148259 | 0.6884 |
| hCV1834242 | rs11712308 | hCV263841 | rs1523127 | 0.51 | 0.536148259 | 0.5486 |
| hCV1834242 | rs11712308 | hCV26920276 | rs13062540 | 0.51 | 0.536148259 | 0.6884 |
| hCV1834242 | rs11712308 | hCV26920316 | rs2692618 | 0.51 | 0.536148259 | 0.6259 |
| hCV1834242 | rs11712308 | hCV27498971 | rs3772134 | 0.51 | 0.536148259 | 0.6884 |
| hCV1834242 | rs11712308 | hCV27504984 | rs3814055 | 0.51 | 0.536148259 | 0.5833 |
| hCV1834242 | rs11712308 | hCV29280454 | rs6794484 | 0.51 | 0.536148259 | 0.6884 |
| hCV1834242 | rs11712308 | hCV29841665 | rs7623217 | 0.51 | 0.536148259 | 0.9666 |
| hCV1834242 | rs11712308 | hCV30699687 | rs11711386 | 0.51 | 0.536148259 | 0.9351 |
| hCV1834242 | rs11712308 | hCV30747432 | rs12488820 | 0.51 | 0.536148259 | 0.6074 |
| hCV1834242 | rs11712308 | hCV3150918 | rs11720605 | 0.51 | 0.536148259 | 0.7467 |
| hCV1834242 | rs11712308 | hCV31747142 | rs7613999 | 0.51 | 0.536148259 | 0.6884 |
| hCV1834242 | rs11712308 | hCV8830526 | rs940181 | 0.51 | 0.536148259 | 0.7467 |
| hCV1834242 | rs11712308 | hCV9152783 | rs1523130 | 0.51 | 0.536148259 | 0.6039 |
| hCV1834242 | rs11712308 | hCV965662 | rs523476 | 0.51 | 0.536148259 | 0.6884 |
| hCV1834242 | rs11712308 | hCV965695 | rs552244 | 0.51 | 0.536148259 | 0.6884 |
| hCV1834242 | rs11712308 | hCV965698 | rs571352 | 0.51 | 0.536148259 | 0.6884 |
| hCV1874482 | rs2306158 | hCV11197524 | rs3736947 | 0.51 | 0.756211269 | 0.8979 |
| hCV1874482 | rs2306158 | hCV1874474 | rs2419629 | 0.51 | 0.756211269 | 0.931 |
| hCV1874482 | rs2306158 | hCV31261952 | rs12414780 | 0.51 | 0.756211269 | 1 |
| hCV1874482 | rs2306158 | hCV31262197 | rs11195948 | 0.51 | 0.756211269 | 0.929 |
| hCV1974936 | rs4648648 | hCV1974933 | rs734999 | 0.51 | 0.815233071 | 0.8413 |
| hCV1974936 | rs4648648 | hCV1974942 | rs6671426 | 0.51 | 0.815233071 | 0.8456 |
| hCV1974936 | rs4648648 | hCV1974943 | rs6672381 | 0.51 | 0.815233071 | 0.871 |
| hCV1974936 | rs4648648 | hCV1974944 | rs6667605 | 0.51 | 0.815233071 | 0.8746 |
| hCV1974936 | rs4648648 | hCV1974957 | rs7550231 | 0.51 | 0.815233071 | 0.8456 |
| hCV1974936 | rs4648648 | hCV31475436 | rs4486391 | 0.51 | 0.815233071 | 0.8728 |
| hCV1974936 | rs4648648 | hCV31475439 | rs10797434 | 0.51 | 0.815233071 | 0.8723 |
| hCV1974936 | rs4648648 | hDV68598166 | rs10797432 | 0.51 | 0.815233071 | 0.8456 |
| hCV2288095 | rs378815 | hCV11780206 | rs5931656 | 0.51 | 0.721860657 | 0.9579 |
| hCV2288095 | rs378815 | hCV11780209 | rs5930009 | 0.51 | 0.721860657 | 0.9579 |
| hCV2288095 | rs378815 | hCV11780214 | rs7878061 | 0.51 | 0.721860657 | 0.9579 |
| hCV2288095 | rs378815 | hCV26011954 | rs4620439 | 0.51 | 0.721860657 | 0.9579 |
| hCV2288095 | rs378815 | hCV26011955 | rs5930013 | 0.51 | 0.721860657 | 0.9579 |
| hCV2288095 | rs378815 | hCV26016182 | rs11796672 | 0.51 | 0.721860657 | 0.9579 |
| hCV2288095 | rs378815 | hCV26016183 | rs9887617 | 0.51 | 0.721860657 | 0.9162 |
| hCV2288095 | rs378815 | hCV27904396 | rs4829996 | 0.51 | 0.721860657 | 0.9459 |
| hCV2288095 | rs378815 | hCV28962605 | rs5930005 | 0.51 | 0.721860657 | 0.9576 |
| hCV2288095 | rs378815 | hCV29515877 | rs5930015 | 0.51 | 0.721860657 | 0.9579 |
| hCV2288095 | rs378815 | hCV29732937 | rs5931647 | 0.51 | 0.721860657 | 0.9579 |
| hCV2288095 | rs378815 | hCV29967889 | rs5931645 | 0.51 | 0.721860657 | 0.9579 |
| hCV2288095 | rs378815 | hCV30130033 | rs5931646 | 0.51 | 0.721860657 | 0.9579 |
| hCV2288095 | rs378815 | hCV30201992 | rs5931641 | 0.51 | 0.721860657 | 0.9579 |

TABLE 4-continued

| Interrogated SNP | Interrogated rs | LD SNP | LD SNP rs | Power | Threshold r² | r² |
|---|---|---|---|---|---|---|
| hCV2288095 | rs378815 | hCV30291634 | rs5931666 | 0.51 | 0.721860657 | 0.9562 |
| hCV2288095 | rs378815 | hCV30700232 | rs12687091 | 0.51 | 0.721860657 | 0.9579 |
| hCV2288095 | rs378815 | hCV596663 | rs411017 | 0.51 | 0.721860657 | 1 |
| hCV2288095 | rs378815 | hCV596665 | rs401597 | 0.51 | 0.721860657 | 0.9459 |
| hCV2288095 | rs378815 | hDV77022847 | rs4598407 | 0.51 | 0.721860657 | 0.9579 |
| hCV2288095 | rs378815 | hDV77148131 | rs5931661 | 0.51 | 0.721860657 | 0.9116 |
| hCV2288095 | rs378815 | hDV77150953 | rs5976389 | 0.51 | 0.721860657 | 0.9579 |
| hCV233148 | rs1417121 | hCV12073840 | rs14403 | 0.51 | 0.50633557 | 0.8697 |
| hCV233148 | rs1417121 | hCV15760229 | rs3006939 | 0.51 | 0.50633557 | 0.6544 |
| hCV233148 | rs1417121 | hCV15760238 | rs3006936 | 0.51 | 0.50633557 | 0.6656 |
| hCV233148 | rs1417121 | hCV15760239 | rs3006923 | 0.51 | 0.50633557 | 0.7142 |
| hCV233148 | rs1417121 | hCV26034157 | rs2994329 | 0.51 | 0.50633557 | 0.5147 |
| hCV233148 | rs1417121 | hCV26034158 | rs4515770 | 0.51 | 0.50633557 | 0.7064 |
| hCV233148 | rs1417121 | hCV26034160 | rs2994327 | 0.51 | 0.50633557 | 0.7442 |
| hCV233148 | rs1417121 | hCV26719121 | rs10927041 | 0.51 | 0.50633557 | 0.5615 |
| hCV233148 | rs1417121 | hCV29210363 | rs6656918 | 0.51 | 0.50633557 | 0.656 |
| hCV233148 | rs1417121 | hCV30690778 | rs12140414 | 0.51 | 0.50633557 | 0.5904 |
| hCV233148 | rs1417121 | hCV30690780 | rs10737888 | 0.51 | 0.50633557 | 0.6656 |
| hCV233148 | rs1417121 | hCV30690784 | rs4658574 | 0.51 | 0.50633557 | 0.7442 |
| hCV233148 | rs1417121 | hCV8688079 | rs884808 | 0.51 | 0.50633557 | 0.7442 |
| hCV233148 | rs1417121 | hCV8688080 | rs884328 | 0.51 | 0.50633557 | 0.7429 |
| hCV233148 | rs1417121 | hCV8688111 | rs1578275 | 0.51 | 0.50633557 | 0.5904 |
| hCV233148 | rs1417121 | hCV9493081 | rs1058304 | 0.51 | 0.50633557 | 1 |
| hCV233148 | rs1417121 | hCV97631 | rs1538773 | 0.51 | 0.50633557 | 0.6656 |
| hCV2456747 | rs3820059 | hCV11341869 | rs2176473 | 0.51 | 0.699341435 | 0.873 |
| hCV2456747 | rs3820059 | hCV11341876 | rs1980198 | 0.51 | 0.699341435 | 0.8561 |
| hCV2456747 | rs3820059 | hCV11341878 | rs4656670 | 0.51 | 0.699341435 | 0.873 |
| hCV2456747 | rs3820059 | hCV11341882 | rs12024897 | 0.51 | 0.699341435 | 0.873 |
| hCV2456747 | rs3820059 | hCV11341886 | rs7539415 | 0.51 | 0.699341435 | 0.873 |
| hCV2456747 | rs3820059 | hCV11341887 | rs3766095 | 0.51 | 0.699341435 | 1 |
| hCV2456747 | rs3820059 | hCV11341898 | rs12563090 | 0.51 | 0.699341435 | 0.8681 |
| hCV2456747 | rs3820059 | hCV11975148 | rs2037250 | 0.51 | 0.699341435 | 0.7895 |
| hCV2456747 | rs3820059 | hCV11975152 | rs1856303 | 0.51 | 0.699341435 | 0.7895 |
| hCV2456747 | rs3820059 | hCV15878582 | rs2275299 | 0.51 | 0.699341435 | 0.8709 |
| hCV2456747 | rs3820059 | hCV221700 | rs6677410 | 0.51 | 0.699341435 | 0.8709 |
| hCV2456747 | rs3820059 | hCV2456730 | rs961404 | 0.51 | 0.699341435 | 0.873 |
| hCV2456747 | rs3820059 | hCV2456741 | rs6696810 | 0.51 | 0.699341435 | 0.873 |
| hCV2456747 | rs3820059 | hCV2456753 | rs7528375 | 0.51 | 0.699341435 | 0.8688 |
| hCV2456747 | rs3820059 | hCV2456767 | rs2014061 | 0.51 | 0.699341435 | 0.8709 |
| hCV2456747 | rs3820059 | hCV2456768 | rs6427186 | 0.51 | 0.699341435 | 0.873 |
| hCV2456747 | rs3820059 | hCV2456776 | rs6669741 | 0.51 | 0.699341435 | 0.873 |
| hCV2456747 | rs3820059 | hCV2456780 | rs7534737 | 0.51 | 0.699341435 | 0.873 |
| hCV2456747 | rs3820059 | hCV2520836 | rs10753786 | 0.51 | 0.699341435 | 0.7613 |
| hCV2456747 | rs3820059 | hCV2520851 | rs10919132 | 0.51 | 0.699341435 | 0.7555 |
| hCV2456747 | rs3820059 | hCV2520854 | rs2300158 | 0.51 | 0.699341435 | 0.7635 |
| hCV2456747 | rs3820059 | hCV2520874 | rs1591733 | 0.51 | 0.699341435 | 0.7895 |
| hCV2456747 | rs3820059 | hCV25616192 | rs10919168 | 0.51 | 0.699341435 | 0.7266 |
| hCV2456747 | rs3820059 | hCV27242011 | rs1200083 | 0.51 | 0.699341435 | 0.7855 |
| hCV2456747 | rs3820059 | hCV27242515 | rs3818844 | 0.51 | 0.699341435 | 0.8681 |
| hCV2456747 | rs3820059 | hCV27242533 | rs2138898 | 0.51 | 0.699341435 | 0.903 |
| hCV2456747 | rs3820059 | hCV27242578 | rs6427187 | 0.51 | 0.699341435 | 0.9662 |
| hCV2456747 | rs3820059 | hCV27242639 | rs7544221 | 0.51 | 0.699341435 | 1 |
| hCV2456747 | rs3820059 | hCV27242642 | rs10919167 | 0.51 | 0.699341435 | 0.9656 |
| hCV2456747 | rs3820059 | hCV27242694 | rs6673326 | 0.51 | 0.699341435 | 1 |
| hCV2456747 | rs3820059 | hCV27480801 | rs3766057 | 0.51 | 0.699341435 | 0.7895 |
| hCV2456747 | rs3820059 | hCV27496192 | rs3753303 | 0.51 | 0.699341435 | 0.8786 |
| hCV2456747 | rs3820059 | hCV27928246 | rs4656672 | 0.51 | 0.699341435 | 1 |
| hCV2456747 | rs3820059 | hCV279320 | rs10800441 | 0.51 | 0.699341435 | 0.873 |
| hCV2456747 | rs3820059 | hCV29397237 | rs6427185 | 0.51 | 0.699341435 | 1 |
| hCV2456747 | rs3820059 | hCV29397241 | rs4656183 | 0.51 | 0.699341435 | 0.9662 |
| hCV2456747 | rs3820059 | hCV2986550 | rs10919124 | 0.51 | 0.699341435 | 0.7895 |
| hCV2456747 | rs3820059 | hCV30126929 | rs10429893 | 0.51 | 0.699341435 | 1 |
| hCV2456747 | rs3820059 | hCV30180981 | rs7415756 | 0.51 | 0.699341435 | 0.8709 |
| hCV2456747 | rs3820059 | hCV30415180 | rs7533257 | 0.51 | 0.699341435 | 0.7895 |
| hCV2456747 | rs3820059 | hCV30523079 | rs10489189 | 0.51 | 0.699341435 | 1 |
| hCV2456747 | rs3820059 | hCV30577322 | rs7516248 | 0.51 | 0.699341435 | 0.873 |
| hCV2456747 | rs3820059 | hCV32141055 | rs10800408 | 0.51 | 0.699341435 | 0.7821 |
| hCV2456747 | rs3820059 | hCV32141218 | rs10800424 | 0.51 | 0.699341435 | 0.7895 |
| hCV2456747 | rs3820059 | hCV32141221 | rs10800425 | 0.51 | 0.699341435 | 0.7794 |
| hCV2456747 | rs3820059 | hCV32141272 | rs4264046 | 0.51 | 0.699341435 | 0.7895 |
| hCV2456747 | rs3820059 | hCV32141290 | rs10800435 | 0.51 | 0.699341435 | 0.8071 |
| hCV2456747 | rs3820059 | hCV32141293 | rs10800438 | 0.51 | 0.699341435 | 0.873 |
| hCV2456747 | rs3820059 | hCV32141297 | rs10800440 | 0.51 | 0.699341435 | 0.8703 |
| hCV2456747 | rs3820059 | hCV32141333 | rs10800446 | 0.51 | 0.699341435 | 0.8715 |
| hCV2456747 | rs3820059 | hCV32141337 | rs10919164 | 0.51 | 0.699341435 | 0.8391 |
| hCV2456747 | rs3820059 | hCV32141359 | rs12022776 | 0.51 | 0.699341435 | 0.8715 |
| hCV2456747 | rs3820059 | hCV459880 | rs10800439 | 0.51 | 0.699341435 | 0.7543 |
| hCV2456747 | rs3820059 | hCV8688930 | rs3905328 | 0.51 | 0.699341435 | 1 |

TABLE 4-continued

| Interrogated SNP | Interrogated rs | LD SNP | LD SNP rs | Power | Threshold r² | r² |
|---|---|---|---|---|---|---|
| hCV2456747 | rs3820059 | hCV8690976 | rs1124843 | 0.51 | 0.699341435 | 1 |
| hCV2456747 | rs3820059 | hCV8697018 | rs932301 | 0.51 | 0.699341435 | 1 |
| hCV2456747 | rs3820059 | hCV8697031 | rs1400836 | 0.51 | 0.699341435 | 1 |
| hCV2456747 | rs3820059 | hCV8697038 | rs961403 | 0.51 | 0.699341435 | 0.873 |
| hCV2456747 | rs3820059 | hCV8919256 | rs1200085 | 0.51 | 0.699341435 | 0.7829 |
| hCV2456747 | rs3820059 | hCV8919302 | rs1208370 | 0.51 | 0.699341435 | 0.7802 |
| hCV2456747 | rs3820059 | hCV8919303 | rs1018831 | 0.51 | 0.699341435 | 0.7895 |
| hCV2456747 | rs3820059 | hCV8919327 | rs1208377 | 0.51 | 0.699341435 | 0.7895 |
| hCV25474414 | rs4253399 | hCV27477533 | rs3756008 | 0.51 | 0.838310492 | 0.8606 |
| hCV25474414 | rs4253399 | hCV3230025 | rs3756009 | 0.51 | 0.838310492 | 0.9593 |
| hCV25474414 | rs4253399 | hCV8241630 | rs925451 | 0.51 | 0.838310492 | 0.9185 |
| hCV263841 | rs1523127 | hCV105917 | rs9289134 | 0.51 | 0.347046958 | 0.561 |
| hCV263841 | rs1523127 | hCV11230788 | rs7643038 | 0.51 | 0.347046958 | 0.966 |
| hCV263841 | rs1523127 | hCV11232111 | rs17203235 | 0.51 | 0.347046958 | 0.3567 |
| hCV263841 | rs1523127 | hCV134275 | rs9847068 | 0.51 | 0.347046958 | 0.5453 |
| hCV263841 | rs1523127 | hCV15882316 | rs2276706 | 0.51 | 0.347046958 | 0.966 |
| hCV263841 | rs1523127 | hCV178227 | rs13070374 | 0.51 | 0.347046958 | 0.5595 |
| hCV263841 | rs1523127 | hCV178228 | rs4687882 | 0.51 | 0.347046958 | 0.5543 |
| hCV263841 | rs1523127 | hCV1833991 | rs11926554 | 0.51 | 0.347046958 | 0.5548 |
| hCV263841 | rs1523127 | hCV1834237 | rs9865270 | 0.51 | 0.347046958 | 0.561 |
| hCV263841 | rs1523127 | hCV1834240 | rs1581451 | 0.51 | 0.347046958 | 0.966 |
| hCV263841 | rs1523127 | hCV1834242 | rs11712308 | 0.51 | 0.347046958 | 0.5486 |
| hCV263841 | rs1523127 | hCV1834243 | rs9682652 | 0.51 | 0.347046958 | 0.5966 |
| hCV263841 | rs1523127 | hCV1834252 | rs10934498 | 0.51 | 0.347046958 | 0.932 |
| hCV263841 | rs1523127 | hCV1834256 | rs2472662 | 0.51 | 0.347046958 | 0.5585 |
| hCV263841 | rs1523127 | hCV1834260 | rs4688033 | 0.51 | 0.347046958 | 0.5966 |
| hCV263841 | rs1523127 | hCV192027 | rs9821892 | 0.51 | 0.347046958 | 0.561 |
| hCV263841 | rs1523127 | hCV255886 | rs10511394 | 0.51 | 0.347046958 | 0.5966 |
| hCV263841 | rs1523127 | hCV27504984 | rs3814055 | 0.51 | 0.347046958 | 0.966 |
| hCV263841 | rs1523127 | hCV278948 | rs1464599 | 0.51 | 0.347046958 | 0.5908 |
| hCV263841 | rs1523127 | hCV29841665 | rs7623217 | 0.51 | 0.347046958 | 0.5633 |
| hCV263841 | rs1523127 | hCV30562884 | rs9815093 | 0.51 | 0.347046958 | 0.561 |
| hCV263841 | rs1523127 | hCV30699687 | rs11711386 | 0.51 | 0.347046958 | 0.5647 |
| hCV263841 | rs1523127 | hCV30747432 | rs12488820 | 0.51 | 0.347046958 | 0.9217 |
| hCV263841 | rs1523127 | hCV3150918 | rs11720605 | 0.51 | 0.347046958 | 0.3489 |
| hCV263841 | rs1523127 | hCV8830526 | rs940181 | 0.51 | 0.347046958 | 0.3489 |
| hCV263841 | rs1523127 | hCV9151800 | rs6803814 | 0.51 | 0.347046958 | 0.3494 |
| hCV263841 | rs1523127 | hCV9152783 | rs1523130 | 0.51 | 0.347046958 | 0.932 |
| hCV26719108 | rs10927035 | hCV12073160 | rs1973284 | 0.51 | 0.558010019 | 0.6861 |
| hCV26719108 | rs10927035 | hCV12073167 | rs2034915 | 0.51 | 0.558010019 | 0.6861 |
| hCV26719108 | rs10927035 | hCV12073172 | rs971285 | 0.51 | 0.558010019 | 0.6861 |
| hCV26719108 | rs10927035 | hCV12073180 | rs1870272 | 0.51 | 0.558010019 | 0.6861 |
| hCV26719108 | rs10927035 | hCV15776869 | rs2345994 | 0.51 | 0.558010019 | 0.6674 |
| hCV26719108 | rs10927035 | hCV15823033 | rs2125231 | 0.51 | 0.558010019 | 0.6861 |
| hCV26719108 | rs10927035 | hCV15885435 | rs2290753 | 0.51 | 0.558010019 | 0.6861 |
| hCV26719108 | rs10927035 | hCV15965328 | rs2291409 | 0.51 | 0.558010019 | 0.717 |
| hCV26719108 | rs10927035 | hCV1678668 | rs1379700 | 0.51 | 0.558010019 | 0.5985 |
| hCV26719108 | rs10927035 | hCV1678723 | rs1486472 | 0.51 | 0.558010019 | 0.5777 |
| hCV26719108 | rs10927035 | hCV26719086 | rs4658585 | 0.51 | 0.558010019 | 0.6417 |
| hCV26719108 | rs10927035 | hCV26719087 | rs4658401 | 0.51 | 0.558010019 | 0.6722 |
| hCV26719108 | rs10927035 | hCV26719102 | rs10927056 | 0.51 | 0.558010019 | 0.6269 |
| hCV26719108 | rs10927035 | hCV26719114 | rs7549780 | 0.51 | 0.558010019 | 0.6768 |
| hCV26719108 | rs10927035 | hCV26719117 | rs12144559 | 0.51 | 0.558010019 | 0.6768 |
| hCV26719108 | rs10927035 | hCV26719171 | rs10927075 | 0.51 | 0.558010019 | 0.6861 |
| hCV26719108 | rs10927035 | hCV26719179 | rs6672195 | 0.51 | 0.558010019 | 0.6861 |
| hCV26719108 | rs10927035 | hCV26719194 | rs10927081 | 0.51 | 0.558010019 | 0.6861 |
| hCV26719108 | rs10927035 | hCV26719197 | rs4590656 | 0.51 | 0.558010019 | 0.6861 |
| hCV26719108 | rs10927035 | hCV26719215 | rs12144546 | 0.51 | 0.558010019 | 0.6768 |
| hCV26719108 | rs10927035 | hCV26719225 | rs11586029 | 0.51 | 0.558010019 | 0.6832 |
| hCV26719108 | rs10927035 | hCV29210367 | rs4518884 | 0.51 | 0.558010019 | 0.6861 |
| hCV26719108 | rs10927035 | hCV29633221 | rs10157763 | 0.51 | 0.558010019 | 0.6861 |
| hCV26719108 | rs10927035 | hCV29795761 | rs7528450 | 0.51 | 0.558010019 | 0.697 |
| hCV26719108 | rs10927035 | hCV30012351 | rs10158245 | 0.51 | 0.558010019 | 0.6929 |
| hCV26719108 | rs10927035 | hCV31523552 | rs12739344 | 0.51 | 0.558010019 | 0.7439 |
| hCV26719108 | rs10927035 | hCV31523555 | rs12749316 | 0.51 | 0.558010019 | 0.6452 |
| hCV26719108 | rs10927035 | hCV31523573 | rs11589907 | 0.51 | 0.558010019 | 0.6768 |
| hCV26719108 | rs10927035 | hCV31523576 | rs12691548 | 0.51 | 0.558010019 | 0.6458 |
| hCV26719108 | rs10927035 | hCV31523608 | rs12744297 | 0.51 | 0.558010019 | 0.7086 |
| hCV26719108 | rs10927035 | hCV31523624 | rs10927044 | 0.51 | 0.558010019 | 0.717 |
| hCV26719108 | rs10927035 | hCV31523725 | rs10927060 | 0.51 | 0.558010019 | 0.6861 |
| hCV26719108 | rs10927035 | hCV8688098 | rs1531244 | 0.51 | 0.558010019 | 0.6835 |
| hCV26719108 | rs10927035 | hCV8689016 | rs897959 | 0.51 | 0.558010019 | 0.6861 |
| hCV26719108 | rs10927035 | hCV9115290 | rs1352162 | 0.51 | 0.558010019 | 0.717 |
| hCV26719113 | rs7517340 | hCV15823024 | rs2125230 | 0.51 | 0.678279305 | 0.9318 |
| hCV26719113 | rs7517340 | hCV15885425 | rs2290754 | 0.51 | 0.678279305 | 0.9318 |
| hCV26719113 | rs7517340 | hCV15965338 | rs2291410 | 0.51 | 0.678279305 | 0.9318 |
| hCV26719113 | rs7517340 | hCV16082410 | rs2881275 | 0.51 | 0.678279305 | 0.9318 |
| hCV26719113 | rs7517340 | hCV1678656 | rs1458024 | 0.51 | 0.678279305 | 0.9318 |

TABLE 4-continued

| Interrogated SNP | Interrogated rs | LD SNP | LD SNP rs | Power | Threshold r² | r² |
|---|---|---|---|---|---|---|
| hCV26719113 | rs7517340 | hCV1678674 | rs1458023 | 0.51 | 0.678279305 | 0.721 |
| hCV26719113 | rs7517340 | hCV1678682 | rs320339 | 0.51 | 0.678279305 | 0.7898 |
| hCV26719113 | rs7517340 | hCV26719082 | rs10927046 | 0.51 | 0.678279305 | 0.7893 |
| hCV26719113 | rs7517340 | hCV26719085 | rs10927047 | 0.51 | 0.678279305 | 0.8571 |
| hCV26719113 | rs7517340 | hCV26719107 | rs7538011 | 0.51 | 0.678279305 | 0.7303 |
| hCV26719113 | rs7517340 | hCV26719116 | rs10927039 | 0.51 | 0.678279305 | 0.7983 |
| hCV26719113 | rs7517340 | hCV26719120 | rs10927040 | 0.51 | 0.678279305 | 0.9236 |
| hCV26719113 | rs7517340 | hCV26719121 | rs10927041 | 0.51 | 0.678279305 | 0.7465 |
| hCV26719113 | rs7517340 | hCV26719149 | rs6675851 | 0.51 | 0.678279305 | 0.9318 |
| hCV26719113 | rs7517340 | hCV26719162 | rs4132509 | 0.51 | 0.678279305 | 0.9318 |
| hCV26719113 | rs7517340 | hCV26719176 | rs10927076 | 0.51 | 0.678279305 | 1 |
| hCV26719113 | rs7517340 | hCV26719192 | rs10803161 | 0.51 | 0.678279305 | 0.9278 |
| hCV26719113 | rs7517340 | hCV26719201 | rs4478795 | 0.51 | 0.678279305 | 0.7268 |
| hCV26719113 | rs7517340 | hCV26719219 | rs9782958 | 0.51 | 0.678279305 | 0.9318 |
| hCV26719113 | rs7517340 | hCV26719222 | rs4553169 | 0.51 | 0.678279305 | 0.9314 |
| hCV26719113 | rs7517340 | hCV26719227 | rs10927065 | 0.51 | 0.678279305 | 0.721 |
| hCV26719113 | rs7517340 | hCV26719232 | rs10803158 | 0.51 | 0.678279305 | 0.9318 |
| hCV26719113 | rs7517340 | hCV26719233 | rs10927067 | 0.51 | 0.678279305 | 0.9318 |
| hCV26719113 | rs7517340 | hCV27498250 | rs3766673 | 0.51 | 0.678279305 | 0.8652 |
| hCV26719113 | rs7517340 | hCV29542869 | rs7534117 | 0.51 | 0.678279305 | 0.9318 |
| hCV26719113 | rs7517340 | hCV29560960 | rs7519673 | 0.51 | 0.678279305 | 0.721 |
| hCV26719113 | rs7517340 | hCV29741723 | rs7517921 | 0.51 | 0.678279305 | 0.7448 |
| hCV26719113 | rs7517340 | hCV29994467 | rs6694738 | 0.51 | 0.678279305 | 0.7303 |
| hCV26719113 | rs7517340 | hCV30084348 | rs9287269 | 0.51 | 0.678279305 | 0.9318 |
| hCV26719113 | rs7517340 | hCV30372886 | rs9782883 | 0.51 | 0.678279305 | 0.9318 |
| hCV26719113 | rs7517340 | hCV31523557 | rs10754807 | 0.51 | 0.678279305 | 0.9316 |
| hCV26719113 | rs7517340 | hCV31523563 | rs10927051 | 0.51 | 0.678279305 | 0.8299 |
| hCV26719113 | rs7517340 | hCV31523638 | rs12037013 | 0.51 | 0.678279305 | 0.7893 |
| hCV26719113 | rs7517340 | hCV31523639 | rs12034588 | 0.51 | 0.678279305 | 0.9278 |
| hCV26719113 | rs7517340 | hCV31523643 | rs6671475 | 0.51 | 0.678279305 | 0.8638 |
| hCV26719113 | rs7517340 | hCV31523650 | rs12048930 | 0.51 | 0.678279305 | 0.7467 |
| hCV26719113 | rs7517340 | hCV31523658 | rs12047209 | 0.51 | 0.678279305 | 0.721 |
| hCV26719113 | rs7517340 | hCV31523688 | rs12049228 | 0.51 | 0.678279305 | 0.928 |
| hCV26719113 | rs7517340 | hCV31523691 | rs12021907 | 0.51 | 0.678279305 | 0.721 |
| hCV26719113 | rs7517340 | hCV31523707 | rs10803152 | 0.51 | 0.678279305 | 0.7778 |
| hCV26719113 | rs7517340 | hCV31523710 | rs10927059 | 0.51 | 0.678279305 | 0.9318 |
| hCV26719113 | rs7517340 | hCV31523736 | rs12124113 | 0.51 | 0.678279305 | 0.7203 |
| hCV26719113 | rs7517340 | hCV31523740 | rs12032342 | 0.51 | 0.678279305 | 0.9318 |
| hCV26719113 | rs7517340 | hCV31523744 | rs12031994 | 0.51 | 0.678279305 | 0.721 |
| hCV26719113 | rs7517340 | hCV804126 | rs320320 | 0.51 | 0.678279305 | 0.9318 |
| hCV26719113 | rs7517340 | hDV71836703 | rs6429433 | 0.51 | 0.678279305 | 0.86 |
| hCV26719121 | rs10927041 | hCV15760229 | rs3006939 | 0.51 | 0.636443944 | 0.7427 |
| hCV26719121 | rs10927041 | hCV15760238 | rs3006936 | 0.51 | 0.636443944 | 0.7525 |
| hCV26719121 | rs10927041 | hCV15823024 | rs2125230 | 0.51 | 0.636443944 | 0.8181 |
| hCV26719121 | rs10927041 | hCV15885425 | rs2290754 | 0.51 | 0.636443944 | 0.8181 |
| hCV26719121 | rs10927041 | hCV15965338 | rs2291410 | 0.51 | 0.636443944 | 0.8181 |
| hCV26719121 | rs10927041 | hCV16082410 | rs2881275 | 0.51 | 0.636443944 | 0.8181 |
| hCV26719121 | rs10927041 | hCV1678656 | rs1458024 | 0.51 | 0.636443944 | 0.8181 |
| hCV26719121 | rs10927041 | hCV1678674 | rs1458023 | 0.51 | 0.636443944 | 0.6431 |
| hCV26719121 | rs10927041 | hCV1678682 | rs320339 | 0.51 | 0.636443944 | 0.7003 |
| hCV26719121 | rs10927041 | hCV26034158 | rs4515770 | 0.51 | 0.636443944 | 0.7555 |
| hCV26719121 | rs10927041 | hCV26719082 | rs10927046 | 0.51 | 0.636443944 | 0.6995 |
| hCV26719121 | rs10927041 | hCV26719085 | rs10927047 | 0.51 | 0.636443944 | 0.685 |
| hCV26719121 | rs10927041 | hCV26719107 | rs7538011 | 0.51 | 0.636443944 | 0.7586 |
| hCV26719121 | rs10927041 | hCV26719113 | rs7517340 | 0.51 | 0.636443944 | 0.7465 |
| hCV26719121 | rs10927041 | hCV26719116 | rs10927039 | 0.51 | 0.636443944 | 0.9349 |
| hCV26719121 | rs10927041 | hCV26719120 | rs10927040 | 0.51 | 0.636443944 | 0.8595 |
| hCV26719121 | rs10927041 | hCV26719149 | rs6675851 | 0.51 | 0.636443944 | 0.8181 |
| hCV26719121 | rs10927041 | hCV26719162 | rs4132509 | 0.51 | 0.636443944 | 0.8181 |
| hCV26719121 | rs10927041 | hCV26719176 | rs10927076 | 0.51 | 0.636443944 | 0.7883 |
| hCV26719121 | rs10927041 | hCV26719192 | rs10803161 | 0.51 | 0.636443944 | 0.8086 |
| hCV26719121 | rs10927041 | hCV26719219 | rs9782958 | 0.51 | 0.636443944 | 0.8181 |
| hCV26719121 | rs10927041 | hCV26719222 | rs4553169 | 0.51 | 0.636443944 | 0.817 |
| hCV26719121 | rs10927041 | hCV26719227 | rs10927065 | 0.51 | 0.636443944 | 0.6431 |
| hCV26719121 | rs10927041 | hCV26719232 | rs10803158 | 0.51 | 0.636443944 | 0.8181 |
| hCV26719121 | rs10927041 | hCV26719233 | rs10927067 | 0.51 | 0.636443944 | 0.8181 |
| hCV26719121 | rs10927041 | hCV27498250 | rs3766673 | 0.51 | 0.636443944 | 0.7692 |
| hCV26719121 | rs10927041 | hCV29210363 | rs6656918 | 0.51 | 0.636443944 | 0.7435 |
| hCV26719121 | rs10927041 | hCV29542869 | rs7534117 | 0.51 | 0.636443944 | 0.8181 |
| hCV26719121 | rs10927041 | hCV29560960 | rs7519673 | 0.51 | 0.636443944 | 0.6431 |
| hCV26719121 | rs10927041 | hCV29994467 | rs6694738 | 0.51 | 0.636443944 | 0.7586 |
| hCV26719121 | rs10927041 | hCV30084348 | rs9287269 | 0.51 | 0.636443944 | 0.8181 |
| hCV26719121 | rs10927041 | hCV30372886 | rs9782883 | 0.51 | 0.636443944 | 0.8181 |
| hCV26719121 | rs10927041 | hCV30690780 | rs10737888 | 0.51 | 0.636443944 | 0.7525 |
| hCV26719121 | rs10927041 | hCV31523557 | rs10754807 | 0.51 | 0.636443944 | 0.8175 |
| hCV26719121 | rs10927041 | hCV31523563 | rs10927051 | 0.51 | 0.636443944 | 0.8556 |
| hCV26719121 | rs10927041 | hCV31523638 | rs12037013 | 0.51 | 0.636443944 | 0.6995 |
| hCV26719121 | rs10927041 | hCV31523639 | rs12034588 | 0.51 | 0.636443944 | 0.8088 |

TABLE 4-continued

| Interrogated SNP | Interrogated rs | LD SNP | LD SNP rs | Power | Threshold r² | r² |
|---|---|---|---|---|---|---|
| hCV26719121 | rs10927041 | hCV31523643 | rs6671475 | 0.51 | 0.636443944 | 0.872 |
| hCV26719121 | rs10927041 | hCV31523650 | rs12048930 | 0.51 | 0.636443944 | 0.6588 |
| hCV26719121 | rs10927041 | hCV31523688 | rs12049228 | 0.51 | 0.636443944 | 0.8095 |
| hCV26719121 | rs10927041 | hCV31523691 | rs12021907 | 0.51 | 0.636443944 | 0.6431 |
| hCV26719121 | rs10927041 | hCV31523707 | rs10803152 | 0.51 | 0.636443944 | 0.6861 |
| hCV26719121 | rs10927041 | hCV31523710 | rs10927059 | 0.51 | 0.636443944 | 0.8181 |
| hCV26719121 | rs10927041 | hCV31523736 | rs12124113 | 0.51 | 0.636443944 | 0.6422 |
| hCV26719121 | rs10927041 | hCV31523740 | rs12032342 | 0.51 | 0.636443944 | 0.8181 |
| hCV26719121 | rs10927041 | hCV31523744 | rs12031994 | 0.51 | 0.636443944 | 0.6431 |
| hCV26719121 | rs10927041 | hCV804126 | rs320320 | 0.51 | 0.636443944 | 0.8181 |
| hCV26719121 | rs10927041 | hCV97631 | rs1538773 | 0.51 | 0.636443944 | 0.7525 |
| hCV26719121 | rs10927041 | hDV71836703 | rs6429433 | 0.51 | 0.636443944 | 0.6481 |
| hCV27020269 | rs7659613 | hCV15860433 | rs2070006 | 0.51 | 0.923124202 | 1 |
| hCV27020269 | rs7659613 | hCV2892870 | rs2070011 | 0.51 | 0.923124202 | 0.9647 |
| hCV27102953 | rs4648360 | hCV16000557 | rs2377041 | 0.51 | 0.602141599 | 0.8987 |
| hCV27102953 | rs4648360 | hCV1642008 | rs1563471 | 0.51 | 0.602141599 | 0.8842 |
| hCV27102953 | rs4648360 | hCV27102978 | rs7537581 | 0.51 | 0.602141599 | 0.9332 |
| hCV27102953 | rs4648360 | hCV27103080 | rs4648459 | 0.51 | 0.602141599 | 0.9004 |
| hCV27102953 | rs4648360 | hCV27103144 | rs11584658 | 0.51 | 0.602141599 | 0.9666 |
| hCV27102953 | rs4648360 | hCV27103182 | rs4609377 | 0.51 | 0.602141599 | 0.8748 |
| hCV27102953 | rs4648360 | hCV27103185 | rs10797389 | 0.51 | 0.602141599 | 0.9636 |
| hCV27102953 | rs4648360 | hCV27103186 | rs4648481 | 0.51 | 0.602141599 | 0.967 |
| hCV27102953 | rs4648360 | hCV27103188 | rs7511879 | 0.51 | 0.602141599 | 0.8714 |
| hCV27102953 | rs4648360 | hCV27103189 | rs12031493 | 0.51 | 0.602141599 | 0.8097 |
| hCV27102953 | rs4648360 | hCV27103192 | rs6680471 | 0.51 | 0.602141599 | 0.7499 |
| hCV27102953 | rs4648360 | hCV27103207 | rs6424062 | 0.51 | 0.602141599 | 0.9021 |
| hCV27102953 | rs4648360 | hCV31965210 | rs10909880 | 0.51 | 0.602141599 | 0.967 |
| hCV27102953 | rs4648360 | hCV31965333 | rs10797390 | 0.51 | 0.602141599 | 0.7827 |
| hCV27102953 | rs4648360 | hCV788647 | rs729045 | 0.51 | 0.602141599 | 0.6831 |
| hCV27102978 | rs7537581 | hCV11448257 | rs1886730 | 0.51 | 0.333611682 | 0.4384 |
| hCV27102978 | rs7537581 | hCV11612179 | rs10752748 | 0.51 | 0.333611682 | 0.4033 |
| hCV27102978 | rs7537581 | hCV15976797 | rs2843401 | 0.51 | 0.333611682 | 0.42 |
| hCV27102978 | rs7537581 | hCV15976807 | rs2843402 | 0.51 | 0.333611682 | 0.4103 |
| hCV27102978 | rs7537581 | hCV16000557 | rs2377041 | 0.51 | 0.333611682 | 0.8288 |
| hCV27102978 | rs7537581 | hCV16186317 | rs2764841 | 0.51 | 0.333611682 | 0.3895 |
| hCV27102978 | rs7537581 | hCV16186318 | rs2985859 | 0.51 | 0.333611682 | 0.413 |
| hCV27102978 | rs7537581 | hCV1642008 | rs1563471 | 0.51 | 0.333611682 | 0.8774 |
| hCV27102978 | rs7537581 | hCV1974927 | rs3748816 | 0.51 | 0.333611682 | 0.386 |
| hCV27102978 | rs7537581 | hCV1974928 | rs3748819 | 0.51 | 0.333611682 | 0.42 |
| hCV27102978 | rs7537581 | hCV1974930 | rs10752747 | 0.51 | 0.333611682 | 0.42 |
| hCV27102978 | rs7537581 | hCV1974933 | rs734999 | 0.51 | 0.333611682 | 0.4443 |
| hCV27102978 | rs7537581 | hCV1974936 | rs4648648 | 0.51 | 0.333611682 | 0.3435 |
| hCV27102978 | rs7537581 | hCV1974940 | rs4310388 | 0.51 | 0.333611682 | 0.3553 |
| hCV27102978 | rs7537581 | hCV1974942 | rs6671426 | 0.51 | 0.333611682 | 0.44 |
| hCV27102978 | rs7537581 | hCV1974943 | rs6672381 | 0.51 | 0.333611682 | 0.4185 |
| hCV27102978 | rs7537581 | hCV1974944 | rs6667605 | 0.51 | 0.333611682 | 0.4135 |
| hCV27102978 | rs7537581 | hCV1974949 | rs2257763 | 0.51 | 0.333611682 | 0.4443 |
| hCV27102978 | rs7537581 | hCV1974950 | rs2281852 | 0.51 | 0.333611682 | 0.4149 |
| hCV27102978 | rs7537581 | hCV1974951 | rs2234161 | 0.51 | 0.333611682 | 0.44 |
| hCV27102978 | rs7537581 | hCV1974957 | rs7550231 | 0.51 | 0.333611682 | 0.3936 |
| hCV27102978 | rs7537581 | hCV1974967 | rs2147905 | 0.51 | 0.333611682 | 0.4342 |
| hCV27102978 | rs7537581 | hCV25602566 | rs3748817 | 0.51 | 0.333611682 | 0.4034 |
| hCV27102978 | rs7537581 | hCV25981574 | rs7535528 | 0.51 | 0.333611682 | 0.3816 |
| hCV27102978 | rs7537581 | hCV26678889 | rs3890745 | 0.51 | 0.333611682 | 0.3962 |
| hCV27102978 | rs7537581 | hCV27102953 | rs4648360 | 0.51 | 0.333611682 | 0.9332 |
| hCV27102978 | rs7537581 | hCV27103080 | rs4648459 | 0.51 | 0.333611682 | 0.8317 |
| hCV27102978 | rs7537581 | hCV27103144 | rs11584658 | 0.51 | 0.333611682 | 0.8974 |
| hCV27102978 | rs7537581 | hCV27103182 | rs4609377 | 0.51 | 0.333611682 | 0.8676 |
| hCV27102978 | rs7537581 | hCV27103185 | rs10797389 | 0.51 | 0.333611682 | 0.8871 |
| hCV27102978 | rs7537581 | hCV27103186 | rs4648481 | 0.51 | 0.333611682 | 0.8992 |
| hCV27102978 | rs7537581 | hCV27103187 | rs4648482 | 0.51 | 0.333611682 | 0.4675 |
| hCV27102978 | rs7537581 | hCV27103188 | rs7511879 | 0.51 | 0.333611682 | 0.8664 |
| hCV27102978 | rs7537581 | hCV27103189 | rs12031493 | 0.51 | 0.333611682 | 0.7384 |
| hCV27102978 | rs7537581 | hCV27103192 | rs6680471 | 0.51 | 0.333611682 | 0.7416 |
| hCV27102978 | rs7537581 | hCV27103201 | rs12049543 | 0.51 | 0.333611682 | 0.3576 |
| hCV27102978 | rs7537581 | hCV27103202 | rs6424081 | 0.51 | 0.333611682 | 0.3576 |
| hCV27102978 | rs7537581 | hCV27103207 | rs6424062 | 0.51 | 0.333611682 | 0.8345 |
| hCV27102978 | rs7537581 | hCV27103209 | rs7529000 | 0.51 | 0.333611682 | 0.3816 |
| hCV27102978 | rs7537581 | hCV27972176 | rs4648356 | 0.51 | 0.333611682 | 0.3962 |
| hCV27102978 | rs7537581 | hCV28001111 | rs4648384 | 0.51 | 0.333611682 | 0.3739 |
| hCV27102978 | rs7537581 | hCV29511345 | rs7548023 | 0.51 | 0.333611682 | 0.3739 |
| hCV27102978 | rs7537581 | hCV30497685 | rs6684865 | 0.51 | 0.333611682 | 0.4033 |
| hCV27102978 | rs7537581 | hCV31475405 | rs10797441 | 0.51 | 0.333611682 | 0.4033 |
| hCV27102978 | rs7537581 | hCV31475409 | rs10910111 | 0.51 | 0.333611682 | 0.407 |
| hCV27102978 | rs7537581 | hCV31475429 | rs10910099 | 0.51 | 0.333611682 | 0.42 |
| hCV27102978 | rs7537581 | hCV31475436 | rs4486391 | 0.51 | 0.333611682 | 0.4262 |
| hCV27102978 | rs7537581 | hCV31475439 | rs10797434 | 0.51 | 0.333611682 | 0.4006 |
| hCV27102978 | rs7537581 | hCV31965210 | rs10909880 | 0.51 | 0.333611682 | 0.8992 |

TABLE 4-continued

| Interrogated SNP | Interrogated rs | LD SNP | LD SNP rs | Power | Threshold r² | r² |
|---|---|---|---|---|---|---|
| hCV27102978 | rs7537581 | hCV31965333 | rs10797390 | 0.51 | 0.333611682 | 0.7038 |
| hCV27102978 | rs7537581 | hCV31965380 | rs12409348 | 0.51 | 0.333611682 | 0.3859 |
| hCV27102978 | rs7537581 | hCV403768 | rs10797440 | 0.51 | 0.333611682 | 0.3723 |
| hCV27102978 | rs7537581 | hCV403772 | rs10797437 | 0.51 | 0.333611682 | 0.3692 |
| hCV27102978 | rs7537581 | hCV441460 | rs4474198 | 0.51 | 0.333611682 | 0.4033 |
| hCV27102978 | rs7537581 | hCV788647 | rs729045 | 0.51 | 0.333611682 | 0.6657 |
| hCV27102978 | rs7537581 | hCV8725809 | rs897628 | 0.51 | 0.333611682 | 0.4133 |
| hCV27102978 | rs7537581 | hCV8725828 | rs1456461 | 0.51 | 0.333611682 | 0.4358 |
| hCV27102978 | rs7537581 | hCV8725829 | rs1456460 | 0.51 | 0.333611682 | 0.36 |
| hCV27102978 | rs7537581 | hCV9688194 | rs6673993 | 0.51 | 0.333611682 | 0.3692 |
| hCV27102978 | rs7537581 | hDV68598166 | rs10797432 | 0.51 | 0.333611682 | 0.44 |
| hCV27102978 | rs7537581 | hDV76957636 | rs4073286 | 0.51 | 0.333611682 | 0.3692 |
| hCV27103080 | rs4648459 | hCV16000557 | rs2377041 | 0.51 | 0.540557472 | 1 |
| hCV27103080 | rs4648459 | hCV1642008 | rs1563471 | 0.51 | 0.540557472 | 0.8395 |
| hCV27103080 | rs4648459 | hCV27102953 | rs4648360 | 0.51 | 0.540557472 | 0.9004 |
| hCV27103080 | rs4648459 | hCV27102978 | rs7537581 | 0.51 | 0.540557472 | 0.8317 |
| hCV27103080 | rs4648459 | hCV27103144 | rs11584658 | 0.51 | 0.540557472 | 0.8659 |
| hCV27103080 | rs4648459 | hCV27103182 | rs4609377 | 0.51 | 0.540557472 | 0.7778 |
| hCV27103080 | rs4648459 | hCV27103185 | rs10797389 | 0.51 | 0.540557472 | 0.8532 |
| hCV27103080 | rs4648459 | hCV27103186 | rs4648481 | 0.51 | 0.540557472 | 0.8681 |
| hCV27103080 | rs4648459 | hCV27103188 | rs7511879 | 0.51 | 0.540557472 | 0.7756 |
| hCV27103080 | rs4648459 | hCV27103189 | rs12031493 | 0.51 | 0.540557472 | 0.7422 |
| hCV27103080 | rs4648459 | hCV27103192 | rs6680471 | 0.51 | 0.540557472 | 0.6587 |
| hCV27103080 | rs4648459 | hCV27103207 | rs6424062 | 0.51 | 0.540557472 | 1 |
| hCV27103080 | rs4648459 | hCV31965210 | rs10909880 | 0.51 | 0.540557472 | 0.8681 |
| hCV27103080 | rs4648459 | hCV31965333 | rs10797390 | 0.51 | 0.540557472 | 0.7405 |
| hCV27103080 | rs4648459 | hCV788647 | rs729045 | 0.51 | 0.540557472 | 0.5916 |
| hCV27103080 | rs4648459 | hCV8725828 | rs1456461 | 0.51 | 0.540557472 | 0.5874 |
| hCV27103182 | rs4609377 | hCV11448257 | rs1886730 | 0.51 | 0.384835006 | 0.5438 |
| hCV27103182 | rs4609377 | hCV15976797 | rs2843401 | 0.51 | 0.384835006 | 0.3989 |
| hCV27103182 | rs4609377 | hCV15976807 | rs2843402 | 0.51 | 0.384835006 | 0.3863 |
| hCV27103182 | rs4609377 | hCV16000557 | rs2377041 | 0.51 | 0.384835006 | 0.7742 |
| hCV27103182 | rs4609377 | hCV16186318 | rs2985859 | 0.51 | 0.384835006 | 0.3915 |
| hCV27103182 | rs4609377 | hCV1642008 | rs1563471 | 0.51 | 0.384835006 | 0.8794 |
| hCV27103182 | rs4609377 | hCV1974928 | rs3748819 | 0.51 | 0.384835006 | 0.3989 |
| hCV27103182 | rs4609377 | hCV1974930 | rs10752747 | 0.51 | 0.384835006 | 0.3989 |
| hCV27103182 | rs4609377 | hCV1974933 | rs734999 | 0.51 | 0.384835006 | 0.5303 |
| hCV27103182 | rs4609377 | hCV1974936 | rs4648648 | 0.51 | 0.384835006 | 0.4201 |
| hCV27103182 | rs4609377 | hCV1974940 | rs4310388 | 0.51 | 0.384835006 | 0.3854 |
| hCV27103182 | rs4609377 | hCV1974942 | rs6671426 | 0.51 | 0.384835006 | 0.5447 |
| hCV27103182 | rs4609377 | hCV1974943 | rs6672381 | 0.51 | 0.384835006 | 0.5265 |
| hCV27103182 | rs4609377 | hCV1974944 | rs6667605 | 0.51 | 0.384835006 | 0.517 |
| hCV27103182 | rs4609377 | hCV1974949 | rs2257763 | 0.51 | 0.384835006 | 0.5303 |
| hCV27103182 | rs4609377 | hCV1974950 | rs2281852 | 0.51 | 0.384835006 | 0.5413 |
| hCV27103182 | rs4609377 | hCV1974951 | rs2234161 | 0.51 | 0.384835006 | 0.5447 |
| hCV27103182 | rs4609377 | hCV1974957 | rs7550231 | 0.51 | 0.384835006 | 0.4949 |
| hCV27103182 | rs4609377 | hCV1974967 | rs2147905 | 0.51 | 0.384835006 | 0.4889 |
| hCV27103182 | rs4609377 | hCV27102953 | rs4648360 | 0.51 | 0.384835006 | 0.8748 |
| hCV27103182 | rs4609377 | hCV27102978 | rs7537581 | 0.51 | 0.384835006 | 0.8676 |
| hCV27103182 | rs4609377 | hCV27103080 | rs4648459 | 0.51 | 0.384835006 | 0.7778 |
| hCV27103182 | rs4609377 | hCV27103144 | rs11584658 | 0.51 | 0.384835006 | 0.9032 |
| hCV27103182 | rs4609377 | hCV27103185 | rs10797389 | 0.51 | 0.384835006 | 0.8944 |
| hCV27103182 | rs4609377 | hCV27103186 | rs4648481 | 0.51 | 0.384835006 | 0.9047 |
| hCV27103182 | rs4609377 | hCV27103187 | rs4648482 | 0.51 | 0.384835006 | 0.4791 |
| hCV27103182 | rs4609377 | hCV27103188 | rs7511879 | 0.51 | 0.384835006 | 0.8718 |
| hCV27103182 | rs4609377 | hCV27103189 | rs12031493 | 0.51 | 0.384835006 | 0.7457 |
| hCV27103182 | rs4609377 | hCV27103192 | rs6680471 | 0.51 | 0.384835006 | 0.7506 |
| hCV27103182 | rs4609377 | hCV27103207 | rs6424062 | 0.51 | 0.384835006 | 0.7813 |
| hCV27103182 | rs4609377 | hCV27103209 | rs7529000 | 0.51 | 0.384835006 | 0.4041 |
| hCV27103182 | rs4609377 | hCV28001111 | rs4648384 | 0.51 | 0.384835006 | 0.3889 |
| hCV27103182 | rs4609377 | hCV29511345 | rs7548023 | 0.51 | 0.384835006 | 0.3889 |
| hCV27103182 | rs4609377 | hCV30497685 | rs6684865 | 0.51 | 0.384835006 | 0.3915 |
| hCV27103182 | rs4609377 | hCV31475409 | rs10910111 | 0.51 | 0.384835006 | 0.3884 |
| hCV27103182 | rs4609377 | hCV31475429 | rs10910099 | 0.51 | 0.384835006 | 0.3989 |
| hCV27103182 | rs4609377 | hCV31475436 | rs4486391 | 0.51 | 0.384835006 | 0.533 |
| hCV27103182 | rs4609377 | hCV31475439 | rs10797434 | 0.51 | 0.384835006 | 0.5069 |
| hCV27103182 | rs4609377 | hCV31965210 | rs10909880 | 0.51 | 0.384835006 | 0.9047 |
| hCV27103182 | rs4609377 | hCV31965333 | rs10797390 | 0.51 | 0.384835006 | 0.7768 |
| hCV27103182 | rs4609377 | hCV31965380 | rs12409348 | 0.51 | 0.384835006 | 0.4098 |
| hCV27103182 | rs4609377 | hCV788647 | rs729045 | 0.51 | 0.384835006 | 0.7268 |
| hCV27103182 | rs4609377 | hCV8725809 | rs897628 | 0.51 | 0.384835006 | 0.3908 |
| hCV27103182 | rs4609377 | hCV8725828 | rs1456461 | 0.51 | 0.384835006 | 0.4541 |
| hCV27103182 | rs4609377 | hDV68598166 | rs10797432 | 0.51 | 0.384835006 | 0.5447 |
| hCV27103188 | rs7511879 | hCV16000557 | rs2377041 | 0.51 | 0.52983896 | 0.7719 |
| hCV27103188 | rs7511879 | hCV1642008 | rs1563471 | 0.51 | 0.52983896 | 0.9211 |
| hCV27103188 | rs7511879 | hCV27102953 | rs4648360 | 0.51 | 0.52983896 | 0.8714 |
| hCV27103188 | rs7511879 | hCV27102978 | rs7537581 | 0.51 | 0.52983896 | 0.8664 |
| hCV27103188 | rs7511879 | hCV27103080 | rs4648459 | 0.51 | 0.52983896 | 0.7756 |

TABLE 4-continued

| Interrogated SNP | Interrogated rs | LD SNP | LD SNP rs | Power | Threshold r² | r² |
|---|---|---|---|---|---|---|
| hCV27103188 | rs7511879 | hCV27103144 | rs11584658 | 0.51 | 0.52983896 | 0.9007 |
| hCV27103188 | rs7511879 | hCV27103182 | rs4609377 | 0.51 | 0.52983896 | 0.8718 |
| hCV27103188 | rs7511879 | hCV27103185 | rs10797389 | 0.51 | 0.52983896 | 0.9269 |
| hCV27103188 | rs7511879 | hCV27103186 | rs4648481 | 0.51 | 0.52983896 | 0.9023 |
| hCV27103188 | rs7511879 | hCV27103189 | rs12031493 | 0.51 | 0.52983896 | 0.807 |
| hCV27103188 | rs7511879 | hCV27103192 | rs6680471 | 0.51 | 0.52983896 | 0.809 |
| hCV27103188 | rs7511879 | hCV27103207 | rs6424062 | 0.51 | 0.52983896 | 0.7791 |
| hCV27103188 | rs7511879 | hCV31965210 | rs10909880 | 0.51 | 0.52983896 | 0.9023 |
| hCV27103188 | rs7511879 | hCV31965333 | rs10797390 | 0.51 | 0.52983896 | 0.7786 |
| hCV27103188 | rs7511879 | hCV788647 | rs729045 | 0.51 | 0.52983896 | 0.7328 |
| hCV27103189 | rs12031493 | hCV16000557 | rs2377041 | 0.51 | 0.635618245 | 0.738 |
| hCV27103189 | rs12031493 | hCV1642008 | rs1563471 | 0.51 | 0.635618245 | 0.8028 |
| hCV27103189 | rs12031493 | hCV27102953 | rs4648360 | 0.51 | 0.635618245 | 0.8097 |
| hCV27103189 | rs12031493 | hCV27102978 | rs7537581 | 0.51 | 0.635618245 | 0.7384 |
| hCV27103189 | rs12031493 | hCV27103080 | rs4648459 | 0.51 | 0.635618245 | 0.7422 |
| hCV27103189 | rs12031493 | hCV27103144 | rs11584658 | 0.51 | 0.635618245 | 0.8365 |
| hCV27103189 | rs12031493 | hCV27103182 | rs4609377 | 0.51 | 0.635618245 | 0.7457 |
| hCV27103189 | rs12031493 | hCV27103185 | rs10797389 | 0.51 | 0.635618245 | 0.855 |
| hCV27103189 | rs12031493 | hCV27103186 | rs4648481 | 0.51 | 0.635618245 | 0.8391 |
| hCV27103189 | rs12031493 | hCV27103188 | rs7511879 | 0.51 | 0.635618245 | 0.807 |
| hCV27103189 | rs12031493 | hCV27103192 | rs6680471 | 0.51 | 0.635618245 | 0.8695 |
| hCV27103189 | rs12031493 | hCV27103207 | rs6424062 | 0.51 | 0.635618245 | 0.7463 |
| hCV27103189 | rs12031493 | hCV31965210 | rs10909880 | 0.51 | 0.635618245 | 0.8391 |
| hCV27103189 | rs12031493 | hCV31965333 | rs10797390 | 0.51 | 0.635618245 | 0.8473 |
| hCV27103189 | rs12031493 | hCV788647 | rs729045 | 0.51 | 0.635618245 | 0.7823 |
| hCV27103207 | rs6424062 | hCV16000557 | rs2377041 | 0.51 | 0.53997951 | 1 |
| hCV27103207 | rs6424062 | hCV1642008 | rs1563471 | 0.51 | 0.53997951 | 0.8426 |
| hCV27103207 | rs6424062 | hCV27102953 | rs4648360 | 0.51 | 0.53997951 | 0.9021 |
| hCV27103207 | rs6424062 | hCV27102978 | rs7537581 | 0.51 | 0.53997951 | 0.8345 |
| hCV27103207 | rs6424062 | hCV27103080 | rs4648459 | 0.51 | 0.53997951 | 1 |
| hCV27103207 | rs6424062 | hCV27103144 | rs11584658 | 0.51 | 0.53997951 | 0.8681 |
| hCV27103207 | rs6424062 | hCV27103182 | rs4609377 | 0.51 | 0.53997951 | 0.7813 |
| hCV27103207 | rs6424062 | hCV27103185 | rs10797389 | 0.51 | 0.53997951 | 0.8559 |
| hCV27103207 | rs6424062 | hCV27103186 | rs4648481 | 0.51 | 0.53997951 | 0.8703 |
| hCV27103207 | rs6424062 | hCV27103188 | rs7511879 | 0.51 | 0.53997951 | 0.7791 |
| hCV27103207 | rs6424062 | hCV27103189 | rs12031493 | 0.51 | 0.53997951 | 0.7463 |
| hCV27103207 | rs6424062 | hCV27103192 | rs6680471 | 0.51 | 0.53997951 | 0.6639 |
| hCV27103207 | rs6424062 | hCV31965210 | rs10909880 | 0.51 | 0.53997951 | 0.8703 |
| hCV27103207 | rs6424062 | hCV31965333 | rs10797390 | 0.51 | 0.53997951 | 0.7449 |
| hCV27103207 | rs6424062 | hCV788647 | rs729045 | 0.51 | 0.53997951 | 0.5975 |
| hCV27103207 | rs6424062 | hCV8725828 | rs1456461 | 0.51 | 0.53997951 | 0.5653 |
| hCV2744023 | rs369328 | hCV11420034 | rs9351219 | 0.51 | 0.447364409 | 0.4799 |
| hCV2744023 | rs369328 | hCV11569192 | rs2585018 | 0.51 | 0.447364409 | 1 |
| hCV2744023 | rs369328 | hCV11569204 | rs9344968 | 0.51 | 0.447364409 | 0.4599 |
| hCV2744023 | rs369328 | hCV15840762 | rs2180140 | 0.51 | 0.447364409 | 0.4889 |
| hCV2744023 | rs369328 | hCV2012677 | rs1470263 | 0.51 | 0.447364409 | 0.4746 |
| hCV2744023 | rs369328 | hCV2012681 | rs6918308 | 0.51 | 0.447364409 | 0.8995 |
| hCV2744023 | rs369328 | hCV2012686 | rs9362676 | 0.51 | 0.447364409 | 0.4746 |
| hCV2744023 | rs369328 | hCV2012692 | rs4707565 | 0.51 | 0.447364409 | 0.4741 |
| hCV2744023 | rs369328 | hCV2012696 | rs41426481 | 0.51 | 0.447364409 | 0.4746 |
| hCV2744023 | rs369328 | hCV26081278 | rs2585008 | 0.51 | 0.447364409 | 1 |
| hCV2744023 | rs369328 | hCV27392140 | rs12661693 | 0.51 | 0.447364409 | 1 |
| hCV2744023 | rs369328 | hCV28980044 | rs6923604 | 0.51 | 0.447364409 | 0.8995 |
| hCV2744023 | rs369328 | hCV2950250 | rs292259 | 0.51 | 0.447364409 | 0.5535 |
| hCV2744023 | rs369328 | hCV2956500 | rs11755610 | 0.51 | 0.447364409 | 0.493 |
| hCV2744023 | rs369328 | hCV29986476 | rs9451269 | 0.51 | 0.447364409 | 0.8669 |
| hCV2744023 | rs369328 | hCV30238224 | rs6910277 | 0.51 | 0.447364409 | 0.8959 |
| hCV2744023 | rs369328 | hCV30454683 | rs9351210 | 0.51 | 0.447364409 | 0.4746 |
| hCV2744023 | rs369328 | hCV30562928 | rs9342209 | 0.51 | 0.447364409 | 0.4746 |
| hCV2744023 | rs369328 | hCV30580828 | rs9344964 | 0.51 | 0.447364409 | 0.4792 |
| hCV2744023 | rs369328 | hCV30749435 | rs7762262 | 0.51 | 0.447364409 | 0.4643 |
| hCV2744023 | rs369328 | hCV30749473 | rs12661230 | 0.51 | 0.447364409 | 0.4599 |
| hCV2744023 | rs369328 | hCV3180831 | rs456671 | 0.51 | 0.447364409 | 0.5535 |
| hCV2744023 | rs369328 | hCV3180835 | rs292222 | 0.51 | 0.447364409 | 1 |
| hCV2744023 | rs369328 | hCV996140 | rs457665 | 0.51 | 0.447364409 | 0.57 |
| hCV2744023 | rs369328 | hCV996141 | rs409320 | 0.51 | 0.447364409 | 1 |
| hCV27474895 | rs3756011 | hCV32291269 | rs4253417 | 0.51 | 0.912197135 | 0.9319 |
| hCV27474895 | rs3756011 | hCV3230038 | rs2289252 | 0.51 | 0.912197135 | 1 |
| hCV27477533 | rs3756008 | hCV3230025 | rs3756009 | 0.51 | 0.89567049 | 1 |
| hCV27477533 | rs3756008 | hCV8241630 | rs925451 | 0.51 | 0.89567049 | 0.9185 |
| hCV2852784 | rs743572 | hCV11201601 | rs3781287 | 0.51 | 0.919963603 | 0.931 |
| hCV2852784 | rs743572 | hCV12119916 | rs6163 | 0.51 | 0.919963603 | 1 |
| hCV2852784 | rs743572 | hCV12119917 | rs6162 | 0.51 | 0.919963603 | 0.931 |
| hCV2852784 | rs743572 | hCV25761532 | rs3740397 | 0.51 | 0.919963603 | 1 |
| hCV2852784 | rs743572 | hCV27433651 | rs10883785 | 0.51 | 0.919963603 | 1 |
| hCV2852784 | rs743572 | hCV31979198 | rs4290163 | 0.51 | 0.919963603 | 0.931 |
| hCV2852784 | rs743572 | hCV31979199 | rs7096475 | 0.51 | 0.919963603 | 0.931 |
| hCV2852784 | rs743572 | hCV3284571 | rs7097872 | 0.51 | 0.919963603 | 0.9301 |

TABLE 4-continued

| Interrogated SNP | Interrogated rs | LD SNP | LD SNP rs | Power | Threshold r² | r² |
|---|---|---|---|---|---|---|
| hCV2852784 | rs743572 | hCV3284577 | rs10786712 | 0.51 | 0.919963603 | 1 |
| hCV2892855 | rs6536024 | hCV2892858 | rs12648395 | 0.51 | 0.436203746 | 0.5717 |
| hCV2892855 | rs6536024 | hCV2892863 | rs1049636 | 0.51 | 0.436203746 | 0.5596 |
| hCV2892855 | rs6536024 | hCV2892923 | rs13435192 | 0.51 | 0.436203746 | 0.5707 |
| hCV2892855 | rs6536024 | hCV2892924 | rs13435101 | 0.51 | 0.436203746 | 0.5658 |
| hCV2892855 | rs6536024 | hCV2892925 | rs7689945 | 0.51 | 0.436203746 | 0.5091 |
| hCV2892855 | rs6536024 | hCV2892927 | rs13123551 | 0.51 | 0.436203746 | 0.5235 |
| hCV2892855 | rs6536024 | hCV7429782 | rs1118823 | 0.51 | 0.436203746 | 0.5717 |
| hCV2892869 | rs13109457 | hCV11503414 | rs2066865 | 0.51 | 0.696732032 | 0.9571 |
| hCV2892869 | rs13109457 | hCV11503416 | rs2066864 | 0.51 | 0.696732032 | 0.9571 |
| hCV2892869 | rs13109457 | hCV11503431 | rs2066861 | 0.51 | 0.696732032 | 0.9571 |
| hCV2892869 | rs13109457 | hCV11853483 | rs12644950 | 0.51 | 0.696732032 | 0.9537 |
| hCV2892869 | rs13109457 | hCV11853489 | rs7681423 | 0.51 | 0.696732032 | 0.9571 |
| hCV2892869 | rs13109457 | hCV11853496 | rs7654093 | 0.51 | 0.696732032 | 0.9568 |
| hCV2892869 | rs13109457 | hCV27020277 | rs6825454 | 0.51 | 0.696732032 | 0.9556 |
| hCV2892869 | rs13109457 | hCV2892859 | rs13130318 | 0.51 | 0.696732032 | 0.869 |
| hCV2892869 | rs13109457 | hCV2892877 | rs6050 | 0.51 | 0.696732032 | 0.9571 |
| hCV2892869 | rs13109457 | hCV31863982 | rs7659024 | 0.51 | 0.696732032 | 0.9571 |
| hCV2892927 | rs13123551 | hCV2892923 | rs13435192 | 0.51 | 0.957904963 | 1 |
| hCV2892927 | rs13123551 | hCV2892925 | rs7689945 | 0.51 | 0.957904963 | 1 |
| hCV29210363 | rs6656918 | hCV12073840 | rs14403 | 0.51 | 0.470215497 | 0.5134 |
| hCV29210363 | rs6656918 | hCV15760229 | rs3006939 | 0.51 | 0.470215497 | 1 |
| hCV29210363 | rs6656918 | hCV15760238 | rs3006936 | 0.51 | 0.470215497 | 1 |
| hCV29210363 | rs6656918 | hCV15823024 | rs2125230 | 0.51 | 0.470215497 | 0.6952 |
| hCV29210363 | rs6656918 | hCV15885425 | rs2290754 | 0.51 | 0.470215497 | 0.6952 |
| hCV29210363 | rs6656918 | hCV15965338 | rs2291410 | 0.51 | 0.470215497 | 0.6952 |
| hCV29210363 | rs6656918 | hCV16082410 | rs2881275 | 0.51 | 0.470215497 | 0.6952 |
| hCV29210363 | rs6656918 | hCV1678656 | rs1458024 | 0.51 | 0.470215497 | 0.6952 |
| hCV29210363 | rs6656918 | hCV1678674 | rs1458023 | 0.51 | 0.470215497 | 0.556 |
| hCV29210363 | rs6656918 | hCV1678682 | rs320339 | 0.51 | 0.470215497 | 0.6015 |
| hCV29210363 | rs6656918 | hCV233148 | rs1417121 | 0.51 | 0.470215497 | 0.656 |
| hCV29210363 | rs6656918 | hCV26034158 | rs4515770 | 0.51 | 0.470215497 | 1 |
| hCV29210363 | rs6656918 | hCV26034160 | rs2994327 | 0.51 | 0.470215497 | 0.4867 |
| hCV29210363 | rs6656918 | hCV26719082 | rs10927046 | 0.51 | 0.470215497 | 0.6005 |
| hCV29210363 | rs6656918 | hCV26719085 | rs10927047 | 0.51 | 0.470215497 | 0.5855 |
| hCV29210363 | rs6656918 | hCV26719107 | rs7538011 | 0.51 | 0.470215497 | 0.6479 |
| hCV29210363 | rs6656918 | hCV26719113 | rs7517340 | 0.51 | 0.470215497 | 0.6336 |
| hCV29210363 | rs6656918 | hCV26719116 | rs10927039 | 0.51 | 0.470215497 | 0.7848 |
| hCV29210363 | rs6656918 | hCV26719120 | rs10927040 | 0.51 | 0.470215497 | 0.7569 |
| hCV29210363 | rs6656918 | hCV26719121 | rs10927041 | 0.51 | 0.470215497 | 0.7435 |
| hCV29210363 | rs6656918 | hCV26719149 | rs6675851 | 0.51 | 0.470215497 | 0.6952 |
| hCV29210363 | rs6656918 | hCV26719162 | rs4132509 | 0.51 | 0.470215497 | 0.6952 |
| hCV29210363 | rs6656918 | hCV26719176 | rs10927076 | 0.51 | 0.470215497 | 0.6562 |
| hCV29210363 | rs6656918 | hCV26719192 | rs10803161 | 0.51 | 0.470215497 | 0.723 |
| hCV29210363 | rs6656918 | hCV26719219 | rs9782958 | 0.51 | 0.470215497 | 0.6952 |
| hCV29210363 | rs6656918 | hCV26719222 | rs4553169 | 0.51 | 0.470215497 | 0.6934 |
| hCV29210363 | rs6656918 | hCV26719227 | rs10927065 | 0.51 | 0.470215497 | 0.556 |
| hCV29210363 | rs6656918 | hCV26719232 | rs10803158 | 0.51 | 0.470215497 | 0.6952 |
| hCV29210363 | rs6656918 | hCV26719233 | rs10927067 | 0.51 | 0.470215497 | 0.6952 |
| hCV29210363 | rs6656918 | hCV27498250 | rs3766673 | 0.51 | 0.470215497 | 0.5812 |
| hCV29210363 | rs6656918 | hCV29542869 | rs7534117 | 0.51 | 0.470215497 | 0.6952 |
| hCV29210363 | rs6656918 | hCV29560960 | rs7519673 | 0.51 | 0.470215497 | 0.556 |
| hCV29210363 | rs6656918 | hCV29741723 | rs7517921 | 0.51 | 0.470215497 | 0.6407 |
| hCV29210363 | rs6656918 | hCV29994467 | rs6694738 | 0.51 | 0.470215497 | 0.6479 |
| hCV29210363 | rs6656918 | hCV30084348 | rs9287269 | 0.51 | 0.470215497 | 0.6952 |
| hCV29210363 | rs6656918 | hCV30372886 | rs9782883 | 0.51 | 0.470215497 | 0.6952 |
| hCV29210363 | rs6656918 | hCV30690778 | rs12140414 | 0.51 | 0.470215497 | 0.8942 |
| hCV29210363 | rs6656918 | hCV30690780 | rs10737888 | 0.51 | 0.470215497 | 1 |
| hCV29210363 | rs6656918 | hCV30690784 | rs4658574 | 0.51 | 0.470215497 | 0.4867 |
| hCV29210363 | rs6656918 | hCV31523557 | rs10754807 | 0.51 | 0.470215497 | 0.6943 |
| hCV29210363 | rs6656918 | hCV31523563 | rs10927051 | 0.51 | 0.470215497 | 0.6381 |
| hCV29210363 | rs6656918 | hCV31523638 | rs12037013 | 0.51 | 0.470215497 | 0.6005 |
| hCV29210363 | rs6656918 | hCV31523639 | rs12034588 | 0.51 | 0.470215497 | 0.6943 |
| hCV29210363 | rs6656918 | hCV31523643 | rs6671475 | 0.51 | 0.470215497 | 0.7754 |
| hCV29210363 | rs6656918 | hCV31523650 | rs12048930 | 0.51 | 0.470215497 | 0.6433 |
| hCV29210363 | rs6656918 | hCV31523658 | rs12047209 | 0.51 | 0.470215497 | 0.5048 |
| hCV29210363 | rs6656918 | hCV31523688 | rs12049228 | 0.51 | 0.470215497 | 0.6836 |
| hCV29210363 | rs6656918 | hCV31523691 | rs12021907 | 0.51 | 0.470215497 | 0.556 |
| hCV29210363 | rs6656918 | hCV31523707 | rs10803152 | 0.51 | 0.470215497 | 0.5865 |
| hCV29210363 | rs6656918 | hCV31523710 | rs10927059 | 0.51 | 0.470215497 | 0.6952 |
| hCV29210363 | rs6656918 | hCV31523723 | rs12140040 | 0.51 | 0.470215497 | 0.5114 |
| hCV29210363 | rs6656918 | hCV31523736 | rs12124113 | 0.51 | 0.470215497 | 0.555 |
| hCV29210363 | rs6656918 | hCV31523740 | rs12032342 | 0.51 | 0.470215497 | 0.6952 |
| hCV29210363 | rs6656918 | hCV31523744 | rs12031994 | 0.51 | 0.470215497 | 0.556 |
| hCV29210363 | rs6656918 | hCV804126 | rs320320 | 0.51 | 0.470215497 | 0.6952 |
| hCV29210363 | rs6656918 | hCV8688079 | rs884808 | 0.51 | 0.470215497 | 0.4867 |
| hCV29210363 | rs6656918 | hCV8688080 | rs884328 | 0.51 | 0.470215497 | 0.4847 |
| hCV29210363 | rs6656918 | hCV8688111 | rs1578275 | 0.51 | 0.470215497 | 0.8942 |

TABLE 4-continued

| Interrogated SNP | Interrogated rs | LD SNP | LD SNP rs | Power | Threshold r² | r² |
|---|---|---|---|---|---|---|
| hCV29210363 | rs6656918 | hCV9493081 | rs1058304 | 0.51 | 0.470215497 | 0.6589 |
| hCV29210363 | rs6656918 | hCV97631 | rs1538773 | 0.51 | 0.470215497 | 1 |
| hCV29210363 | rs6656918 | hDV71836703 | rs6429433 | 0.51 | 0.470215497 | 0.6479 |
| hCV30690780 | rs10737888 | hCV12073840 | rs14403 | 0.51 | 0.454920162 | 0.5283 |
| hCV30690780 | rs10737888 | hCV15760229 | rs3006939 | 0.51 | 0.454920162 | 1 |
| hCV30690780 | rs10737888 | hCV15760238 | rs3006936 | 0.51 | 0.454920162 | 1 |
| hCV30690780 | rs10737888 | hCV15760239 | rs3006923 | 0.51 | 0.454920162 | 0.4865 |
| hCV30690780 | rs10737888 | hCV15823024 | rs2125230 | 0.51 | 0.454920162 | 0.7059 |
| hCV30690780 | rs10737888 | hCV15885425 | rs2290754 | 0.51 | 0.454920162 | 0.7059 |
| hCV30690780 | rs10737888 | hCV15965338 | rs2291410 | 0.51 | 0.454920162 | 0.7059 |
| hCV30690780 | rs10737888 | hCV16082410 | rs2881275 | 0.51 | 0.454920162 | 0.7059 |
| hCV30690780 | rs10737888 | hCV1678656 | rs1458024 | 0.51 | 0.454920162 | 0.7059 |
| hCV30690780 | rs10737888 | hCV1678674 | rs1458023 | 0.51 | 0.454920162 | 0.5714 |
| hCV30690780 | rs10737888 | hCV1678682 | rs320339 | 0.51 | 0.454920162 | 0.6154 |
| hCV30690780 | rs10737888 | hCV233148 | rs1417121 | 0.51 | 0.454920162 | 0.6656 |
| hCV30690780 | rs10737888 | hCV26034158 | rs4515770 | 0.51 | 0.454920162 | 1 |
| hCV30690780 | rs10737888 | hCV26034160 | rs2994327 | 0.51 | 0.454920162 | 0.5018 |
| hCV30690780 | rs10737888 | hCV26719082 | rs10927046 | 0.51 | 0.454920162 | 0.6144 |
| hCV30690780 | rs10737888 | hCV26719085 | rs10927047 | 0.51 | 0.454920162 | 0.6005 |
| hCV30690780 | rs10737888 | hCV26719107 | rs7538011 | 0.51 | 0.454920162 | 0.6602 |
| hCV30690780 | rs10737888 | hCV26719113 | rs7517340 | 0.51 | 0.454920162 | 0.647 |
| hCV30690780 | rs10737888 | hCV26719116 | rs10927039 | 0.51 | 0.454920162 | 0.7848 |
| hCV30690780 | rs10737888 | hCV26719120 | rs10927040 | 0.51 | 0.454920162 | 0.7673 |
| hCV30690780 | rs10737888 | hCV26719121 | rs10927041 | 0.51 | 0.454920162 | 0.7525 |
| hCV30690780 | rs10737888 | hCV26719149 | rs6675851 | 0.51 | 0.454920162 | 0.7059 |
| hCV30690780 | rs10737888 | hCV26719162 | rs4132509 | 0.51 | 0.454920162 | 0.7059 |
| hCV30690780 | rs10737888 | hCV26719176 | rs10927076 | 0.51 | 0.454920162 | 0.6701 |
| hCV30690780 | rs10737888 | hCV26719192 | rs10803161 | 0.51 | 0.454920162 | 0.7337 |
| hCV30690780 | rs10737888 | hCV26719201 | rs4478795 | 0.51 | 0.454920162 | 0.4789 |
| hCV30690780 | rs10737888 | hCV26719219 | rs9782958 | 0.51 | 0.454920162 | 0.7059 |
| hCV30690780 | rs10737888 | hCV26719222 | rs4553169 | 0.51 | 0.454920162 | 0.7041 |
| hCV30690780 | rs10737888 | hCV26719227 | rs10927065 | 0.51 | 0.454920162 | 0.5714 |
| hCV30690780 | rs10737888 | hCV26719232 | rs10803158 | 0.51 | 0.454920162 | 0.7059 |
| hCV30690780 | rs10737888 | hCV26719233 | rs10927067 | 0.51 | 0.454920162 | 0.7059 |
| hCV30690780 | rs10737888 | hCV27498250 | rs3766673 | 0.51 | 0.454920162 | 0.6075 |
| hCV30690780 | rs10737888 | hCV29210363 | rs6656918 | 0.51 | 0.454920162 | 1 |
| hCV30690780 | rs10737888 | hCV29542869 | rs7534117 | 0.51 | 0.454920162 | 0.7059 |
| hCV30690780 | rs10737888 | hCV29560960 | rs7519673 | 0.51 | 0.454920162 | 0.5714 |
| hCV30690780 | rs10737888 | hCV29741723 | rs7517921 | 0.51 | 0.454920162 | 0.5624 |
| hCV30690780 | rs10737888 | hCV29994467 | rs6694738 | 0.51 | 0.454920162 | 0.6602 |
| hCV30690780 | rs10737888 | hCV30084348 | rs9287269 | 0.51 | 0.454920162 | 0.7059 |
| hCV30690780 | rs10737888 | hCV30372886 | rs9782883 | 0.51 | 0.454920162 | 0.7059 |
| hCV30690780 | rs10737888 | hCV30690778 | rs12140414 | 0.51 | 0.454920162 | 0.898 |
| hCV30690780 | rs10737888 | hCV30690784 | rs4658574 | 0.51 | 0.454920162 | 0.5018 |
| hCV30690780 | rs10737888 | hCV31523557 | rs10754807 | 0.51 | 0.454920162 | 0.705 |
| hCV30690780 | rs10737888 | hCV31523563 | rs10927051 | 0.51 | 0.454920162 | 0.6533 |
| hCV30690780 | rs10737888 | hCV31523638 | rs12037013 | 0.51 | 0.454920162 | 0.6144 |
| hCV30690780 | rs10737888 | hCV31523639 | rs12034588 | 0.51 | 0.454920162 | 0.6943 |
| hCV30690780 | rs10737888 | hCV31523643 | rs6671475 | 0.51 | 0.454920162 | 0.7841 |
| hCV30690780 | rs10737888 | hCV31523650 | rs12048930 | 0.51 | 0.454920162 | 0.566 |
| hCV30690780 | rs10737888 | hCV31523658 | rs12047209 | 0.51 | 0.454920162 | 0.5224 |
| hCV30690780 | rs10737888 | hCV31523688 | rs12049228 | 0.51 | 0.454920162 | 0.6952 |
| hCV30690780 | rs10737888 | hCV31523691 | rs12021907 | 0.51 | 0.454920162 | 0.5714 |
| hCV30690780 | rs10737888 | hCV31523707 | rs10803152 | 0.51 | 0.454920162 | 0.6015 |
| hCV30690780 | rs10737888 | hCV31523710 | rs10927059 | 0.51 | 0.454920162 | 0.7059 |
| hCV30690780 | rs10737888 | hCV31523723 | rs12140040 | 0.51 | 0.454920162 | 0.5283 |
| hCV30690780 | rs10737888 | hCV31523736 | rs12124113 | 0.51 | 0.454920162 | 0.5704 |
| hCV30690780 | rs10737888 | hCV31523740 | rs12032342 | 0.51 | 0.454920162 | 0.7059 |
| hCV30690780 | rs10737888 | hCV31523744 | rs12031994 | 0.51 | 0.454920162 | 0.5714 |
| hCV30690780 | rs10737888 | hCV804126 | rs320320 | 0.51 | 0.454920162 | 0.7059 |
| hCV30690780 | rs10737888 | hCV8688079 | rs884808 | 0.51 | 0.454920162 | 0.5018 |
| hCV30690780 | rs10737888 | hCV8688080 | rs884328 | 0.51 | 0.454920162 | 0.4999 |
| hCV30690780 | rs10737888 | hCV8688111 | rs1578275 | 0.51 | 0.454920162 | 0.898 |
| hCV30690780 | rs10737888 | hCV9493081 | rs1058304 | 0.51 | 0.454920162 | 0.6684 |
| hCV30690780 | rs10737888 | hCV97631 | rs1538773 | 0.51 | 0.454920162 | 1 |
| hCV30690780 | rs10737888 | hDV71836703 | rs6429433 | 0.51 | 0.454920162 | 0.6602 |
| hCV31523557 | rs10754807 | hCV15760229 | rs3006939 | 0.51 | 0.685954218 | 0.6934 |
| hCV31523557 | rs10754807 | hCV15760238 | rs3006936 | 0.51 | 0.685954218 | 0.705 |
| hCV31523557 | rs10754807 | hCV15823024 | rs2125230 | 0.51 | 0.685954218 | 1 |
| hCV31523557 | rs10754807 | hCV15885425 | rs2290754 | 0.51 | 0.685954218 | 1 |
| hCV31523557 | rs10754807 | hCV15965338 | rs2291410 | 0.51 | 0.685954218 | 1 |
| hCV31523557 | rs10754807 | hCV16082410 | rs2881275 | 0.51 | 0.685954218 | 1 |
| hCV31523557 | rs10754807 | hCV1678656 | rs1458024 | 0.51 | 0.685954218 | 1 |
| hCV31523557 | rs10754807 | hCV1678674 | rs1458023 | 0.51 | 0.685954218 | 0.8091 |
| hCV31523557 | rs10754807 | hCV1678682 | rs320339 | 0.51 | 0.685954218 | 0.8715 |
| hCV31523557 | rs10754807 | hCV26034158 | rs4515770 | 0.51 | 0.685954218 | 0.6968 |
| hCV31523557 | rs10754807 | hCV26719082 | rs10927046 | 0.51 | 0.685954218 | 0.8715 |
| hCV31523557 | rs10754807 | hCV26719085 | rs10927047 | 0.51 | 0.685954218 | 0.8649 |

TABLE 4-continued

| Interrogated SNP | Interrogated rs | LD SNP | LD SNP rs | Power | Threshold r² | r² |
|---|---|---|---|---|---|---|
| hCV31523557 | rs10754807 | hCV26719107 | rs7538011 | 0.51 | 0.685954218 | 0.8095 |
| hCV31523557 | rs10754807 | hCV26719113 | rs7517340 | 0.51 | 0.685954218 | 0.9316 |
| hCV31523557 | rs10754807 | hCV26719116 | rs10927039 | 0.51 | 0.685954218 | 0.8707 |
| hCV31523557 | rs10754807 | hCV26719120 | rs10927040 | 0.51 | 0.685954218 | 1 |
| hCV31523557 | rs10754807 | hCV26719121 | rs10927041 | 0.51 | 0.685954218 | 0.8175 |
| hCV31523557 | rs10754807 | hCV26719149 | rs6675851 | 0.51 | 0.685954218 | 1 |
| hCV31523557 | rs10754807 | hCV26719162 | rs4132509 | 0.51 | 0.685954218 | 1 |
| hCV31523557 | rs10754807 | hCV26719176 | rs10927076 | 0.51 | 0.685954218 | 1 |
| hCV31523557 | rs10754807 | hCV26719192 | rs10803161 | 0.51 | 0.685954218 | 1 |
| hCV31523557 | rs10754807 | hCV26719201 | rs4478795 | 0.51 | 0.685954218 | 0.7457 |
| hCV31523557 | rs10754807 | hCV26719219 | rs9782958 | 0.51 | 0.685954218 | 1 |
| hCV31523557 | rs10754807 | hCV26719222 | rs4553169 | 0.51 | 0.685954218 | 1 |
| hCV31523557 | rs10754807 | hCV26719227 | rs10927065 | 0.51 | 0.685954218 | 0.8091 |
| hCV31523557 | rs10754807 | hCV26719232 | rs10803158 | 0.51 | 0.685954218 | 1 |
| hCV31523557 | rs10754807 | hCV26719233 | rs10927067 | 0.51 | 0.685954218 | 1 |
| hCV31523557 | rs10754807 | hCV27498250 | rs3766673 | 0.51 | 0.685954218 | 0.879 |
| hCV31523557 | rs10754807 | hCV29210363 | rs6656918 | 0.51 | 0.685954218 | 0.6943 |
| hCV31523557 | rs10754807 | hCV29542869 | rs7534117 | 0.51 | 0.685954218 | 1 |
| hCV31523557 | rs10754807 | hCV29560960 | rs7519673 | 0.51 | 0.685954218 | 0.8091 |
| hCV31523557 | rs10754807 | hCV29741723 | rs7517921 | 0.51 | 0.685954218 | 0.7033 |
| hCV31523557 | rs10754807 | hCV29994467 | rs6694738 | 0.51 | 0.685954218 | 0.8095 |
| hCV31523557 | rs10754807 | hCV30084348 | rs9287269 | 0.51 | 0.685954218 | 1 |
| hCV31523557 | rs10754807 | hCV30372886 | rs9782883 | 0.51 | 0.685954218 | 1 |
| hCV31523557 | rs10754807 | hCV30690780 | rs10737888 | 0.51 | 0.685954218 | 0.705 |
| hCV31523557 | rs10754807 | hCV31523563 | rs10927051 | 0.51 | 0.685954218 | 0.923 |
| hCV31523557 | rs10754807 | hCV31523638 | rs12037013 | 0.51 | 0.685954218 | 0.8711 |
| hCV31523557 | rs10754807 | hCV31523639 | rs12034588 | 0.51 | 0.685954218 | 1 |
| hCV31523557 | rs10754807 | hCV31523643 | rs6671475 | 0.51 | 0.685954218 | 0.9345 |
| hCV31523557 | rs10754807 | hCV31523650 | rs12048930 | 0.51 | 0.685954218 | 0.8175 |
| hCV31523557 | rs10754807 | hCV31523658 | rs12047209 | 0.51 | 0.685954218 | 0.7474 |
| hCV31523557 | rs10754807 | hCV31523688 | rs12049228 | 0.51 | 0.685954218 | 1 |
| hCV31523557 | rs10754807 | hCV31523691 | rs12021907 | 0.51 | 0.685954218 | 0.8091 |
| hCV31523557 | rs10754807 | hCV31523707 | rs10803152 | 0.51 | 0.685954218 | 0.8649 |
| hCV31523557 | rs10754807 | hCV31523710 | rs10927059 | 0.51 | 0.685954218 | 1 |
| hCV31523557 | rs10754807 | hCV31523723 | rs12140040 | 0.51 | 0.685954218 | 0.7479 |
| hCV31523557 | rs10754807 | hCV31523736 | rs12124113 | 0.51 | 0.685954218 | 0.8086 |
| hCV31523557 | rs10754807 | hCV31523740 | rs12032342 | 0.51 | 0.685954218 | 1 |
| hCV31523557 | rs10754807 | hCV31523744 | rs12031994 | 0.51 | 0.685954218 | 0.8091 |
| hCV31523557 | rs10754807 | hCV804126 | rs320320 | 0.51 | 0.685954218 | 1 |
| hCV31523557 | rs10754807 | hCV97631 | rs1538773 | 0.51 | 0.685954218 | 0.705 |
| hCV31523557 | rs10754807 | hDV71836703 | rs6429433 | 0.51 | 0.685954218 | 0.8095 |
| hCV31523608 | rs12744297 | hCV12073160 | rs1973284 | 0.51 | 0.768680874 | 0.9599 |
| hCV31523608 | rs12744297 | hCV12073167 | rs2034915 | 0.51 | 0.768680874 | 0.9599 |
| hCV31523608 | rs12744297 | hCV12073172 | rs971285 | 0.51 | 0.768680874 | 0.9599 |
| hCV31523608 | rs12744297 | hCV12073180 | rs1870272 | 0.51 | 0.768680874 | 0.9599 |
| hCV31523608 | rs12744297 | hCV15776869 | rs2345994 | 0.51 | 0.768680874 | 0.9556 |
| hCV31523608 | rs12744297 | hCV15823033 | rs2125231 | 0.51 | 0.768680874 | 0.9599 |
| hCV31523608 | rs12744297 | hCV15885435 | rs2290753 | 0.51 | 0.768680874 | 0.9599 |
| hCV31523608 | rs12744297 | hCV15965328 | rs2291409 | 0.51 | 0.768680874 | 1 |
| hCV31523608 | rs12744297 | hCV1678668 | rs1379700 | 0.51 | 0.768680874 | 0.845 |
| hCV31523608 | rs12744297 | hCV1678723 | rs1486472 | 0.51 | 0.768680874 | 0.7707 |
| hCV31523608 | rs12744297 | hCV26719086 | rs4658585 | 0.51 | 0.768680874 | 0.9197 |
| hCV31523608 | rs12744297 | hCV26719087 | rs4658401 | 0.51 | 0.768680874 | 0.9056 |
| hCV31523608 | rs12744297 | hCV26719102 | rs10927056 | 0.51 | 0.768680874 | 0.8824 |
| hCV31523608 | rs12744297 | hCV26719114 | rs7549780 | 0.51 | 0.768680874 | 0.9599 |
| hCV31523608 | rs12744297 | hCV26719117 | rs12144559 | 0.51 | 0.768680874 | 0.9599 |
| hCV31523608 | rs12744297 | hCV26719171 | rs10927075 | 0.51 | 0.768680874 | 0.9599 |
| hCV31523608 | rs12744297 | hCV26719179 | rs6672195 | 0.51 | 0.768680874 | 0.9599 |
| hCV31523608 | rs12744297 | hCV26719194 | rs10927081 | 0.51 | 0.768680874 | 0.9599 |
| hCV31523608 | rs12744297 | hCV26719197 | rs4590656 | 0.51 | 0.768680874 | 0.9599 |
| hCV31523608 | rs12744297 | hCV26719215 | rs12144546 | 0.51 | 0.768680874 | 0.9599 |
| hCV31523608 | rs12744297 | hCV26719225 | rs11586029 | 0.51 | 0.768680874 | 0.9596 |
| hCV31523608 | rs12744297 | hCV29210367 | rs4518884 | 0.51 | 0.768680874 | 0.9599 |
| hCV31523608 | rs12744297 | hCV29633221 | rs10157763 | 0.51 | 0.768680874 | 0.9589 |
| hCV31523608 | rs12744297 | hCV29795761 | rs7528450 | 0.51 | 0.768680874 | 1 |
| hCV31523608 | rs12744297 | hCV30012351 | rs10158245 | 0.51 | 0.768680874 | 0.9568 |
| hCV31523608 | rs12744297 | hCV31523552 | rs12739344 | 0.51 | 0.768680874 | 1 |
| hCV31523608 | rs12744297 | hCV31523555 | rs12749316 | 0.51 | 0.768680874 | 0.9202 |
| hCV31523608 | rs12744297 | hCV31523573 | rs11589907 | 0.51 | 0.768680874 | 0.9599 |
| hCV31523608 | rs12744297 | hCV31523576 | rs12691548 | 0.51 | 0.768680874 | 0.9207 |
| hCV31523608 | rs12744297 | hCV31523624 | rs10927044 | 0.51 | 0.768680874 | 1 |
| hCV31523608 | rs12744297 | hCV31523725 | rs10927060 | 0.51 | 0.768680874 | 0.9599 |
| hCV31523608 | rs12744297 | hCV8688098 | rs1531244 | 0.51 | 0.768680874 | 0.9544 |
| hCV31523608 | rs12744297 | hCV8689016 | rs897959 | 0.51 | 0.768680874 | 0.9599 |
| hCV31523608 | rs12744297 | hCV9115290 | rs1352162 | 0.51 | 0.768680874 | 1 |
| hCV31523643 | rs6671475 | hCV15760229 | rs3006939 | 0.51 | 0.736259252 | 0.7747 |
| hCV31523643 | rs6671475 | hCV15760238 | rs3006936 | 0.51 | 0.736259252 | 0.7841 |
| hCV31523643 | rs6671475 | hCV15823024 | rs2125230 | 0.51 | 0.736259252 | 0.9347 |

TABLE 4-continued

| Interrogated SNP | Interrogated rs | LD SNP | LD SNP rs | Power | Threshold r² | r² |
|---|---|---|---|---|---|---|
| hCV31523643 | rs6671475 | hCV15885425 | rs2290754 | 0.51 | 0.736259252 | 0.9347 |
| hCV31523643 | rs6671475 | hCV15965338 | rs2291410 | 0.51 | 0.736259252 | 0.9347 |
| hCV31523643 | rs6671475 | hCV16082410 | rs2881275 | 0.51 | 0.736259252 | 0.9347 |
| hCV31523643 | rs6671475 | hCV1678656 | rs1458024 | 0.51 | 0.736259252 | 0.9347 |
| hCV31523643 | rs6671475 | hCV1678674 | rs1458023 | 0.51 | 0.736259252 | 0.7467 |
| hCV31523643 | rs6671475 | hCV1678682 | rs320339 | 0.51 | 0.736259252 | 0.8081 |
| hCV31523643 | rs6671475 | hCV26034158 | rs4515770 | 0.51 | 0.736259252 | 0.7955 |
| hCV31523643 | rs6671475 | hCV26719082 | rs10927046 | 0.51 | 0.736259252 | 0.8076 |
| hCV31523643 | rs6671475 | hCV26719085 | rs10927047 | 0.51 | 0.736259252 | 0.7978 |
| hCV31523643 | rs6671475 | hCV26719107 | rs7538011 | 0.51 | 0.736259252 | 0.8707 |
| hCV31523643 | rs6671475 | hCV26719113 | rs7517340 | 0.51 | 0.736259252 | 0.8638 |
| hCV31523643 | rs6671475 | hCV26719116 | rs10927039 | 0.51 | 0.736259252 | 0.9312 |
| hCV31523643 | rs6671475 | hCV26719120 | rs10927040 | 0.51 | 0.736259252 | 1 |
| hCV31523643 | rs6671475 | hCV26719121 | rs10927041 | 0.51 | 0.736259252 | 0.872 |
| hCV31523643 | rs6671475 | hCV26719149 | rs6675851 | 0.51 | 0.736259252 | 0.9347 |
| hCV31523643 | rs6671475 | hCV26719162 | rs4132509 | 0.51 | 0.736259252 | 0.9347 |
| hCV31523643 | rs6671475 | hCV26719176 | rs10927076 | 0.51 | 0.736259252 | 0.9232 |
| hCV31523643 | rs6671475 | hCV26719192 | rs10803161 | 0.51 | 0.736259252 | 0.9345 |
| hCV31523643 | rs6671475 | hCV26719219 | rs9782958 | 0.51 | 0.736259252 | 0.9347 |
| hCV31523643 | rs6671475 | hCV26719222 | rs4553169 | 0.51 | 0.736259252 | 0.9343 |
| hCV31523643 | rs6671475 | hCV26719227 | rs10927065 | 0.51 | 0.736259252 | 0.7467 |
| hCV31523643 | rs6671475 | hCV26719232 | rs10803158 | 0.51 | 0.736259252 | 0.9347 |
| hCV31523643 | rs6671475 | hCV26719233 | rs10927067 | 0.51 | 0.736259252 | 0.9347 |
| hCV31523643 | rs6671475 | hCV27498250 | rs3766673 | 0.51 | 0.736259252 | 1 |
| hCV31523643 | rs6671475 | hCV29210363 | rs6656918 | 0.51 | 0.736259252 | 0.7754 |
| hCV31523643 | rs6671475 | hCV29542869 | rs7534117 | 0.51 | 0.736259252 | 0.9347 |
| hCV31523643 | rs6671475 | hCV29560960 | rs7519673 | 0.51 | 0.736259252 | 0.7467 |
| hCV31523643 | rs6671475 | hCV29741723 | rs7517921 | 0.51 | 0.736259252 | 0.7503 |
| hCV31523643 | rs6671475 | hCV29994467 | rs6694738 | 0.51 | 0.736259252 | 0.8707 |
| hCV31523643 | rs6671475 | hCV30084348 | rs9287269 | 0.51 | 0.736259252 | 0.9347 |
| hCV31523643 | rs6671475 | hCV30372886 | rs9782883 | 0.51 | 0.736259252 | 0.9347 |
| hCV31523643 | rs6671475 | hCV30690780 | rs10737888 | 0.51 | 0.736259252 | 0.7841 |
| hCV31523643 | rs6671475 | hCV31523557 | rs10754807 | 0.51 | 0.736259252 | 0.9345 |
| hCV31523643 | rs6671475 | hCV31523563 | rs10927051 | 0.51 | 0.736259252 | 0.8551 |
| hCV31523643 | rs6671475 | hCV31523638 | rs12037013 | 0.51 | 0.736259252 | 0.8076 |
| hCV31523643 | rs6671475 | hCV31523639 | rs12034588 | 0.51 | 0.736259252 | 0.9312 |
| hCV31523643 | rs6671475 | hCV31523650 | rs12048930 | 0.51 | 0.736259252 | 0.752 |
| hCV31523643 | rs6671475 | hCV31523688 | rs12049228 | 0.51 | 0.736259252 | 0.9314 |
| hCV31523643 | rs6671475 | hCV31523691 | rs12021907 | 0.51 | 0.736259252 | 0.7467 |
| hCV31523643 | rs6671475 | hCV31523707 | rs10803152 | 0.51 | 0.736259252 | 0.7983 |
| hCV31523643 | rs6671475 | hCV31523710 | rs10927059 | 0.51 | 0.736259252 | 0.9347 |
| hCV31523643 | rs6671475 | hCV31523736 | rs12124113 | 0.51 | 0.736259252 | 0.746 |
| hCV31523643 | rs6671475 | hCV31523740 | rs12032342 | 0.51 | 0.736259252 | 0.9347 |
| hCV31523643 | rs6671475 | hCV31523744 | rs12031994 | 0.51 | 0.736259252 | 0.7467 |
| hCV31523643 | rs6671475 | hCV804126 | rs320320 | 0.51 | 0.736259252 | 0.9347 |
| hCV31523643 | rs6671475 | hCV97631 | rs1538773 | 0.51 | 0.736259252 | 0.7841 |
| hCV31523643 | rs6671475 | hDV71836703 | rs6429433 | 0.51 | 0.736259252 | 0.8707 |
| hCV31523650 | rs12048930 | hCV26719120 | rs10927040 | 0.51 | 0.888920337 | 0.9316 |
| hCV31523650 | rs12048930 | hCV31523563 | rs10927051 | 0.51 | 0.888920337 | 0.923 |
| hCV31523650 | rs12048930 | hCV31523639 | rs12034588 | 0.51 | 0.888920337 | 0.9349 |
| hCV31863982 | rs7659024 | hCV11503414 | rs2066865 | 0.51 | 0.477476354 | 1 |
| hCV31863982 | rs7659024 | hCV11503416 | rs2066864 | 0.51 | 0.477476354 | 1 |
| hCV31863982 | rs7659024 | hCV11503431 | rs2066861 | 0.51 | 0.477476354 | 1 |
| hCV31863982 | rs7659024 | hCV11853483 | rs12644950 | 0.51 | 0.477476354 | 1 |
| hCV31863982 | rs7659024 | hCV11853489 | rs7681423 | 0.51 | 0.477476354 | 1 |
| hCV31863982 | rs7659024 | hCV11853496 | rs7654093 | 0.51 | 0.477476354 | 1 |
| hCV31863982 | rs7659024 | hCV15860433 | rs2070006 | 0.51 | 0.477476354 | 0.5225 |
| hCV31863982 | rs7659024 | hCV27020269 | rs7659613 | 0.51 | 0.477476354 | 0.5225 |
| hCV31863982 | rs7659024 | hCV27020277 | rs6825454 | 0.51 | 0.477476354 | 0.9115 |
| hCV31863982 | rs7659024 | hCV2892859 | rs13130318 | 0.51 | 0.477476354 | 0.8654 |
| hCV31863982 | rs7659024 | hCV2892869 | rs13109457 | 0.51 | 0.477476354 | 0.9571 |
| hCV31863982 | rs7659024 | hCV2892877 | rs6050 | 0.51 | 0.477476354 | 0.9148 |
| hCV31965333 | rs10797390 | hCV16000557 | rs2377041 | 0.51 | 0.676094947 | 0.7352 |
| hCV31965333 | rs10797390 | hCV1642008 | rs1563471 | 0.51 | 0.676094947 | 0.7255 |
| hCV31965333 | rs10797390 | hCV27102953 | rs4648360 | 0.51 | 0.676094947 | 0.7827 |
| hCV31965333 | rs10797390 | hCV27102978 | rs7537581 | 0.51 | 0.676094947 | 0.7038 |
| hCV31965333 | rs10797390 | hCV27103080 | rs4648459 | 0.51 | 0.676094947 | 0.7405 |
| hCV31965333 | rs10797390 | hCV27103144 | rs11584658 | 0.51 | 0.676094947 | 0.8469 |
| hCV31965333 | rs10797390 | hCV27103182 | rs4609377 | 0.51 | 0.676094947 | 0.7768 |
| hCV31965333 | rs10797390 | hCV27103185 | rs10797389 | 0.51 | 0.676094947 | 0.8326 |
| hCV31965333 | rs10797390 | hCV27103186 | rs4648481 | 0.51 | 0.676094947 | 0.8158 |
| hCV31965333 | rs10797390 | hCV27103188 | rs7511879 | 0.51 | 0.676094947 | 0.7786 |
| hCV31965333 | rs10797390 | hCV27103189 | rs12031493 | 0.51 | 0.676094947 | 0.8473 |
| hCV31965333 | rs10797390 | hCV27103192 | rs6680471 | 0.51 | 0.676094947 | 0.8159 |
| hCV31965333 | rs10797390 | hCV27103207 | rs6424062 | 0.51 | 0.676094947 | 0.7449 |
| hCV31965333 | rs10797390 | hCV31965210 | rs10909880 | 0.51 | 0.676094947 | 0.8158 |
| hCV31965333 | rs10797390 | hCV788647 | rs729045 | 0.51 | 0.676094947 | 0.9244 |
| hCV3216426 | rs7315731 | hCV1026394 | rs35117 | 0.51 | 0.727697779 | 0.9666 |

TABLE 4-continued

| Interrogated SNP | Interrogated rs | LD SNP | LD SNP rs | Power | Threshold r² | r² |
|---|---|---|---|---|---|---|
| hCV3216426 | rs7315731 | hCV1026396 | rs35115 | 0.51 | 0.727697779 | 0.9344 |
| hCV3216426 | rs7315731 | hCV1026401 | rs35122 | 0.51 | 0.727697779 | 0.9318 |
| hCV3216426 | rs7315731 | hCV1026402 | rs247929 | 0.51 | 0.727697779 | 0.9652 |
| hCV3216426 | rs7315731 | hCV1026405 | rs997307 | 0.51 | 0.727697779 | 1 |
| hCV3216426 | rs7315731 | hCV12058175 | rs10880879 | 0.51 | 0.727697779 | 1 |
| hCV3216426 | rs7315731 | hCV2071465 | rs10880884 | 0.51 | 0.727697779 | 0.9664 |
| hCV3216426 | rs7315731 | hCV2362878 | rs247918 | 0.51 | 0.727697779 | 0.888 |
| hCV3216426 | rs7315731 | hCV26024786 | rs7976870 | 0.51 | 0.727697779 | 0.9652 |
| hCV3216426 | rs7315731 | hCV26173954 | rs7308284 | 0.51 | 0.727697779 | 0.7488 |
| hCV3216426 | rs7315731 | hCV26173968 | rs10880880 | 0.51 | 0.727697779 | 1 |
| hCV3216426 | rs7315731 | hCV26173972 | rs1012642 | 0.51 | 0.727697779 | 1 |
| hCV3216426 | rs7315731 | hCV2773478 | rs2193749 | 0.51 | 0.727697779 | 0.9666 |
| hCV3216426 | rs7315731 | hCV2773479 | rs7138997 | 0.51 | 0.727697779 | 0.9344 |
| hCV3216426 | rs7315731 | hCV2791821 | rs2059404 | 0.51 | 0.727697779 | 0.8909 |
| hCV3216426 | rs7315731 | hCV2791832 | rs2408435 | 0.51 | 0.727697779 | 0.9641 |
| hCV3216426 | rs7315731 | hCV2791836 | rs7132422 | 0.51 | 0.727697779 | 0.966 |
| hCV3216426 | rs7315731 | hCV30311491 | rs6582585 | 0.51 | 0.727697779 | 0.7488 |
| hCV3216426 | rs7315731 | hCV30680015 | rs6582574 | 0.51 | 0.727697779 | 0.9658 |
| hCV3216426 | rs7315731 | hCV30870058 | rs11183272 | 0.51 | 0.727697779 | 1 |
| hCV3216426 | rs7315731 | hCV30870104 | rs10880875 | 0.51 | 0.727697779 | 1 |
| hCV3216426 | rs7315731 | hCV30870137 | rs10880871 | 0.51 | 0.727697779 | 1 |
| hCV3216426 | rs7315731 | hCV31416750 | rs10880855 | 0.51 | 0.727697779 | 0.9666 |
| hCV3216426 | rs7315731 | hCV31416763 | rs12319077 | 0.51 | 0.727697779 | 0.9329 |
| hCV3216426 | rs7315731 | hCV31416770 | rs11183201 | 0.51 | 0.727697779 | 0.9661 |
| hCV3216426 | rs7315731 | hCV3201166 | rs11183243 | 0.51 | 0.727697779 | 1 |
| hCV3216426 | rs7315731 | hCV3216410 | rs247930 | 0.51 | 0.727697779 | 0.9666 |
| hCV3216426 | rs7315731 | hCV3216415 | rs247920 | 0.51 | 0.727697779 | 0.9344 |
| hCV3216426 | rs7315731 | hCV3216418 | rs35125 | 0.51 | 0.727697779 | 0.9666 |
| hCV3216426 | rs7315731 | hCV3216425 | rs1366024 | 0.51 | 0.727697779 | 0.9666 |
| hCV3216426 | rs7315731 | hCV3216427 | rs724909 | 0.51 | 0.727697779 | 1 |
| hCV3216426 | rs7315731 | hCV3216433 | rs7306229 | 0.51 | 0.727697779 | 1 |
| hCV3216426 | rs7315731 | hCV345121 | rs10748432 | 0.51 | 0.727697779 | 0.9578 |
| hCV3216426 | rs7315731 | hCV389695 | rs2408461 | 0.51 | 0.727697779 | 0.7488 |
| hCV491830 | rs3087546 | hCV11280343 | rs12222447 | 0.51 | 0.804397523 | 0.8924 |
| hCV596326 | rs398101 | hCV596330 | rs422187 | 0.51 | 0.794342915 | 0.8217 |
| hCV596326 | rs398101 | hCV596331 | rs6048 | 0.51 | 0.794342915 | 0.8216 |
| hCV596331 | rs6048 | hCV596330 | rs422187 | 0.51 | 0.959456195 | 1 |
| hCV596663 | rs411017 | hCV11780206 | rs5931656 | 0.51 | 0.674917535 | 0.9579 |
| hCV596663 | rs411017 | hCV11780209 | rs5930009 | 0.51 | 0.674917535 | 0.9579 |
| hCV596663 | rs411017 | hCV11780214 | rs7878061 | 0.51 | 0.674917535 | 0.9579 |
| hCV596663 | rs411017 | hCV2288095 | rs378815 | 0.51 | 0.674917535 | 1 |
| hCV596663 | rs411017 | hCV26011954 | rs4620439 | 0.51 | 0.674917535 | 0.9579 |
| hCV596663 | rs411017 | hCV26011955 | rs5930013 | 0.51 | 0.674917535 | 0.9579 |
| hCV596663 | rs411017 | hCV26016182 | rs11796672 | 0.51 | 0.674917535 | 0.9579 |
| hCV596663 | rs411017 | hCV26016183 | rs9887617 | 0.51 | 0.674917535 | 0.9162 |
| hCV596663 | rs411017 | hCV27904396 | rs4829996 | 0.51 | 0.674917535 | 0.9459 |
| hCV596663 | rs411017 | hCV28962605 | rs5930005 | 0.51 | 0.674917535 | 0.9576 |
| hCV596663 | rs411017 | hCV29515877 | rs5930015 | 0.51 | 0.674917535 | 0.9579 |
| hCV596663 | rs411017 | hCV29732937 | rs5931647 | 0.51 | 0.674917535 | 0.9579 |
| hCV596663 | rs411017 | hCV29967889 | rs5931645 | 0.51 | 0.674917535 | 0.9579 |
| hCV596663 | rs411017 | hCV30130033 | rs5931646 | 0.51 | 0.674917535 | 0.9579 |
| hCV596663 | rs411017 | hCV30201992 | rs5931641 | 0.51 | 0.674917535 | 0.9579 |
| hCV596663 | rs411017 | hCV30291634 | rs5931666 | 0.51 | 0.674917535 | 0.9562 |
| hCV596663 | rs411017 | hCV30700232 | rs12687091 | 0.51 | 0.674917535 | 0.9579 |
| hCV596663 | rs411017 | hCV596665 | rs401597 | 0.51 | 0.674917535 | 0.9459 |
| hCV596663 | rs411017 | hDV77022847 | rs4598407 | 0.51 | 0.674917535 | 0.9579 |
| hCV596663 | rs411017 | hDV77148131 | rs5931661 | 0.51 | 0.674917535 | 0.9116 |
| hCV596663 | rs411017 | hDV77150953 | rs5976389 | 0.51 | 0.674917535 | 0.9579 |
| hCV788647 | rs729045 | hCV31965333 | rs10797390 | 0.51 | 0.862222906 | 0.9244 |
| hCV8361354 | rs1138800 | hCV16176508 | rs2949857 | 0.51 | 0.697573042 | 0.7785 |
| hCV8361354 | rs1138800 | hCV16176534 | rs2949863 | 0.51 | 0.697573042 | 0.7785 |
| hCV8361354 | rs1138800 | hCV204260 | rs4753535 | 0.51 | 0.697573042 | 0.743 |
| hCV8361354 | rs1138800 | hCV260722 | rs4073615 | 0.51 | 0.697573042 | 0.8988 |
| hCV8361354 | rs1138800 | hCV26487026 | rs4753543 | 0.51 | 0.697573042 | 0.808 |
| hCV8361354 | rs1138800 | hCV29137668 | rs7108501 | 0.51 | 0.697573042 | 0.7385 |
| hCV8361354 | rs1138800 | hCV29137679 | rs6483293 | 0.51 | 0.697573042 | 0.8651 |
| hCV8361354 | rs1138800 | hCV31252427 | rs4625415 | 0.51 | 0.697573042 | 0.7785 |
| hCV8361354 | rs1138800 | hCV31252429 | rs12222234 | 0.51 | 0.697573042 | 0.755 |
| hCV8361354 | rs1138800 | hCV389113 | rs7927016 | 0.51 | 0.697573042 | 0.7785 |
| hCV8361354 | rs1138800 | hCV389115 | rs4531426 | 0.51 | 0.697573042 | 0.7785 |
| hCV8361354 | rs1138800 | hCV389118 | rs10437575 | 0.51 | 0.697573042 | 0.7385 |
| hCV8361354 | rs1138800 | hCV389119 | rs7925817 | 0.51 | 0.697573042 | 0.738 |
| hCV8361354 | rs1138800 | hCV89001 | rs2949858 | 0.51 | 0.697573042 | 0.75 |
| hCV8598986 | rs4832233 | hCV2105930 | rs2083168 | 0.51 | 0.996752219 | 1 |
| hCV8598986 | rs4832233 | hCV2105934 | rs2099616 | 0.51 | 0.996752219 | 1 |
| hCV8598986 | rs4832233 | hCV2105935 | rs3937593 | 0.51 | 0.996752219 | 1 |
| hCV8598986 | rs4832233 | hCV2105948 | rs6547655 | 0.51 | 0.996752219 | 1 |
| hCV8598986 | rs4832233 | hCV29665700 | rs10173155 | 0.51 | 0.996752219 | 1 |

TABLE 4-continued

| Interrogated SNP | Interrogated rs | LD SNP | LD SNP rs | Power | Threshold $r^2$ | $r^2$ |
|---|---|---|---|---|---|---|
| hCV8598986 | rs4832233 | hCV31173526 | rs6547654 | 0.51 | 0.996752219 | 1 |
| hCV8688111 | rs1578275 | hCV30690778 | rs12140414 | 0.51 | 0.973078677 | 1 |
| hCV9102827 | rs3795733 | hCV31431621 | rs11576266 | 0.51 | 0.983113922 | 1 |
| hCV9493081 | rs1058304 | hCV12073840 | rs14403 | 0.51 | 0.513841921 | 0.871 |
| hCV9493081 | rs1058304 | hCV15760229 | rs3006939 | 0.51 | 0.513841921 | 0.6575 |
| hCV9493081 | rs1058304 | hCV15760238 | rs3006936 | 0.51 | 0.513841921 | 0.6684 |
| hCV9493081 | rs1058304 | hCV15760239 | rs3006923 | 0.51 | 0.513841921 | 0.718 |
| hCV9493081 | rs1058304 | hCV233148 | rs1417121 | 0.51 | 0.513841921 | 1 |
| hCV9493081 | rs1058304 | hCV26034157 | rs2994329 | 0.51 | 0.513841921 | 0.5193 |
| hCV9493081 | rs1058304 | hCV26034158 | rs4515770 | 0.51 | 0.513841921 | 0.7088 |
| hCV9493081 | rs1058304 | hCV26034160 | rs2994327 | 0.51 | 0.513841921 | 0.7471 |
| hCV9493081 | rs1058304 | hCV26719121 | rs10927041 | 0.51 | 0.513841921 | 0.5644 |
| hCV9493081 | rs1058304 | hCV29210363 | rs6656918 | 0.51 | 0.513841921 | 0.6589 |
| hCV9493081 | rs1058304 | hCV30690778 | rs12140414 | 0.51 | 0.513841921 | 0.5936 |
| hCV9493081 | rs1058304 | hCV30690780 | rs10737888 | 0.51 | 0.513841921 | 0.6684 |
| hCV9493081 | rs1058304 | hCV30690784 | rs4658574 | 0.51 | 0.513841921 | 0.7471 |
| hCV9493081 | rs1058304 | hCV8688079 | rs884808 | 0.51 | 0.513841921 | 0.7471 |
| hCV9493081 | rs1058304 | hCV8688080 | rs884328 | 0.51 | 0.513841921 | 0.7459 |
| hCV9493081 | rs1058304 | hCV8688111 | rs1578275 | 0.51 | 0.513841921 | 0.5936 |
| hCV9493081 | rs1058304 | hCV97631 | rs1538773 | 0.51 | 0.513841921 | 0.6684 |
| hCV97631 | rs1538773 | hCV12073840 | rs14403 | 0.51 | 0.521807277 | 0.5283 |
| hCV97631 | rs1538773 | hCV15760229 | rs3006939 | 0.51 | 0.521807277 | 1 |
| hCV97631 | rs1538773 | hCV15760238 | rs3006936 | 0.51 | 0.521807277 | 1 |
| hCV97631 | rs1538773 | hCV15823024 | rs2125230 | 0.51 | 0.521807277 | 0.7059 |
| hCV97631 | rs1538773 | hCV15885425 | rs2290754 | 0.51 | 0.521807277 | 0.7059 |
| hCV97631 | rs1538773 | hCV15965338 | rs2291410 | 0.51 | 0.521807277 | 0.7059 |
| hCV97631 | rs1538773 | hCV16082410 | rs2881275 | 0.51 | 0.521807277 | 0.7059 |
| hCV97631 | rs1538773 | hCV1678656 | rs1458024 | 0.51 | 0.521807277 | 0.7059 |
| hCV97631 | rs1538773 | hCV1678674 | rs1458023 | 0.51 | 0.521807277 | 0.5714 |
| hCV97631 | rs1538773 | hCV1678682 | rs320339 | 0.51 | 0.521807277 | 0.6154 |
| hCV97631 | rs1538773 | hCV233148 | rs1417121 | 0.51 | 0.521807277 | 0.6656 |
| hCV97631 | rs1538773 | hCV26034158 | rs4515770 | 0.51 | 0.521807277 | 1 |
| hCV97631 | rs1538773 | hCV26719082 | rs10927046 | 0.51 | 0.521807277 | 0.6144 |
| hCV97631 | rs1538773 | hCV26719085 | rs10927047 | 0.51 | 0.521807277 | 0.6005 |
| hCV97631 | rs1538773 | hCV26719107 | rs7538011 | 0.51 | 0.521807277 | 0.6602 |
| hCV97631 | rs1538773 | hCV26719113 | rs7517340 | 0.51 | 0.521807277 | 0.647 |
| hCV97631 | rs1538773 | hCV26719116 | rs10927039 | 0.51 | 0.521807277 | 0.7848 |
| hCV97631 | rs1538773 | hCV26719120 | rs10927040 | 0.51 | 0.521807277 | 0.7673 |
| hCV97631 | rs1538773 | hCV26719121 | rs10927041 | 0.51 | 0.521807277 | 0.7525 |
| hCV97631 | rs1538773 | hCV26719149 | rs6675851 | 0.51 | 0.521807277 | 0.7059 |
| hCV97631 | rs1538773 | hCV26719162 | rs4132509 | 0.51 | 0.521807277 | 0.7059 |
| hCV97631 | rs1538773 | hCV26719176 | rs10927076 | 0.51 | 0.521807277 | 0.6701 |
| hCV97631 | rs1538773 | hCV26719192 | rs10803161 | 0.51 | 0.521807277 | 0.7337 |
| hCV97631 | rs1538773 | hCV26719219 | rs9782958 | 0.51 | 0.521807277 | 0.7059 |
| hCV97631 | rs1538773 | hCV26719222 | rs4553169 | 0.51 | 0.521807277 | 0.7041 |
| hCV97631 | rs1538773 | hCV26719227 | rs10927065 | 0.51 | 0.521807277 | 0.5714 |
| hCV97631 | rs1538773 | hCV26719232 | rs10803158 | 0.51 | 0.521807277 | 0.7059 |
| hCV97631 | rs1538773 | hCV26719233 | rs10927067 | 0.51 | 0.521807277 | 0.7059 |
| hCV97631 | rs1538773 | hCV27498250 | rs3766673 | 0.51 | 0.521807277 | 0.6075 |
| hCV97631 | rs1538773 | hCV29210363 | rs6656918 | 0.51 | 0.521807277 | 1 |
| hCV97631 | rs1538773 | hCV29542869 | rs7534117 | 0.51 | 0.521807277 | 0.7059 |
| hCV97631 | rs1538773 | hCV29560960 | rs7519673 | 0.51 | 0.521807277 | 0.5714 |
| hCV97631 | rs1538773 | hCV29741723 | rs7517921 | 0.51 | 0.521807277 | 0.5624 |
| hCV97631 | rs1538773 | hCV29994467 | rs6694738 | 0.51 | 0.521807277 | 0.6602 |
| hCV97631 | rs1538773 | hCV30084348 | rs9287269 | 0.51 | 0.521807277 | 0.7059 |
| hCV97631 | rs1538773 | hCV30372886 | rs9782883 | 0.51 | 0.521807277 | 0.7059 |
| hCV97631 | rs1538773 | hCV30690778 | rs12140414 | 0.51 | 0.521807277 | 0.898 |
| hCV97631 | rs1538773 | hCV30690780 | rs10737888 | 0.51 | 0.521807277 | 1 |
| hCV97631 | rs1538773 | hCV31523557 | rs10754807 | 0.51 | 0.521807277 | 0.705 |
| hCV97631 | rs1538773 | hCV31523563 | rs10927051 | 0.51 | 0.521807277 | 0.6533 |
| hCV97631 | rs1538773 | hCV31523638 | rs12037013 | 0.51 | 0.521807277 | 0.6144 |
| hCV97631 | rs1538773 | hCV31523639 | rs12034588 | 0.51 | 0.521807277 | 0.6943 |
| hCV97631 | rs1538773 | hCV31523643 | rs6671475 | 0.51 | 0.521807277 | 0.7841 |
| hCV97631 | rs1538773 | hCV31523650 | rs12048930 | 0.51 | 0.521807277 | 0.566 |
| hCV97631 | rs1538773 | hCV31523658 | rs12047209 | 0.51 | 0.521807277 | 0.5224 |
| hCV97631 | rs1538773 | hCV31523688 | rs12049228 | 0.51 | 0.521807277 | 0.6952 |
| hCV97631 | rs1538773 | hCV31523691 | rs12021907 | 0.51 | 0.521807277 | 0.5714 |
| hCV97631 | rs1538773 | hCV31523707 | rs10803152 | 0.51 | 0.521807277 | 0.6015 |
| hCV97631 | rs1538773 | hCV31523710 | rs10927059 | 0.51 | 0.521807277 | 0.7059 |
| hCV97631 | rs1538773 | hCV31523723 | rs12140040 | 0.51 | 0.521807277 | 0.5283 |
| hCV97631 | rs1538773 | hCV31523736 | rs12124113 | 0.51 | 0.521807277 | 0.5704 |
| hCV97631 | rs1538773 | hCV31523740 | rs12032342 | 0.51 | 0.521807277 | 0.7059 |
| hCV97631 | rs1538773 | hCV31523744 | rs12031994 | 0.51 | 0.521807277 | 0.5714 |
| hCV97631 | rs1538773 | hCV804126 | rs320320 | 0.51 | 0.521807277 | 0.7059 |
| hCV97631 | rs1538773 | hCV8688111 | rs1578275 | 0.51 | 0.521807277 | 0.898 |
| hCV97631 | rs1538773 | hCV9493081 | rs1058304 | 0.51 | 0.521807277 | 0.6684 |
| hCV97631 | rs1538773 | hDV71836703 | rs6429433 | 0.51 | 0.521807277 | 0.6602 |

TABLE 20

Unadjusted additive and genotypic association of 149 SNPs with DVT in LETS (p <= 0.1) and MEGA-1 (p <= 0.05)

| marker | annot | Endpoint | Model | parameter | P Value | Odds Ratio | OR95l | OR95u | Risk Allele |
|---|---|---|---|---|---|---|---|---|---|
| hCV505733 | (rs11126416) | LETS | Gen | AA_vs_GG | 0.062 | 1.48 | 0.98 | 2.24 | A |
| | | MEGA1 | Gen | AA_vs_GG | 0.006 | 1.36 | 1.09 | 1.69 | A |
| | | LETS | Gen | AA_vs_GG | 0.062 | 1.48 | 0.98 | 2.24 | A |
| | | | Gen | AG_vs_GG | 0.546 | 1.09 | 0.82 | 1.45 | A |
| | | MEGA1 | Gen | AA_vs_GG | 0.006 | 1.36 | 1.09 | 1.69 | A |
| | | | Gen | AG_vs_GG | 0.232 | 1.1 | 0.94 | 1.28 | A |
| hCV2879752 | (rs1244565) | LETS | add | G_vs_A | 0.028 | 1.23 | 1.02 | 1.48 | G |
| | | MEGA1 | add | G_vs_A | 0.036 | 1.11 | 1.01 | 1.23 | G |
| | | LETS | Gen | GA_vs_AA | 0.024 | 1.45 | 1.05 | 1.99 | G |
| | | | Gen | GG_vs_AA | 0.03 | 1.51 | 1.04 | 2.19 | G |
| | | MEGA1 | Gen | GA_vs_AA | 0.578 | 1.05 | 0.89 | 1.24 | G |
| | | | Gen | GG_vs_AA | 0.032 | 1.24 | 1.02 | 1.52 | G |
| hCV11503470 | (rs1800788) | MEGA1 | add | T_vs_C | 0.007 | 1.17 | 1.04 | 1.32 | T |
| | | LETS | add | T_vs_C | 0.014 | 1.32 | 1.06 | 1.65 | T |
| | | LETS | Gen | TC_vs_CC | 0.148 | 1.23 | 0.93 | 1.63 | T |
| | | | Gen | TT_vs_CC | 0.02 | 2.07 | 1.12 | 3.83 | T |
| | | MEGA1 | Gen | TC_vs_CC | 4E-04 | 1.31 | 1.13 | 1.53 | T |
| | | | Gen | TT_vs_CC | 0.505 | 1.11 | 0.82 | 1.49 | T |
| hCV15860433 | (rs2070006) | MEGA1 | add | T_vs_C | 2E-05 | 1.24 | 1.13 | 1.37 | T |
| | | LETS | add | T_vs_C | 0.024 | 1.24 | 1.03 | 1.5 | T |
| | | LETS | Gen | TC_vs_CC | 0.328 | 1.16 | 0.86 | 1.56 | T |
| | | | Gen | TT_vs_CC | 0.02 | 1.57 | 1.07 | 2.31 | T |
| | | MEGA1 | Gen | TC_vs_CC | 0.003 | 1.28 | 1.09 | 1.5 | T |
| | | | Gen | TT_vs_CC | 4E-05 | 1.54 | 1.25 | 1.88 | T |
| hCV2744023 | (rs369328) | LETS | add | A_vs_G | 0.002 | 1.35 | 1.11 | 1.63 | A |
| | | MEGA1 | add | A_vs_G | 0.018 | 1.13 | 1.02 | 1.24 | A |
| | | LETS | Gen | AA_vs_GG | 0.002 | 1.81 | 1.24 | 2.65 | A |
| | | | Gen | AG_vs_GG | 0.072 | 1.34 | 0.97 | 1.84 | A |
| | | MEGA1 | Gen | AA_vs_GG | 0.017 | 1.27 | 1.04 | 1.55 | A |
| | | | Gen | AG_vs_GG | 0.367 | 1.08 | 0.91 | 1.28 | A |
| hCV27477533 | (rs3756008) | MEGA1 | add | T_vs_A | 1E-06 | 1.28 | 1.16 | 1.42 | T |
| | | LETS | add | T_vs_A | 0.031 | 1.22 | 1.02 | 1.46 | T |
| | | LETS | Gen | TA_vs_AA | 0.052 | 1.35 | 1 | 1.82 | T |
| | | | Gen | TT_vs_AA | 0.044 | 1.46 | 1.01 | 2.11 | T |
| | | MEGA1 | Gen | TA_vs_AA | 0.001 | 1.31 | 1.11 | 1.53 | T |
| | | | Gen | TT_vs_AA | 2E-06 | 1.63 | 1.33 | 2 | T |
| hCV949676 | (rs480802) | MEGA1 | Gen | CC_vs_TT | 0.027 | 1.44 | 1.04 | 1.99 | C |
| | | LETS | Gen | CC_vs_TT | 0.049 | 1.86 | 1 | 3.47 | C |
| | | LETS | Gen | CC_vs_TT | 0.049 | 1.86 | 1 | 3.47 | C |
| | | | Gen | CT_vs_TT | 0.581 | 1.08 | 0.81 | 1.45 | C |
| | | MEGA1 | Gen | CC_vs_TT | 0.027 | 1.44 | 1.04 | 1.99 | C |
| | | | Gen | CT_vs_TT | 0.519 | 1.05 | 0.9 | 1.23 | C |
| hCV27904396 | (rs4829996) | LETS | rec | GG_vs_GA + AA | 0.041 | 1.32 | 1.01 | 1.73 | G |
| | | MEGA1 | Gen | GA_vs_AA | 0.049 | 1.26 | 1 | 1.58 | G |
| | | LETS | Gen | GA_vs_AA | 0.917 | 1.02 | 0.67 | 1.57 | G |
| | | | Gen | GG_vs_AA | 0.119 | 1.34 | 0.93 | 1.94 | G |
| | | MEGA1 | Gen | GA_vs_AA | 0.049 | 1.26 | 1 | 1.58 | G |
| | | | Gen | GG_vs_AA | 0.115 | 1.17 | 0.96 | 1.41 | G |
| hCV837462 | (rs528088) | LETS | Gen | CC_vs_AA | 0.071 | 4.2 | 0.89 | 19.9 | C |
| | | MEGA1 | dom | AA + AC_vs_CC | 0.027 | 3.05 | 1.14 | 8.18 | A |
| | | LETS | Gen | CA_vs_AA | 0.677 | 1.08 | 0.75 | 1.55 | C |
| | | | Gen | CC_vs_AA | 0.071 | 4.2 | 0.89 | 19.9 | C |
| | | MEGA1 | Gen | AA_vs_CC | 0.027 | 3.04 | 1.13 | 8.16 | A |
| | | | Gen | AC_vs_CC | 0.027 | 3.09 | 1.14 | 8.43 | A |
| hCV30440155 | (rs6699146) | LETS | add | C_vs_G | 0.062 | 1.19 | 0.99 | 1.43 | C |
| | | MEGA1 | add | C_vs_G | 0.003 | 1.16 | 1.05 | 1.28 | C |
| | | LETS | Gen | CC_vs_GG | 0.063 | 1.42 | 0.98 | 2.05 | C |
| | | | Gen | CG_vs_GG | 0.29 | 1.18 | 0.87 | 1.59 | C |
| | | MEGA1 | Gen | CC_vs_GG | 0.003 | 1.36 | 1.11 | 1.66 | C |
| | | | Gen | CG_vs_GG | 0.276 | 1.1 | 0.93 | 1.3 | C |
| hCV28960679 | (rs6844764) | LETS | rec | GG_vs_GC + CC | 0.072 | 1.29 | 0.98 | 1.71 | G |
| | | MEGA1 | dom | GG + GC_vs_CC | 0.007 | 1.28 | 1.07 | 1.54 | G |
| | | LETS | Gen | GC_vs_CC | 0.976 | 0.99 | 0.69 | 1.43 | G |
| | | | Gen | GG_vs_CC | 0.203 | 1.29 | 0.87 | 1.9 | G |
| | | MEGA1 | Gen | GC_vs_CC | 0.007 | 1.3 | 1.07 | 1.58 | G |
| | | | Gen | GG_vs_CC | 0.029 | 1.26 | 1.02 | 1.54 | G |
| hCV1952126 | (rs7223784) | LETS | add | A_vs_C | 0.026 | 1.26 | 1.03 | 1.55 | A |
| | | MEGA1 | add | A_vs_C | 0.035 | 1.13 | 1.01 | 1.26 | A |
| | | LETS | Gen | AA_vs_CC | 0.08 | 1.56 | 0.95 | 2.56 | A |
| | | | Gen | AC_vs_CC | 0.461 | 1.21 | 0.73 | 2.01 | A |
| | | MEGA1 | Gen | AA_vs_CC | 0.036 | 1.35 | 1.02 | 1.78 | A |
| | | | Gen | AC_vs_CC | 0.143 | 1.24 | 0.93 | 1.65 | A |
| hCV31749285 | (rs8178591) | LETS | rec | CC_vs_CT + TT | 0.069 | 1.28 | 0.98 | 1.66 | C |
| | | MEGA1 | rec | CC_vs_CT + TT | 0.013 | 1.2 | 1.04 | 1.38 | C |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | CC_vs_TT | 0.615 | 0.88 | 0.53 | 1.45 | C |
| | | | Gen | CT_vs_TT | 0.086 | 0.64 | 0.38 | 1.06 | C |
| | | MEGA1 | Gen | CC_vs_TT | 0.114 | 1.26 | 0.95 | 1.69 | C |
| | | | Gen | CT_vs_TT | 0.666 | 1.07 | 0.79 | 1.44 | C |
| hCV3187716 | AGTR1 (rs5186) | LETS | dom | CC + CA_vs_AA | 0.096 | 1.25 | 0.96 | 1.63 | C |
| | | MEGA1 | add | A_vs_C | 0.002 | 1.19 | 1.06 | 1.33 | A |
| | | LETS | Gen | AA_vs_CC | 0.292 | 0.77 | 0.48 | 1.25 | A |
| | | | Gen | AC_vs_CC | 0.782 | 0.93 | 0.58 | 1.51 | A |
| | | MEGA1 | Gen | AA_vs_CC | 0.018 | 1.38 | 1.06 | 1.8 | A |
| | | | Gen | AC_vs_CC | 0.343 | 1.14 | 0.87 | 1.49 | A |
| hCV9493081 | AKT3 (rs1058304) | LETS | add | T_vs_C | 4E−04 | 1.45 | 1.18 | 1.78 | T |
| | | MEGA1 | add | T_vs_C | 0.008 | 1.16 | 1.04 | 1.29 | T |
| | | LETS | Gen | TC_vs_CC | 0.004 | 1.5 | 1.13 | 1.98 | T |
| | | | Gen | TT_vs_CC | 0.004 | 2.01 | 1.24 | 3.26 | T |
| | | MEGA1 | Gen | TC_vs_CC | 0.922 | 1.01 | 0.87 | 1.17 | T |
| | | | Gen | TT_vs_CC | 2E−04 | 1.62 | 1.25 | 2.09 | T |
| hCV30690780 | AKT3 (rs1073788) | LETS | add | C_vs_A | 4E−05 | 1.58 | 1.27 | 1.96 | C |
| | | MEGA1 | add | C_vs_A | 0.001 | 1.21 | 1.08 | 1.36 | C |
| | | LETS | Gen | CA_vs_AA | 9E−04 | 1.61 | 1.21 | 2.13 | C |
| | | | Gen | CC_vs_AA | 0.002 | 2.4 | 1.37 | 4.19 | C |
| | | MEGA1 | Gen | CA_vs_AA | 0.256 | 1.09 | 0.94 | 1.27 | C |
| | | | Gen | CC_vs_AA | 1E−04 | 1.78 | 1.33 | 2.38 | C |
| hCV31523557 | AKT3 (rs10754807) | LETS | add | A_vs_G | 2E−04 | 1.57 | 1.24 | 1.98 | A |
| | | MEGA1 | add | A_vs_G | 0.002 | 1.21 | 1.07 | 1.36 | A |
| | | LETS | Gen | AA_vs_GG | 0.044 | 1.98 | 1.02 | 3.86 | A |
| | | | Gen | AG_vs_GG | 4E−04 | 1.68 | 1.26 | 2.25 | A |
| | | MEGA1 | Gen | AA_vs_GG | 0.043 | 1.41 | 1.01 | 1.97 | A |
| | | | Gen | AG_vs_GG | 0.01 | 1.22 | 1.05 | 1.43 | A |
| hCV26719108 | AKT3 (rs10927035) | LETS | add | C_vs_T | 0.002 | 1.36 | 1.12 | 1.66 | C |
| | | MEGA1 | add | C_vs_T | 0.002 | 1.18 | 1.06 | 1.3 | C |
| | | LETS | Gen | CC_vs_TT | 0.004 | 1.84 | 1.21 | 2.8 | C |
| | | | Gen | CT_vs_TT | 0.027 | 1.38 | 1.04 | 1.83 | C |
| | | MEGA1 | Gen | CC_vs_TT | 0.002 | 1.42 | 1.14 | 1.77 | C |
| | | | Gen | CT_vs_TT | 0.129 | 1.13 | 0.97 | 1.32 | C |
| hCV26719121 | AKT3 (rs10927041) | LETS | add | C_vs_T | 1E−04 | 1.59 | 1.26 | 2 | C |
| | | MEGA1 | add | C_vs_T | 0.007 | 1.18 | 1.05 | 1.34 | C |
| | | LETS | Gen | CC_vs_TT | 0.03 | 2.08 | 1.07 | 4.03 | C |
| | | | Gen | CT_vs_TT | 3E−04 | 1.69 | 1.27 | 2.26 | C |
| | | MEGA1 | Gen | CC_vs_TT | 0.063 | 1.38 | 0.98 | 1.93 | C |
| | | | Gen | CT_vs_TT | 0.026 | 1.19 | 1.02 | 1.39 | C |
| hCV26719227 | AKT3 (rs10927065) | LETS | add | A_vs_C | 0.01 | 1.4 | 1.08 | 1.8 | A |
| | | MEGA1 | add | A_vs_C | 0.013 | 1.18 | 1.04 | 1.34 | A |
| | | LETS | Gen | AA_vs_CC | 0.458 | 1.38 | 0.59 | 3.25 | A |
| | | | Gen | AC_vs_CC | 0.007 | 1.5 | 1.12 | 2.01 | A |
| | | MEGA1 | Gen | AA_vs_CC | 0.093 | 1.4 | 0.94 | 2.09 | A |
| | | | Gen | AC_vs_CC | 0.042 | 1.18 | 1.01 | 1.38 | A |
| hCV31523638 | AKT3 (rs12037013) | LETS | add | A_vs_G | 0.003 | 1.49 | 1.15 | 1.93 | A |
| | | MEGA1 | add | A_vs_G | 0.021 | 1.18 | 1.02 | 1.35 | A |
| | | LETS | Gen | AA_vs_GG | 0.317 | 1.57 | 0.65 | 3.77 | A |
| | | | Gen | AG_vs_GG | 0.002 | 1.6 | 1.18 | 2.17 | A |
| | | MEGA1 | Gen | AA_vs_GG | 0.075 | 1.52 | 0.96 | 2.4 | A |
| | | | Gen | AG_vs_GG | 0.085 | 1.15 | 0.98 | 1.35 | A |
| hCV30690777 | AKT3 (rs12045585) | MEGA1 | add | A_vs_G | 0.002 | 1.25 | 1.08 | 1.43 | A |
| | | LETS | add | A_vs_G | 0.035 | 1.32 | 1.02 | 1.72 | A |
| | | LETS | Gen | AA_vs_GG | 0.36 | 1.54 | 0.61 | 3.88 | A |
| | | | Gen | AG_vs_GG | 0.045 | 1.36 | 1.01 | 1.83 | A |
| | | MEGA1 | Gen | AA_vs_GG | 0.017 | 1.85 | 1.12 | 3.07 | A |
| | | | Gen | AG_vs_GG | 0.021 | 1.21 | 1.03 | 1.42 | A |
| hCV31523650 | KT3 (rs12048930) | LETS | add | T_vs_C | 1E−03 | 1.47 | 1.17 | 1.86 | T |
| | | MEGA1 | add | T_vs_C | 0.026 | 1.15 | 1.02 | 1.29 | T |
| | | LETS | Gen | TC_vs_CC | 0.003 | 1.55 | 1.17 | 2.06 | T |
| | | | Gen | TT_vs_CC | 0.053 | 1.9 | 0.99 | 3.64 | T |
| | | MEGA1 | Gen | TC_vs_CC | 0.032 | 1.18 | 1.01 | 1.38 | T |
| | | | Gen | TT_vs_CC | 0.228 | 1.22 | 0.88 | 1.7 | T |
| hCV30690778 | KT3 (rs12140414) | LETS | add | C_vs_T | 0.003 | 1.44 | 1.14 | 1.82 | C |
| | | MEGA1 | add | C_vs_T | 0.04 | 1.14 | 1.01 | 1.3 | C |
| | | LETS | Gen | CC_vs_TT | 0.23 | 1.53 | 0.76 | 3.08 | C |
| | | | Gen | CT_vs_TT | 0.002 | 1.58 | 1.19 | 2.1 | C |
| | | MEGA1 | Gen | CC_vs_TT | 0.027 | 1.54 | 1.05 | 2.26 | C |
| | | | Gen | CT_vs_TT | 0.283 | 1.09 | 0.93 | 1.27 | C |
| hCV31523608 | KT3 (rs12744297) | MEGA1 | add | G_vs_A | 0.001 | 1.19 | 1.07 | 1.32 | G |
| | | LETS | add | G_vs_A | 0.006 | 1.32 | 1.08 | 1.61 | G |
| | | LETS | Gen | GA_vs_AA | 0.021 | 1.39 | 1.05 | 1.84 | G |
| | | | Gen | GG_vs_AA | 0.026 | 1.65 | 1.06 | 2.57 | G |
| | | MEGA1 | Gen | GA_vs_AA | 0.013 | 1.21 | 1.04 | 1.41 | G |
| | | | Gen | GG_vs_AA | 0.004 | 1.39 | 1.11 | 1.75 | G |
| hCV233148 | AKT3 (rs1417121) | LETS | add | C_vs_G | 3E−04 | 1.45 | 1.18 | 1.78 | C |
| | | MEGA1 | add | C_vs_G | 0.001 | 1.2 | 1.08 | 1.33 | C |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | CC_vs_GG | 0.004 | 2.02 | 1.25 | 3.27 | C |
| | | | Gen | CG_vs_GG | 0.004 | 1.5 | 1.14 | 1.98 | C |
| | | MEGA1 | Gen | CC_vs_GG | 3E−05 | 1.71 | 1.33 | 2.2 | C |
| | | | Gen | CG_vs_GG | 0.591 | 1.04 | 0.9 | 1.21 | C |
| hCV12073840 | AKT3 (rs14403) | LETS | Gen | TC_vs_CC | 0.004 | 1.5 | 1.14 | 1.98 | T |
| | | MEGA1 | Gen | TT_vs_CC | 0.028 | 1.42 | 1.04 | 1.93 | T |
| | | LETS | Gen | TC_vs_CC | 0.004 | 1.5 | 1.14 | 1.98 | T |
| | | | Gen | TT_vs_CC | 0.169 | 1.49 | 0.84 | 2.63 | T |
| | | MEGA1 | Gen | TC_vs_CC | 0.808 | 1.02 | 0.88 | 1.18 | T |
| | | | Gen | TT_vs_CC | 0.028 | 1.42 | 1.04 | 1.93 | T |
| hCV1678674 | AKT3 (rs1458023) | LETS | add | C_vs_T | 4E−04 | 1.5 | 1.2 | 1.88 | C |
| | | MEGA1 | add | C_vs_T | 0.006 | 1.18 | 1.05 | 1.33 | C |
| | | LETS | Gen | CC_vs_TT | 0.015 | 2.12 | 1.16 | 3.88 | C |
| | | | Gen | CT_vs_TT | 0.003 | 1.54 | 1.16 | 2.06 | C |
| | | MEGA1 | Gen | CC_vs_TT | 0.057 | 1.37 | 0.99 | 1.88 | C |
| | | | Gen | CT_vs_TT | 0.021 | 1.2 | 1.03 | 1.4 | C |
| hCV97631 | AKT3 (rs1538773) | LETS | add | G_vs_T | 1E−04 | 1.55 | 1.24 | 1.92 | G |
| | | MEGA1 | add | G_vs_T | 0.006 | 1.18 | 1.05 | 1.32 | G |
| | | LETS | Gen | GG_vs_TT | 0.009 | 2.14 | 1.21 | 3.77 | G |
| | | | Gen | GT_vs_TT | 6E−04 | 1.63 | 1.23 | 2.16 | G |
| | | MEGA1 | Gen | GG_vs_TT | 0.003 | 1.59 | 1.18 | 2.14 | G |
| | | | Gen | GT_vs_TT | 0.224 | 1.1 | 0.94 | 1.28 | G |
| hCV8688111 | AKT3 (rs1578275) | LETS | add | C_vs_G | 0.001 | 1.49 | 1.17 | 1.89 | C |
| | | MEGA1 | add | C_vs_G | 0.047 | 1.14 | 1 | 1.29 | C |
| | | LETS | Gen | CC_vs_GG | 0.064 | 2 | 0.96 | 4.18 | C |
| | | | Gen | CG_vs_GG | 0.004 | 1.53 | 1.15 | 2.04 | C |
| | | MEGA1 | Gen | CC_vs_GG | 0.036 | 1.51 | 1.03 | 2.22 | C |
| | | | Gen | CG_vs_GG | 0.291 | 1.09 | 0.93 | 1.27 | C |
| hCV15885425 | AKT3 (rs2290754) | LETS | add | C_vs_A | 1E−04 | 1.57 | 1.24 | 1.97 | C |
| | | MEGA1 | add | C_vs_A | 0.019 | 1.15 | 1.02 | 1.3 | C |
| | | LETS | Gen | CA_vs_AA | 0.001 | 1.62 | 1.21 | 2.15 | C |
| | | | Gen | CC_vs_AA | 0.015 | 2.25 | 1.17 | 4.32 | C |
| | | MEGA1 | Gen | CA_vs_AA | 0.026 | 1.19 | 1.02 | 1.39 | C |
| | | | Gen | CC_vs_AA | 0.184 | 1.24 | 0.9 | 1.72 | C |
| hCV1678682 | AKT3 (rs320339) | LETS | add | T_vs_G | 3E−04 | 1.51 | 1.21 | 1.9 | T |
| | | MEGA1 | add | T_vs_G | 0.002 | 1.21 | 1.07 | 1.37 | T |
| | | LETS | Gen | TG_vs_GG | 0.002 | 1.59 | 1.19 | 2.13 | T |
| | | | Gen | TT_vs_GG | 0.021 | 2.04 | 1.11 | 3.75 | T |
| | | MEGA1 | Gen | TG_vs_GG | 0.04 | 1.18 | 1.01 | 1.37 | T |
| | | | Gen | TT_vs_GG | 0.006 | 1.57 | 1.14 | 2.17 | T |
| hCV29210363 | AKT3 (rs6656918) | LETS | add | G_vs_A | 5E−05 | 1.56 | 1.26 | 1.94 | G |
| | | MEGA1 | add | G_vs_A | 0.003 | 1.19 | 1.06 | 1.34 | G |
| | | LETS | Gen | GA_vs_AA | 6E−04 | 1.64 | 1.24 | 2.17 | G |
| | | | Gen | GG_vs_AA | 0.004 | 2.24 | 1.29 | 3.9 | G |
| | | MEGA1 | Gen | GA_vs_AA | 0.289 | 1.09 | 0.93 | 1.26 | G |
| | | | Gen | GG_vs_AA | 4E−04 | 1.69 | 1.26 | 2.27 | G |
| hCV31523643 | AKT3 (rs6671475) | LETS | add | G_vs_A | 4E−04 | 1.52 | 1.21 | 1.91 | G |
| | | MEGA1 | add | G_vs_A | 0.014 | 1.16 | 1.03 | 1.31 | G |
| | | LETS | Gen | GA_vs_AA | 0.003 | 1.55 | 1.16 | 2.06 | G |
| | | | Gen | GG_vs_AA | 0.018 | 2.2 | 1.14 | 4.22 | G |
| | | MEGA1 | Gen | GA_vs_AA | 0.038 | 1.18 | 1.01 | 1.37 | G |
| | | | Gen | GG_vs_AA | 0.1 | 1.32 | 0.95 | 1.82 | G |
| hCV26719113 | AKT3 (rs7517340) | LETS | add | T_vs_C | 2E−04 | 1.58 | 1.24 | 2 | T |
| | | MEGA1 | add | T_vs_C | 0.003 | 1.2 | 1.07 | 1.36 | T |
| | | LETS | Gen | TC_vs_CC | 2E−04 | 1.76 | 1.31 | 2.36 | T |
| | | | Gen | TT_vs_CC | 0.061 | 1.87 | 0.97 | 3.59 | T |
| | | MEGA1 | Gen | TC_vs_CC | 0.074 | 1.15 | 0.99 | 1.35 | T |
| | | | Gen | TT_vs_CC | 0.005 | 1.62 | 1.15 | 2.27 | T |
| hCV26034142 | AKT3 (rs9428576) | LETS | add | C_vs_T | 0.025 | 1.23 | 1.03 | 1.47 | C |
| | | MEGA1 | rec | CC_vs_CT + TT | 0.01 | 1.26 | 1.06 | 1.49 | C |
| | | LETS | Gen | CC_vs_TT | 0.029 | 1.49 | 1.04 | 2.15 | C |
| | | | Gen | CT_vs_TT | 0.067 | 1.33 | 0.98 | 1.81 | C |
| | | MEGA1 | Gen | CC_vs_TT | 0.066 | 1.21 | 0.99 | 1.48 | C |
| | | | Gen | CT_vs_TT | 0.454 | 0.94 | 0.8 | 1.11 | C |
| hCV2303891 | POH (rs1801690) | MEGA1 | add | C_vs_G | 0.007 | 1.38 | 1.09 | 1.76 | C |
| | | LETS | add | C_vs_G | 0.042 | 1.65 | 1.02 | 2.68 | C |
| | | LETS | Gen | CC_vs_GG | 0.969 | 291630 | #### | #### | C |
| | | | Gen | CG_vs_GG | 0.97 | 188937 | #### | #### | C |
| | | MEGA1 | Gen | CC_vs_GG | 0.528 | 0.62 | 0.14 | 2.76 | C |
| | | | Gen | CG_vs_GG | 0.263 | 0.42 | 0.09 | 1.92 | C |
| hCV2456747 | Corf114 (rs3820059) | MEGA1 | add | A_vs_G | 1E−04 | 1.22 | 1.1 | 1.35 | A |
| | | LETS | add | A_vs_G | 0.004 | 1.34 | 1.1 | 1.64 | A |
| | | LETS | Gen | AA_vs_GG | 0.035 | 1.61 | 1.03 | 2.51 | A |
| | | | Gen | AG_vs_GG | 0.005 | 1.49 | 1.13 | 1.98 | A |
| | | MEGA1 | Gen | AA_vs_GG | 1E−03 | 1.45 | 1.16 | 1.8 | A |
| | | | Gen | AG_vs_GG | 0.002 | 1.27 | 1.09 | 1.48 | A |
| hCV2403368 | QTNF6 (rs2295261) | LETS | rec | GG_vs_GC + CC | 0.02 | 1.37 | 1.05 | 1.79 | G |
| | | MEGA1 | rec | GG_vs_GC + CC | 0.033 | 1.17 | 1.01 | 1.35 | G |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | GC_vs_CC | 0.521 | 0.82 | 0.46 | 1.49 | G |
| | | | Gen | GG_vs_CC | 0.615 | 1.16 | 0.65 | 2.06 | G |
| | | MEGA1 | Gen | GC_vs_CC | 0.911 | 0.98 | 0.72 | 1.35 | G |
| | | | Gen | GG_vs_CC | 0.371 | 1.15 | 0.85 | 1.56 | G |
| hCV7574127 | Corf167 (rs1737145) | LETS | add | A_vs_G | 0.091 | 1.18 | 0.97 | 1.43 | A |
| | | MEGA1 | add | A_vs_G | 0.009 | 1.14 | 1.03 | 1.26 | A |
| | | LETS | Gen | AA_vs_GG | 0.097 | 1.38 | 0.94 | 2.03 | A |
| | | | Gen | AG_vs_GG | 0.414 | 1.16 | 0.82 | 1.64 | A |
| | | MEGA1 | Gen | AA_vs_GG | 0.01 | 1.3 | 1.07 | 1.58 | A |
| | | | Gen | AG_vs_GG | 0.164 | 1.14 | 0.95 | 1.36 | A |
| hCV25959498 | Corf46 (rs34518648) | LETS | add | G_vs_A | 0.034 | 1.48 | 1.03 | 2.14 | G |
| | | MEGA1 | add | G_vs_A | 0.038 | 1.22 | 1.01 | 1.47 | G |
| | | LETS | Gen | GA_vs_AA | 0.166 | 4.57 | 0.53 | 39.2 | G |
| | | | Gen | GG_vs_AA | 0.093 | 6.16 | 0.74 | 51.3 | G |
| | | MEGA1 | Gen | GA_vs_AA | 0.159 | 1.98 | 0.77 | 5.12 | G |
| | | | Gen | GG_vs_AA | 0.079 | 2.31 | 0.91 | 5.88 | G |
| hCV25959466 | Corf46 (rs35495590) | MEGA1 | add | T_vs_C | 0.03 | 1.23 | 1.02 | 1.48 | T |
| | | LETS | add | T_vs_C | 0.048 | 1.45 | 1 | 2.1 | T |
| | | LETS | Gen | TC_vs_CC | 0.229 | 3.81 | 0.43 | 33.7 | T |
| | | | Gen | TT_vs_CC | 0.137 | 5.12 | 0.6 | 44 | T |
| | | MEGA1 | Gen | TC_vs_CC | 0.206 | 1.78 | 0.73 | 4.35 | T |
| | | | Gen | TT_vs_CC | 0.096 | 2.11 | 0.88 | 5.06 | T |
| hCV25768636 | CCDC36 (rs4279134) | MEGA1 | rec | AA_vs_AG + GG | 0.033 | 1.26 | 1.02 | 1.56 | A |
| | | LETS | rec | AA_vs_AG + GG | 0.036 | 1.53 | 1.03 | 2.27 | A |
| | | LETS | Gen | AA_vs_GG | 0.022 | 1.63 | 1.07 | 2.49 | A |
| | | | Gen | AG_vs_GG | 0.359 | 1.14 | 0.86 | 1.51 | A |
| | | MEGA1 | Gen | AA_vs_GG | 0.033 | 1.28 | 1.02 | 1.61 | A |
| | | | Gen | AG_vs_GG | 0.698 | 1.03 | 0.89 | 1.2 | A |
| hCV25991132 | CCDC41 ( ) | MEGA1 | rec | GG_vs_GA + AA | 0.018 | 1.26 | 1.04 | 1.53 | G |
| | | LETS | rec | GG_vs_GA + AA | 0.041 | 1.46 | 1.02 | 2.1 | G |
| | | LETS | Gen | GA_vs_AA | 0.236 | 3.72 | 0.42 | 32.7 | G |
| | | | Gen | GG_vs_AA | 0.134 | 5.19 | 0.6 | 44.6 | G |
| | | MEGA1 | Gen | GA_vs_AA | 0.013 | 0.29 | 0.11 | 0.77 | G |
| | | | Gen | GG_vs_AA | 0.052 | 0.38 | 0.14 | 1.01 | G |
| hCV3164397 | CMYA5 (rs10043986) | LETS | rec | CC_vs_CT + TT | 0.004 | 1.55 | 1.15 | 2.08 | C |
| | | MEGA1 | dom | CC + CT_vs_TT | 0.015 | 2.28 | 1.18 | 4.42 | C |
| | | LETS | Gen | CC_vs_TT | 0.959 | 0.98 | 0.37 | 2.56 | C |
| | | | Gen | CT_vs_TT | 0.323 | 0.61 | 0.23 | 1.63 | C |
| | | MEGA1 | Gen | CC_vs_TT | 0.017 | 2.24 | 1.16 | 4.35 | C |
| | | | Gen | CT_vs_TT | 0.01 | 2.41 | 1.23 | 4.73 | C |
| hCV3230083 | CYP4V2 (rs10013653) | MEGA1 | Gen | AC_vs_CC | 4E-04 | 1.35 | 1.14 | 1.59 | A |
| | | LETS | Gen | AC_vs_CC | 0.048 | 1.37 | 1 | 1.86 | A |
| | | LETS | Gen | AA_vs_CC | 0.342 | 1.2 | 0.83 | 1.74 | A |
| | | | Gen | AC_vs_CC | 0.048 | 1.37 | 1 | 1.86 | A |
| | | MEGA1 | Gen | AA_vs_CC | 0.002 | 1.39 | 1.13 | 1.7 | A |
| | | | Gen | AC_vs_CC | 4E-04 | 1.35 | 1.14 | 1.59 | A |
| hCV25990131 | CYP4V2 (rs13146272) | MEGA1 | add | A_vs_C | 0.001 | 1.19 | 1.07 | 1.32 | A |
| | | LETS | add | A_vs_C | 0.049 | 1.22 | 1 | 1.49 | A |
| | | LETS | Gen | AA_vs_CC | 0.003 | 2.03 | 1.27 | 3.24 | A |
| | | | Gen | AC_vs_CC | 0.001 | 2.18 | 1.36 | 3.48 | A |
| | | MEGA1 | Gen | AA_vs_CC | 0.006 | 1.38 | 1.1 | 1.74 | A |
| | | | Gen | AC_vs_CC | 0.251 | 1.15 | 0.91 | 1.44 | A |
| hCV15968043 | CYP4V2 (rs2292423) | MEGA1 | dom | AA + AT_vs_TT | 2E-04 | 1.33 | 1.14 | 1.55 | A |
| | | LETS | dom | AA + AT_vs_TT | 0.043 | 1.34 | 1.01 | 1.78 | A |
| | | LETS | Gen | AA_vs_TT | 0.14 | 1.32 | 0.91 | 1.92 | A |
| | | | Gen | AT_vs_TT | 0.052 | 1.35 | 1 | 1.83 | A |
| | | MEGA1 | Gen | AA_vs_TT | 1E-04 | 1.49 | 1.21 | 1.83 | A |
| | | | Gen | AT_vs_TT | 0.003 | 1.27 | 1.08 | 1.5 | A |
| hCV3230096 | CYP4V2 (rs3817184) | LETS | dom | TT + TC_vs_CC | 0.058 | 1.32 | 0.99 | 1.76 | T |
| | | MEGA1 | dom | TT + TC_vs_CC | 0.003 | 1.26 | 1.08 | 1.47 | T |
| | | LETS | Gen | TC_vs_CC | 0.063 | 1.34 | 0.98 | 1.81 | T |
| | | | Gen | TT_vs_CC | 0.193 | 1.28 | 0.88 | 1.86 | T |
| | | MEGA1 | Gen | TC_vs_CC | 0.027 | 1.2 | 1.02 | 1.41 | T |
| | | | Gen | TT_vs_CC | 5E-04 | 1.43 | 1.17 | 1.75 | T |
| hCV11786147 | CYP4V2 (rs4862662) | LETS | dom | TT + TG_vs_GG | 0.052 | 1.33 | 1 | 1.77 | T |
| | | MEGA1 | dom | TT + TG_vs_GG | 0.003 | 1.26 | 1.09 | 1.47 | T |
| | | LETS | Gen | TG_vs_GG | 0.06 | 1.34 | 0.99 | 1.82 | T |
| | | | Gen | TT_vs_GG | 0.164 | 1.31 | 0.9 | 1.9 | T |
| | | MEGA1 | Gen | TG_vs_GG | 0.018 | 1.22 | 1.03 | 1.43 | T |
| | | | Gen | TT_vs_GG | 0.001 | 1.4 | 1.14 | 1.72 | T |
| hCV3230084 | CYP4V2 (rs7682918) | MEGA1 | Gen | TC_vs_CC | 0.002 | 1.29 | 1.1 | 1.51 | T |
| | | LETS | Gen | TC_vs_CC | 0.031 | 1.39 | 1.03 | 1.88 | T |
| | | LETS | Gen | TC_vs_CC | 0.031 | 1.39 | 1.03 | 1.88 | T |
| | | | Gen | TT_vs_CC | 0.792 | 1.05 | 0.71 | 1.55 | T |
| | | MEGA1 | Gen | TC_vs_CC | 0.002 | 1.29 | 1.1 | 1.51 | T |
| | | | Gen | TT_vs_CC | 0.009 | 1.32 | 1.07 | 1.63 | T |
| hCV26265231 | CYP4V2 (rs7684025) | MEGA1 | dom | AA + AG_vs_GG | 8E-04 | 1.32 | 1.12 | 1.55 | A |
| | | LETS | dom | AA + AG_vs_GG | 0.017 | 1.44 | 1.07 | 1.95 | A |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | AA_vs_GG | 0.114 | 1.34 | 0.93 | 1.94 | A |
| | | | Gen | AG_vs_GG | 0.013 | 1.5 | 1.09 | 2.07 | A |
| | | MEGA1 | Gen | AA_vs_GG | 6E-04 | 1.43 | 1.16 | 1.75 | A |
| | | | Gen | AG_vs_GG | 0.006 | 1.27 | 1.07 | 1.51 | A |
| hCV9860072 | DHX38 (rs1050362) | LETS | Gen | AC_vs_CC | 0.013 | 1.43 | 1.08 | 1.91 | A |
| | | MEGA1 | Gen | AA_vs_CC | 0.042 | 1.26 | 1.01 | 1.57 | A |
| | | LETS | Gen | AA_vs_CC | 0.289 | 1.25 | 0.83 | 1.88 | A |
| | | | Gen | AC_vs_CC | 0.013 | 1.43 | 1.08 | 1.91 | A |
| | | MEGA1 | Gen | AA_vs_CC | 0.042 | 1.26 | 1.01 | 1.57 | A |
| | | | Gen | AC_vs_CC | 0.385 | 1.07 | 0.92 | 1.25 | A |
| hCV2103346 | DKFZP564J102 (rs11733307) | LETS | rec | CC_vs_CT + TT | 0.016 | 1.5 | 1.08 | 2.08 | C |
| | | MEGA1 | dom | CC + CT_vs_TT | 0.021 | 1.2 | 1.03 | 1.4 | C |
| | | LETS | Gen | CC_vs_TT | 0.108 | 1.36 | 0.94 | 1.98 | C |
| | | | Gen | CT_vs_TT | 0.286 | 0.85 | 0.63 | 1.15 | C |
| | | MEGA1 | Gen | CC_vs_TT | 0.036 | 1.24 | 1.01 | 1.52 | C |
| | | | Gen | CT_vs_TT | 0.045 | 1.18 | 1 | 1.4 | C |
| hCV12086148 | DKFZP564J102 (rs1877321) | LETS | rec | GG_vs_GA + AA | 0.065 | 1.29 | 0.98 | 1.69 | G |
| | | MEGA1 | Gen | GG_vs_AA | 0.027 | 1.47 | 1.04 | 2.06 | G |
| | | LETS | Gen | GA_vs_AA | 0.613 | 0.86 | 0.47 | 1.56 | G |
| | | | Gen | GG_vs_AA | 0.69 | 1.13 | 0.63 | 2.02 | G |
| | | MEGA1 | Gen | GA_vs_AA | 0.056 | 1.4 | 0.99 | 1.99 | G |
| | | | Gen | GG_vs_AA | 0.027 | 1.47 | 1.04 | 2.06 | G |
| hCV25473516 | DUSSP11 (rs2272051) | LETS | Gen | TT_vs_CC | 0.074 | 1.46 | 0.96 | 2.22 | T |
| | | MEGA1 | Gen | TT_vs_CC | 0.011 | 1.33 | 1.07 | 1.67 | T |
| | | LETS | Gen | TC_vs_CC | 0.698 | 1.06 | 0.8 | 1.41 | T |
| | | | Gen | TT_vs_CC | 0.074 | 1.46 | 0.96 | 2.22 | T |
| | | MEGA1 | Gen | TC_vs_CC | 0.355 | 1.07 | 0.92 | 1.25 | T |
| | | | Gen | TT_vs_CC | 0.011 | 1.33 | 1.07 | 1.67 | T |
| hCV15871021 | EBF1 (rs2072495) | LETS | rec | GG_vs_GA + AA | 0.013 | 1.41 | 1.08 | 1.86 | G |
| | | MEGA1 | dom | GG + GA_vs_AA | 0.007 | 1.33 | 1.08 | 1.63 | G |
| | | LETS | Gen | GA_vs_AA | 0.157 | 0.76 | 0.51 | 1.11 | G |
| | | | Gen | GG_vs_AA | 0.506 | 1.15 | 0.77 | 1.71 | G |
| | | MEGA1 | Gen | GA_vs_AA | 0.008 | 1.34 | 1.08 | 1.67 | G |
| | | | Gen | GG_vs_AA | 0.019 | 1.31 | 1.04 | 1.64 | G |
| hCV491830 | EPS8L2 (rs3087546) | LETS | add | T_vs_C | 0.018 | 1.26 | 1.04 | 1.52 | T |
| | | MEGA1 | add | T_vs_C | 0.027 | 1.12 | 1.01 | 1.24 | T |
| | | LETS | Gen | TC_vs_CC | 0.437 | 1.15 | 0.81 | 1.65 | T |
| | | | Gen | TT_vs_CC | 0.026 | 1.54 | 1.05 | 2.26 | T |
| | | MEGA1 | Gen | TC_vs_CC | 0.041 | 1.22 | 1.01 | 1.49 | T |
| | | | Gen | TT_vs_CC | 0.017 | 1.28 | 1.04 | 1.57 | T |
| hCV2017876 | EPS8L3 (rs3818562) | LETS | add | G_vs_A | 0.069 | 1.18 | 0.99 | 1.42 | G |
| | | MEGA1 | add | G_vs_A | 0.025 | 1.12 | 1.01 | 1.24 | G |
| | | LETS | Gen | GA_vs_AA | 0.572 | 1.1 | 0.79 | 1.54 | G |
| | | | Gen | GG_vs_AA | 0.077 | 1.39 | 0.97 | 1.99 | G |
| | | MEGA1 | Gen | GA_vs_AA | 0.498 | 1.07 | 0.89 | 1.28 | G |
| | | | Gen | GG_vs_AA | 0.03 | 1.25 | 1.02 | 1.53 | G |
| hCV12066124 | F11 (rs2036914) | MEGA1 | add | C_vs_T | 2E-07 | 1.31 | 1.18 | 1.44 | C |
| | | LETS | add | C_vs_T | 0.013 | 1.27 | 1.05 | 1.53 | C |
| | | LETS | Gen | CC_vs_TT | 0.01 | 1.65 | 1.13 | 2.42 | C |
| | | | Gen | CT_vs_TT | 0.053 | 1.43 | 1 | 2.05 | C |
| | | MEGA1 | Gen | CC_vs_TT | 2E-07 | 1.73 | 1.41 | 2.12 | C |
| | | | Gen | CT_vs_TT | 9E-04 | 1.38 | 1.14 | 1.66 | C |
| hCV16172935 | F11 (rs2241817) | LETS | rec | AA_vs_AG + GG | 0.075 | 1.27 | 0.98 | 1.66 | A |
| | | MEGA1 | rec | AA_vs_AG + GG | 0.032 | 1.17 | 1.01 | 1.35 | A |
| | | LETS | Gen | AA_vs_GG | 0.962 | 0.99 | 0.64 | 1.54 | A |
| | | | Gen | AG_vs_GG | 0.167 | 0.73 | 0.47 | 1.14 | A |
| | | MEGA1 | Gen | AA_vs_GG | 0.01 | 1.37 | 1.08 | 1.74 | A |
| | | | Gen | AG_vs_GG | 0.102 | 1.22 | 0.96 | 1.54 | A |
| hCV3230038 | F11 (rs2289252) | LETS | add | T_vs_C | 0.061 | 1.19 | 0.99 | 1.42 | T |
| | | MEGA1 | add | T_vs_C | ##### | 1.34 | 1.21 | 1.48 | T |
| | | LETS | Gen | TC_vs_CC | 0.165 | 1.24 | 0.92 | 1.68 | T |
| | | | Gen | TT_vs_CC | 0.069 | 1.4 | 0.97 | 2.01 | T |
| | | MEGA1 | Gen | TC_vs_CC | 2E-05 | 1.43 | 1.21 | 1.69 | T |
| | | | Gen | TT_vs_CC | 4E-08 | 1.78 | 1.45 | 2.18 | T |
| hCV27474895 | F11 (rs3756011) | MEGA1 | add | A_vs_C | ##### | 1.32 | 1.19 | 1.46 | A |
| | | LETS | add | A_vs_C | 0.035 | 1.21 | 1.01 | 1.45 | A |
| | | LETS | Gen | AA_vs_CC | 0.043 | 1.45 | 1.01 | 2.09 | A |
| | | | Gen | AC_vs_CC | 0.089 | 1.3 | 0.96 | 1.76 | A |
| | | MEGA1 | Gen | AA_vs_CC | 1E-07 | 1.73 | 1.41 | 2.12 | A |
| | | | Gen | AC_vs_CC | 2E-04 | 1.37 | 1.16 | 1.61 | A |
| hCV25474413 | F11 (rs3822057) | LETS | Gen | CC_vs_AA | 0.061 | 1.42 | 0.98 | 2.05 | C |
| | | MEGA1 | Gen | CC_vs_AA | 2E-06 | 1.63 | 1.33 | 2 | C |
| | | LETS | Gen | CA_vs_AA | 0.146 | 1.28 | 0.92 | 1.79 | C |
| | | | Gen | CC_vs_AA | 0.061 | 1.42 | 0.98 | 2.05 | C |
| | | MEGA1 | Gen | CA_vs_AA | 0.002 | 1.34 | 1.12 | 1.6 | C |
| | | | Gen | CC_vs_AA | 2E-06 | 1.63 | 1.33 | 2 | C |
| hCV27490984 | F11 (rs3822058) | LETS | rec | GG_vs_GA + AA | 0.076 | 1.27 | 0.98 | 1.66 | G |
| | | MEGA1 | rec | GG_vs_GA + AA | 0.022 | 1.18 | 1.02 | 1.36 | G |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | GA_vs_AA | 0.108 | 0.7 | 0.45 | 1.08 | G |
| | | | Gen | GG_vs_AA | 0.831 | 0.95 | 0.61 | 1.48 | G |
| | | MEGA1 | Gen | GA_vs_AA | 0.059 | 1.26 | 0.99 | 1.6 | G |
| | | | Gen | GG_vs_AA | 0.004 | 1.42 | 1.12 | 1.81 | G |
| hCV25474414 | F11 (rs4253399) | MEGA1 | add | G_vs_T | 5E−07 | 1.3 | 1.17 | 1.44 | G |
| | | LETS | add | G_vs_T | 0.023 | 1.23 | 1.03 | 1.48 | G |
| | | LETS | Gen | GG_vs_TT | 0.038 | 1.48 | 1.02 | 2.15 | G |
| | | | Gen | GT_vs_TT | 0.049 | 1.35 | 1 | 1.81 | G |
| | | MEGA1 | Gen | GG_vs_TT | 6E−07 | 1.7 | 1.38 | 2.09 | G |
| | | | Gen | GT_vs_TT | 0.003 | 1.28 | 1.09 | 1.5 | G |
| hCV26038139 | F11 (rs4253405) | MEGA1 | Gen | AG_vs_GG | 0.006 | 1.39 | 1.1 | 1.74 | A |
| | | LETS | Gen | AG_vs_GG | 0.048 | 0.66 | 0.43 | 1 | A |
| | | LETS | Gen | AA_vs_GG | 0.767 | 0.94 | 0.62 | 1.43 | A |
| | | | Gen | AG_vs_GG | 0.048 | 0.66 | 0.43 | 1 | A |
| | | MEGA1 | Gen | AA_vs_GG | 3E−04 | 1.54 | 1.22 | 1.95 | A |
| | | | Gen | AG_vs_GG | 0.006 | 1.39 | 1.1 | 1.74 | A |
| hCV3230119 | F11 (rs4253430) | LETS | rec | GG_vs_GC + CC | 0.052 | 1.3 | 1 | 1.7 | G |
| | | MEGA1 | rec | GG_vs_GC + CC | 0.038 | 1.16 | 1.01 | 1.34 | G |
| | | LETS | Gen | GC_vs_CC | 0.222 | 0.76 | 0.49 | 1.18 | G |
| | | | Gen | GG_vs_CC | 0.845 | 1.04 | 0.67 | 1.62 | G |
| | | MEGA1 | Gen | GC_vs_CC | 0.062 | 1.25 | 0.99 | 1.59 | G |
| | | | Gen | GG_vs_CC | 0.006 | 1.4 | 1.1 | 1.77 | G |
| hCV8241630 | F11 (rs925451) | MEGA1 | add | A_vs_G | ##### | 1.32 | 1.2 | 1.46 | A |
| | | LETS | add | A_vs_G | 0.045 | 1.2 | 1 | 1.44 | A |
| | | LETS | Gen | AA_vs_GG | 0.078 | 1.39 | 0.96 | 2.01 | A |
| | | | Gen | AG_vs_GG | 0.029 | 1.39 | 1.03 | 1.88 | A |
| | | MEGA1 | Gen | AA_vs_GG | 1E−07 | 1.75 | 1.42 | 2.15 | A |
| | | | Gen | AG_vs_GG | 3E−04 | 1.34 | 1.14 | 1.57 | A |
| hCV8726802 | F2 (rs1799963) | MEGA1 | add | A_vs_G | 2E−07 | 2.85 | 1.92 | 4.24 | A |
| | | LETS | add | A_vs_G | 0.003 | 3 | 1.44 | 6.26 | A |
| | | LETS | Gen | AG_vs_GG | 0.003 | 3 | 1.44 | 6.26 | A |
| | | MEGA1 | Gen | AG_vs_GG | 2E−07 | 2.85 | 1.92 | 4.24 | A |
| hCV27480803 | F5 (rs3766103) | MEGA1 | add | C_vs_T | 4E−04 | 1.2 | 1.08 | 1.32 | C |
| | | LETS | add | C_vs_T | 0.017 | 1.26 | 1.04 | 1.52 | C |
| | | LETS | Gen | CC_vs_TT | 0.015 | 1.61 | 1.1 | 2.36 | C |
| | | | Gen | CT_vs_TT | 0.25 | 1.19 | 0.88 | 1.61 | C |
| | | MEGA1 | Gen | CC_vs_TT | 3E−04 | 1.44 | 1.18 | 1.75 | C |
| | | | Gen | CT_vs_TT | 0.107 | 1.15 | 0.97 | 1.35 | C |
| hCV8919444 | F5 (rs4524) | MEGA1 | add | T_vs_C | 1E−04 | 1.26 | 1.12 | 1.42 | T |
| | | LETS | add | T_vs_C | 0.006 | 1.36 | 1.09 | 1.69 | T |
| | | LETS | Gen | TC_vs_CC | 0.931 | 1.03 | 0.58 | 1.83 | T |
| | | | Gen | TT_vs_CC | 0.13 | 1.54 | 0.88 | 2.68 | T |
| | | MEGA1 | Gen | TC_vs_CC | 0.565 | 0.91 | 0.66 | 1.25 | T |
| | | | Gen | TT_vs_CC | 0.124 | 1.27 | 0.94 | 1.73 | T |
| hCV8919442 | F5 (rs4525) | MEGA1 | add | T_vs_C | 5E−05 | 1.28 | 1.14 | 1.44 | T |
| | | LETS | add | T_vs_C | 0.01 | 1.33 | 1.07 | 1.66 | T |
| | | LETS | Gen | TC_vs_CC | 0.846 | 0.94 | 0.53 | 1.68 | T |
| | | | Gen | TT_vs_CC | 0.216 | 1.42 | 0.82 | 2.47 | T |
| | | MEGA1 | Gen | TC_vs_CC | 0.562 | 0.91 | 0.66 | 1.25 | T |
| | | | Gen | TT_vs_CC | 0.103 | 1.29 | 0.95 | 1.77 | T |
| hCV8919451 | F5 (rs6016) | MEGA1 | add | G_vs_A | 6E−05 | 1.27 | 1.13 | 1.43 | G |
| | | LETS | add | G_vs_A | 0.006 | 1.35 | 1.09 | 1.69 | G |
| | | LETS | Gen | GA_vs_AA | 0.967 | 0.99 | 0.55 | 1.76 | G |
| | | | Gen | GG_vs_AA | 0.163 | 1.49 | 0.85 | 2.6 | G |
| | | MEGA1 | Gen | GA_vs_AA | 0.414 | 0.88 | 0.64 | 1.2 | G |
| | | | Gen | GG_vs_AA | 0.141 | 1.26 | 0.93 | 1.71 | G |
| hCV2288095 | F9 (rs378815) | LETS | Gen | CC_vs_TT | 0.02 | 1.5 | 1.07 | 2.11 | C |
| | | MEGA1 | Gen | CT_vs_TT | 0.048 | 1.23 | 1 | 1.52 | C |
| | | LETS | Gen | CC_vs_TT | 0.02 | 1.5 | 1.07 | 2.11 | C |
| | | | Gen | CT_vs_TT | 0.282 | 1.24 | 0.84 | 1.82 | C |
| | | MEGA1 | Gen | CC_vs_TT | 0.177 | 1.13 | 0.95 | 1.34 | C |
| | | | Gen | CT_vs_TT | 0.048 | 1.23 | 1 | 1.52 | C |
| hCV596326 | F9 (rs398101) | LETS | rec | AA_vs_AG + GG | 0.006 | 1.46 | 1.12 | 1.9 | A |
| | | MEGA1 | Gen | AG_vs_GG | 0.015 | 1.31 | 1.05 | 1.64 | A |
| | | LETS | Gen | AA_vs_GG | 0.06 | 1.4 | 0.99 | 1.99 | A |
| | | | Gen | AG_vs_GG | 0.729 | 0.93 | 0.62 | 1.4 | A |
| | | MEGA1 | Gen | AA_vs_GG | 0.067 | 1.19 | 0.99 | 1.42 | A |
| | | | Gen | AG_vs_GG | 0.015 | 1.31 | 1.05 | 1.64 | A |
| hCV596330 | F9 (rs422187) | LETS | add | A_vs_C | 0.048 | 1.19 | 1 | 1.41 | A |
| | | MEGA1 | add | A_vs_C | 0.049 | 1.09 | 1 | 1.2 | A |
| | | LETS | Gen | AA_vs_CC | 0.085 | 1.37 | 0.96 | 1.96 | A |
| | | | Gen | AC_vs_CC | 0.757 | 1.07 | 0.71 | 1.61 | A |
| | | MEGA1 | Gen | AA_vs_CC | 0.016 | 1.26 | 1.04 | 1.51 | A |
| | | | Gen | AC_vs_CC | 0.008 | 1.35 | 1.08 | 1.68 | A |
| hCV596331 | F9 (rs6048) | LETS | rec | AA_vs_AG + GG | 0.016 | 1.39 | 1.06 | 1.81 | A |
| | | MEGA1 | dom | AA + AG_vs_GG | 0.014 | 1.26 | 1.05 | 1.51 | A |
| | | LETS | Gen | AA_vs_GG | 0.069 | 1.4 | 0.97 | 2 | A |
| | | | Gen | AG_vs_GG | 0.968 | 1.01 | 0.67 | 1.52 | A |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | MEGA1 | Gen | AA_vs_GG | 0.023 | 1.24 | 1.03 | 1.5 | A |
| | | | Gen | AG_vs_GG | 0.024 | 1.3 | 1.04 | 1.63 | A |
| hCV2892877 | FGA (rs6050) | LETS | add | C_vs_T | 0.058 | 1.29 | 0.99 | 1.68 | C |
| | | MEGA1 | add | C_vs_T | 5E-07 | 1.44 | 1.25 | 1.66 | C |
| | | LETS | Gen | CT_vs_TT | 0.058 | 1.29 | 0.99 | 1.68 | C |
| | | MEGA1 | Gen | CT_vs_TT | 5E-07 | 1.44 | 1.25 | 1.66 | C |
| hCV11503469 | FGG (rs2066854) | MEGA1 | add | A_vs_T | ##### | 1.41 | 1.26 | 1.57 | A |
| | | LETS | add | A_vs_T | 2E-04 | 1.48 | 1.2 | 1.83 | A |
| | | LETS | Gen | AA_vs_TT | 5E-05 | 3.01 | 1.77 | 5.11 | A |
| | | | Gen | AT_vs_TT | 0.139 | 1.23 | 0.93 | 1.62 | A |
| | | MEGA1 | Gen | AA_vs_TT | 8E-08 | 1.96 | 1.53 | 2.5 | A |
| | | | Gen | AT_vs_TT | 4E-06 | 1.42 | 1.22 | 1.65 | A |
| hCV11503414 | FGG (rs2066865) | MEGA1 | add | A_vs_G | ##### | 1.41 | 1.27 | 1.57 | A |
| | | LETS | add | A_vs_G | 4E-04 | 1.45 | 1.18 | 1.78 | A |
| | | LETS | Gen | AA_vs_GG | 8E-05 | 2.81 | 1.68 | 4.7 | A |
| | | | Gen | AG_vs_GG | 0.215 | 1.19 | 0.9 | 1.57 | A |
| | | MEGA1 | Gen | AA_vs_GG | 9E-08 | 1.97 | 1.54 | 2.53 | A |
| | | | Gen | AG_vs_GG | 5E-06 | 1.42 | 1.22 | 1.65 | A |
| hCV30505633 | GNG12 (rs7530537) | LETS | add | T_vs_C | 0.023 | 1.52 | 1.06 | 2.17 | T |
| | | MEGA1 | add | T_vs_C | 0.047 | 1.2 | 1 | 1.44 | T |
| | | LETS | Gen | TC_vs_CC | 0.078 | 1.42 | 0.96 | 2.09 | T |
| | | | Gen | TT_vs_CC | 0.124 | 5.42 | 0.63 | 46.6 | T |
| | | MEGA1 | Gen | TC_vs_CC | 0.128 | 1.17 | 0.96 | 1.43 | T |
| | | | Gen | TT_vs_CC | 0.151 | 1.74 | 0.82 | 3.68 | T |
| hCV8717873 | GP6 (rs1613662) | MEGA1 | add | A_vs_G | 0.004 | 1.21 | 1.06 | 1.38 | A |
| | | LETS | add | A_vs_G | 0.013 | 1.36 | 1.07 | 1.74 | A |
| | | LETS | Gen | AA_vs_GG | 0.07 | 2.06 | 0.94 | 4.51 | A |
| | | | Gen | AG_vs_GG | 0.282 | 1.55 | 0.7 | 3.47 | A |
| | | MEGA1 | Gen | AA_vs_GG | 0.449 | 1.16 | 0.78 | 1.73 | A |
| | | | Gen | AG_vs_GG | 0.62 | 0.9 | 0.6 | 1.36 | A |
| hCV1376342 | GP6 (rs1654416) | LETS | Gen | TT_vs_CC | 0.076 | 1.81 | 0.94 | 3.49 | T |
| | | MEGA1 | rec | TT_vs_TC + CC | 0.009 | 1.22 | 1.05 | 1.42 | T |
| | | LETS | Gen | TC_vs_CC | 0.182 | 1.59 | 0.81 | 3.13 | T |
| | | | Gen | TT_vs_CC | 0.076 | 1.81 | 0.94 | 3.49 | T |
| | | MEGA1 | Gen | TC_vs_CC | 0.647 | 0.91 | 0.62 | 1.35 | T |
| | | | Gen | TT_vs_CC | 0.545 | 1.12 | 0.77 | 1.64 | T |
| hCV8717893 | GP6 (rs1671192) | LETS | Gen | GG_vs_AA | 0.077 | 1.81 | 0.94 | 3.48 | G |
| | | MEGA1 | rec | GG_vs_GA + AA | 0.004 | 1.24 | 1.07 | 1.44 | G |
| | | LETS | Gen | GA_vs_AA | 0.182 | 1.59 | 0.81 | 3.13 | G |
| | | | Gen | GG_vs_AA | 0.077 | 1.81 | 0.94 | 3.48 | G |
| | | MEGA1 | Gen | GA_vs_AA | 0.395 | 0.84 | 0.57 | 1.25 | G |
| | | | Gen | GG_vs_AA | 0.729 | 1.07 | 0.73 | 1.56 | G |
| hCV2575036 | GRB10 (rs34432772) | LETS | add | A_vs_G | 0.007 | 3.03 | 1.35 | 6.81 | A |
| | | MEGA1 | add | G_vs_A | 0.025 | 1.49 | 1.05 | 2.11 | G |
| | | LETS | Gen | AG_vs_GG | 0.007 | 0.33 | 0.15 | 0.74 | A |
| | | MEGA1 | Gen | GA_vs_AA | 0.038 | 1.45 | 1.02 | 2.07 | G |
| | | | Gen | GG_vs_AA | 0.952 | 137573 | 0 | #### | G |
| hCV2699725 | GUCY1B2 (rs11841997) | LETS | Gen | CG_vs_GG | 0.037 | 1.85 | 1.04 | 3.31 | C |
| | | MEGA1 | Gen | GC_vs_CC | 0.048 | 1.33 | 1 | 1.78 | G |
| | | LETS | Gen | CC_vs_GG | 0.314 | 3.2 | 0.33 | 30.9 | C |
| | | | Gen | CG_vs_GG | 0.037 | 1.85 | 1.04 | 3.31 | C |
| | | MEGA1 | Gen | GC_vs_CC | 0.048 | 1.33 | 1 | 1.78 | G |
| | | | Gen | GG_vs_CC | 0.97 | 1.03 | 0.27 | 3.83 | G |
| hCV25995678 | hCV25995678 | LETS | add | T_vs_C | 0.019 | 1.46 | 1.06 | 2 | T |
| | | MEGA1 | dom | TT + TC_vs_CC | 0.049 | 2.73 | 1 | 7.42 | T |
| | | LETS | Gen | TC_vs_CC | 0.569 | 1.44 | 0.41 | 4.98 | T |
| | | | Gen | TT_vs_CC | 0.229 | 2.1 | 0.63 | 7.04 | T |
| | | MEGA1 | Gen | TC_vs_CC | 0.052 | 2.72 | 0.99 | 7.5 | T |
| | | | Gen | TT_vs_CC | 0.049 | 2.73 | 1 | 7.42 | T |
| hCV25996277 | hCV25996277 | LETS | add | A_vs_T | 0.024 | 1.43 | 1.05 | 1.96 | A |
| | | MEGA1 | Gen | AA_vs_TT | 0.021 | 3.19 | 1.19 | 8.51 | A |
| | | LETS | Gen | AA_vs_TT | 0.231 | 2.09 | 0.63 | 7.02 | A |
| | | | Gen | AT_vs_TT | 0.547 | 1.47 | 0.42 | 5.08 | A |
| | | MEGA1 | Gen | AA_vs_TT | 0.021 | 3.19 | 1.19 | 8.51 | A |
| | | | Gen | AT_vs_TT | 0.025 | 3.13 | 1.16 | 8.48 | A |
| hCV31199195 | KCTTD10 (rs10850234) | LETS | dom | CC + CA_vs_AA | 0.021 | 1.4 | 1.05 | 1.86 | C |
| | | MEGA1 | dom | CC + CA_vs_AA | 0.036 | 1.17 | 1.01 | 1.37 | C |
| | | LETS | Gen | CA_vs_AA | 0.013 | 1.45 | 1.08 | 1.95 | C |
| | | | Gen | CC_vs_AA | 0.945 | 0.97 | 0.44 | 2.14 | C |
| | | MEGA1 | Gen | CA_vs_AA | 0.065 | 1.16 | 0.99 | 1.35 | C |
| | | | Gen | CC_vs_AA | 0.155 | 1.33 | 0.9 | 1.97 | C |
| hCV27502514 | KLF3 (rs3796533) | MEGA1 | dom | AA + AG_vs_GG | 0.026 | 1.19 | 1.02 | 1.38 | A |
| | | LETS | dom | AA + AG_vs_GG | 0.038 | 1.34 | 1.02 | 1.77 | A |
| | | LETS | Gen | AA_vs_GG | 0.499 | 1.28 | 0.63 | 2.61 | A |
| | | | Gen | AG_vs_GG | 0.042 | 1.35 | 1.01 | 1.8 | A |
| | | MEGA1 | Gen | AA_vs_GG | 0.218 | 1.31 | 0.85 | 2 | A |
| | | | Gen | AG_vs_GG | 0.042 | 1.18 | 1.01 | 1.38 | A |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| hCV11786258 | KLKB1 (rs4253303) | LETS | Gen | AG_vs_GG | 0.069 | 1.32 | 0.98 | 1.78 | A |
| | | MEGA1 | Gen | AG_vs_GG | 0.003 | 1.27 | 1.09 | 1.49 | A |
| | | LETS | Gen | AA_vs_GG | 0.32 | 1.21 | 0.83 | 1.78 | A |
| | | | Gen | AG_vs_GG | 0.069 | 1.32 | 0.98 | 1.78 | A |
| | | MEGA1 | Gen | AA_vs_GG | 4E−04 | 1.45 | 1.18 | 1.79 | A |
| | | | Gen | AG_vs_GG | 0.003 | 1.27 | 1.09 | 1.49 | A |
| hCV540410 | LASP1 (rs609529) | LETS | Gen | AT_vs_TT | 0.058 | 1.5 | 0.99 | 2.28 | A |
| | | MEGA1 | Gen | AA_vs_TT | 0.009 | 3.83 | 1.39 | 10.6 | A |
| | | LETS | Gen | AA_vs_TT | 0.47 | 0.53 | 0.1 | 2.93 | A |
| | | | Gen | AT_vs_TT | 0.058 | 1.5 | 0.99 | 2.28 | A |
| | | MEGA1 | Gen | AA_vs_TT | 0.009 | 3.83 | 1.39 | 10.6 | A |
| | | | Gen | AT_vs_TT | 0.637 | 1.05 | 0.85 | 1.3 | A |
| hDV70662128 | LOC129656 | LETS | add | A_vs_G | 0.063 | 1.68 | 0.97 | 2.92 | A |
| | | MEGA1 | add | A_vs_G | 9E−04 | 1.59 | 1.21 | 2.09 | A |
| | (rs17043082) | LETS | Gen | AG_vs_GG | 0.063 | 1.68 | 0.97 | 2.92 | A |
| | | MEGA1 | Gen | AA_vs_GG | 0.465 | 1.63 | 0.44 | 6.1 | A |
| | | | Gen | AG_vs_GG | 9E−04 | 1.65 | 1.23 | 2.23 | A |
| hCV11541681 | LOC200420 | MEGA1 | add | C_vs_G | 0.013 | 1.14 | 1.03 | 1.26 | C |
| | (rs2001490) | LETS | add | C_vs_G | 0.039 | 1.22 | 1.01 | 1.49 | C |
| | | LETS | Gen | CC_vs_GG | 0.028 | 1.57 | 1.05 | 2.35 | C |
| | | | Gen | CG_vs_GG | 0.441 | 1.12 | 0.84 | 1.5 | C |
| | | MEGA1 | Gen | CC_vs_GG | 0.015 | 1.3 | 1.05 | 1.61 | C |
| | | | Gen | CG_vs_GG | 0.126 | 1.13 | 0.97 | 1.32 | C |
| hCV2706410 | LOC387646 | LETS | Gen | CT_vs_TT | 0.015 | 1.41 | 1.07 | 1.87 | C |
| | (rs7896532) | MEGA1 | Gen | CT_vs_TT | 0.04 | 1.17 | 1.01 | 1.36 | C |
| | | LETS | Gen | CC_vs_TT | 0.33 | 1.3 | 0.77 | 2.19 | C |
| | | | Gen | CT_vs_TT | 0.015 | 1.41 | 1.07 | 1.87 | C |
| | | MEGA1 | Gen | CC_vs_TT | 0.817 | 0.97 | 0.72 | 1.29 | C |
| | | | Gen | CT_vs_TT | 0.04 | 1.17 | 1.01 | 1.36 | C |
| hCV1547677 | LOC646030 | LETS | add | G_vs_A | 0.024 | 2.6 | 1.13 | 5.97 | G |
| | (rs6505228) | MEGA1 | add | G_vs_A | 0.044 | 1.37 | 1.01 | 1.87 | G |
| | | LETS | Gen | GA_vs_AA | 0.024 | 2.6 | 1.13 | 5.97 | G |
| | | MEGA1 | Gen | GA_vs_AA | 0.737 | 1.08 | 0.7 | 1.66 | G |
| | | | Gen | GG_vs_AA | 0.015 | 3.24 | 1.25 | 8.38 | G |
| hCV8827309 | LOC728221 | LETS | add | T_vs_C | 0.006 | 1.49 | 1.12 | 1.98 | T |
| | (rs1110796) | MEGA1 | add | T_vs_C | 0.04 | 1.17 | 1.01 | 1.36 | T |
| | | LETS | Gen | TC_vs_CC | 0.021 | 1.46 | 1.06 | 2.02 | T |
| | | | Gen | TT_vs_CC | 0.093 | 2.49 | 0.86 | 7.26 | T |
| | | MEGA1 | Gen | TC_vs_CC | 0.031 | 1.2 | 1.02 | 1.42 | T |
| | | | Gen | TT_vs_CC | 0.658 | 1.14 | 0.63 | 2.06 | T |
| hCV2103392 | LOC728284 | LETS | dom | CC + CT_vs_TT | 0.097 | 1.4 | 0.94 | 2.07 | C |
| | (rs12500826) | MEGA1 | dom | CC + CT_vs_TT | 0.014 | 1.31 | 1.06 | 1.62 | C |
| | | LETS | Gen | CC_vs_TT | 0.124 | 1.39 | 0.91 | 2.11 | C |
| | | | Gen | CT_vs_TT | 0.113 | 1.4 | 0.92 | 2.13 | C |
| | | MEGA1 | Gen | CC_vs_TT | 0.005 | 1.39 | 1.11 | 1.75 | C |
| | | | Gen | CT_vs_TT | 0.064 | 1.24 | 0.99 | 1.55 | C |
| hCV3230136 | LOC728284 | MEGA1 | rec | GG_vs_GA + AA | 0.007 | 1.21 | 1.05 | 1.4 | G |
| | (rs13116273) | LETS | rec | GG_vs_GA + AA | 0.03 | 1.34 | 1.03 | 1.75 | G |
| | | LETS | Gen | GA_vs_AA | 0.415 | 0.8 | 0.46 | 1.37 | G |
| | | | Gen | GG_vs_AA | 0.7 | 1.11 | 0.65 | 1.88 | G |
| | | MEGA1 | Gen | GA_vs_AA | 0.11 | 1.28 | 0.95 | 1.74 | G |
| | | | Gen | GG_vs_AA | 0.008 | 1.51 | 1.12 | 2.03 | G |
| hCV3230131 | LOC728284 | LETS | rec | TT_vs_TC + CC | 0.05 | 1.3 | 1 | 1.7 | T |
| | (rs13136269) | MEGA1 | rec | TT_vs_TC + CC | 0.003 | 1.24 | 1.08 | 1.43 | T |
| | | LETS | Gen | TC_vs_CC | 0.47 | 0.82 | 0.48 | 1.41 | T |
| | | | Gen | TT_vs_CC | 0.721 | 1.1 | 0.65 | 1.87 | T |
| | | MEGA1 | Gen | TC_vs_CC | 0.067 | 1.33 | 0.98 | 1.8 | T |
| | | | Gen | TT_vs_CC | 0.003 | 1.59 | 1.18 | 2.14 | T |
| hCV29821005 | LOC728284 | LETS | Gen | TC_vs_CC | 0.055 | 1.31 | 0.99 | 1.74 | T |
| | (rs65522970) | MEGA1 | Gen | TC_vs_CC | 0.008 | 1.23 | 1.05 | 1.43 | T |
| | | LETS | Gen | TC_vs_CC | 0.055 | 1.31 | 0.99 | 1.74 | T |
| | | | Gen | TT_vs_CC | 0.59 | 1.2 | 0.62 | 2.29 | T |
| | | MEGA1 | Gen | TC_vs_CC | 0.008 | 1.23 | 1.05 | 1.43 | T |
| | | | Gen | TT_vs_CC | 0.491 | 1.13 | 0.8 | 1.6 | T |
| hCV32209621 | LOC728284 | LETS | Gen | AG_vs_GG | 0.054 | 1.39 | 0.99 | 1.94 | A |
| | (rs6552971) | MEGA1 | Gen | AA_vs_GG | 0.045 | 1.23 | 1 | 1.5 | A |
| | | LETS | Gen | AA_vs_GG | 0.46 | 1.15 | 0.79 | 1.66 | A |
| | | | Gen | AG_vs_GG | 0.054 | 1.39 | 0.99 | 1.94 | A |
| | | MEGA1 | Gen | AA_vs_GG | 0.045 | 1.23 | 1 | 1.5 | A |
| | | | Gen | AG_vs_GG | 0.109 | 1.16 | 0.97 | 1.38 | A |
| hCV32209620 | LOC728284 | LETS | dom | CC + CT_vs_TT | 0.061 | 1.29 | 0.99 | 1.69 | C |
| | (rs6552972) | MEGA1 | dom | CC + CT_vs_TT | 0.011 | 1.21 | 1.05 | 1.4 | C |
| | | LETS | Gen | CC_vs_TT | 0.487 | 1.24 | 0.67 | 2.3 | C |
| | | | Gen | CT_vs_TT | 0.066 | 1.3 | 0.98 | 1.72 | C |
| | | MEGA1 | Gen | CC_vs_TT | 0.462 | 1.14 | 0.81 | 1.61 | C |
| | | | Gen | CT_vs_TT | 0.011 | 1.22 | 1.05 | 1.42 | C |
| hCV916107 | LOC729138 | LETS | add | C_vs_T | 0.018 | 1.27 | 1.04 | 1.54 | C |
| | (rs670659) | MEGA1 | add | C_vs_T | 0.026 | 1.13 | 1.01 | 1.25 | C |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | CC_vs_TT | 0.022 | 1.67 | 1.08 | 2.6 | C |
| | | | Gen | CT_vs_TT | 0.158 | 1.38 | 0.88 | 2.14 | C |
| | | MEGA1 | Gen | CC_vs_TT | 0.012 | 1.35 | 1.07 | 1.7 | C |
| | | | Gen | CT_vs_TT | 0.035 | 1.28 | 1.02 | 1.61 | C |
| hCV30922162 | LOC729672 (rs4334028) | LETS | add | T_vs_C | 0.013 | 1.3 | 1.06 | 1.6 | T |
| | | MEGA1 | add | T_vs_C | 0.048 | 1.12 | 1 | 1.25 | T |
| | | LETS | Gen | TC_vs_CC | 0.3 | 1.16 | 0.88 | 1.52 | T |
| | | | Gen | TT_vs_CC | 0.006 | 2 | 1.22 | 3.29 | T |
| | | MEGA1 | Gen | TC_vs_CC | 0.355 | 1.07 | 0.92 | 1.24 | T |
| | | | Gen | TT_vs_CC | 0.035 | 1.32 | 1.02 | 1.72 | T |
| hCV7504118 | LOC729672 (rs967257) | MEGA1 | add | G_vs_A | 0.022 | 1.14 | 1.02 | 1.27 | G |
| | | LETS | add | G_vs_A | 0.028 | 1.26 | 1.02 | 1.55 | G |
| | | LETS | Gen | GA_vs_AA | 0.222 | 1.19 | 0.9 | 1.56 | G |
| | | | Gen | GG_vs_AA | 0.029 | 1.75 | 1.06 | 2.91 | G |
| | | MEGA1 | Gen | GA_vs_AA | 0.229 | 1.09 | 0.94 | 1.27 | G |
| | | | Gen | GG_vs_AA | 0.019 | 1.38 | 1.06 | 1.81 | G |
| hCV11633415 | LOC730144 (rs4262503) | MEGA1 | add | T_vs_C | 0.003 | 1.34 | 1.1 | 1.64 | T |
| | | LETS | add | T_vs_C | 0.036 | 1.49 | 1.03 | 2.15 | T |
| | | LETS | Gen | TC_vs_CC | 0.974 | 2E+06 | 0 | Inf | T |
| | | | Gen | TT_vs_CC | 0.974 | 2E+06 | 0 | Inf | T |
| | | MEGA1 | Gen | TC_vs_CC | 0.842 | 1.11 | 0.4 | 3.06 | T |
| | | | Gen | TT_vs_CC | 0.416 | 1.51 | 0.56 | 4.1 | T |
| hCV2494846 | LUZP1 (rs3765407) | MEGA1 | rec | GG_vs_GT + TT | 0.029 | 1.56 | 1.05 | 2.33 | G |
| | | LETS | rec | GG_vs_GT + TT | 0.043 | 2.2 | 1.03 | 4.74 | G |
| | | LETS | Gen | GG_vs_TT | 0.032 | 2.32 | 1.08 | 5.01 | G |
| | | | Gen | GT_vs_TT | 0.202 | 1.22 | 0.9 | 1.65 | G |
| | | MEGA1 | Gen | GG_vs_TT | 0.029 | 1.57 | 1.05 | 2.34 | G |
| | | | Gen | GT_vs_TT | 0.93 | 1.01 | 0.86 | 1.18 | G |
| hCV25752810 | MDN1 (rs4707557) | MEGA1 | add | C_vs_A | 0.011 | 1.49 | 1.09 | 2.04 | C |
| | | LETS | add | C_vs_A | 0.03 | 2.01 | 1.07 | 3.76 | C |
| | | LETS | Gen | CA_vs_AA | 0.047 | 2.11 | 1.01 | 4.4 | C |
| | | | Gen | CC_vs_AA | 0.32 | 3.16 | 0.33 | 30.5 | C |
| | | MEGA1 | Gen | CA_vs_AA | 0.03 | 1.49 | 1.04 | 2.12 | C |
| | | | Gen | CC_vs_AA | 0.187 | 2.29 | 0.67 | 7.84 | C |
| hCV16170613 | MET (rs2237712) | MEGA1 | add | G_vs_A | 0.017 | 1.38 | 1.06 | 1.8 | G |
| | | LETS | add | G_vs_A | 0.031 | 1.68 | 1.05 | 2.7 | G |
| | | LETS | Gen | GA_vs_AA | 0.155 | 1.45 | 0.87 | 2.43 | G |
| | | | Gen | GG_vs_AA | 0.974 | 2E+06 | 0 | Inf | G |
| | | MEGA1 | Gen | GA_vs_AA | 0.033 | 1.35 | 1.02 | 1.77 | G |
| | | | Gen | GG_vs_AA | 0.242 | 3.86 | 0.4 | 37.1 | G |
| hCV11726971 | NFIA (rs2065841) | LETS | Gen | GG_vs_AA | 0.016 | 2.55 | 1.19 | 5.45 | G |
| | | MEGA1 | Gen | GA_vs_AA | 0.038 | 1.18 | 1.01 | 1.37 | G |
| | | LETS | Gen | GA_vs_AA | 0.242 | 1.19 | 0.89 | 1.61 | G |
| | | | Gen | GG_vs_AA | 0.016 | 2.55 | 1.19 | 5.45 | G |
| | | MEGA1 | Gen | GA_vs_AA | 0.038 | 1.18 | 1.01 | 1.37 | G |
| | | | Gen | GG_vs_AA | 0.591 | 0.9 | 0.63 | 1.3 | G |
| hCV30747430 | NR1I2 (rs11712211) | MEGA1 | add | T_vs_C | 0.007 | 1.19 | 1.05 | 1.34 | T |
| | | LETS | add | T_vs_C | 0.014 | 1.35 | 1.06 | 1.71 | T |
| | | LETS | Gen | TC_vs_CC | 0.277 | 1.18 | 0.87 | 1.59 | T |
| | | | Gen | TT_vs_CC | 0.009 | 2.63 | 1.28 | 5.42 | T |
| | | MEGA1 | Gen | TC_vs_CC | 0.146 | 1.12 | 0.96 | 1.31 | T |
| | | | Gen | TT_vs_CC | 0.006 | 1.61 | 1.14 | 2.27 | T |
| hCV263841 | NR1I2 (rs1523127) | LETS | add | C_vs_A | 1E-04 | 1.44 | 1.19 | 1.73 | C |
| | | MEGA1 | add | C_vs_A | 0.008 | 1.15 | 1.04 | 1.27 | C |
| | | LETS | Gen | CA_vs_AA | 0.13 | 1.25 | 0.94 | 1.66 | C |
| | | | Gen | CC_vs_AA | 7E-05 | 2.24 | 1.51 | 3.34 | C |
| | | MEGA1 | Gen | CA_vs_AA | 0.15 | 1.12 | 0.96 | 1.31 | C |
| | | | Gen | CC_vs_AA | 0.007 | 1.33 | 1.08 | 1.65 | C |
| hCV4041 | NR3C1 (rs6190) | MEGA1 | dom | TT + TC_vs_CC | 0.021 | 1.41 | 1.05 | 1.89 | T |
| | | LETS | dom | TT + TC_vs_CC | 0.05 | 1.65 | 1 | 2.73 | T |
| | | LETS | Gen | TC_vs_CC | 0.047 | 1.68 | 1.01 | 2.79 | T |
| | | | Gen | TT_vs_CC | 0.966 | 1.06 | 0.07 | 17 | T |
| | | MEGA1 | Gen | TC_vs_CC | 0.038 | 1.37 | 1.02 | 1.84 | T |
| | | | Gen | TT_vs_CC | 0.139 | 5.24 | 0.58 | 46.9 | T |
| hCV2915511 | OBSL1 (rs627530) | LETS | Gen | CT_vs_TT | 0.015 | 1.95 | 1.14 | 3.35 | C |
| | | MEGA1 | Gen | CC_vs_TT | 0.024 | 3.28 | 1.17 | 9.23 | C |
| | | LETS | Gen | CC_vs_TT | 0.311 | 3.23 | 0.33 | 31.1 | C |
| | | | Gen | CT_vs_TT | 0.015 | 1.95 | 1.14 | 3.35 | C |
| | | MEGA1 | Gen | CC_vs_TT | 0.024 | 3.28 | 1.17 | 9.23 | C |
| | | | Gen | CT_vs_TT | 0.564 | 0.92 | 0.7 | 1.22 | C |
| hCV16177220 | ODZ1 (rs2266911) | MEGA1 | add | C_vs_T | 3E-04 | 1.22 | 1.09 | 1.36 | C |
| | | LETS | add | C_vs_T | 0.017 | 1.28 | 1.05 | 1.57 | C |
| | | LETS | Gen | CC_vs_TT | 0.03 | 1.65 | 1.05 | 2.6 | C |
| | | | Gen | CT_vs_TT | 0.321 | 1.31 | 0.77 | 2.22 | C |
| | | MEGA1 | Gen | CC_vs_TT | 0.001 | 1.46 | 1.16 | 1.85 | C |
| | | | Gen | CT_vs_TT | 0.253 | 1.18 | 0.89 | 1.56 | C |
| hCV7584272 | OR1B1 (rs1536929) | LETS | Gen | AG_vs_GG | 0.065 | 1.29 | 0.98 | 1.7 | A |
| | | MEGA1 | dom | AA + AG_vs_GG | 0.044 | 1.16 | 1 | 1.33 | A |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | AA_vs_GG | 0.461 | 1.24 | 0.7 | 2.23 | A |
| | | | Gen | AG_vs_GG | 0.065 | 1.29 | 0.98 | 1.7 | A |
| | | MEGA1 | Gen | AA_vs_GG | 0.344 | 1.16 | 0.85 | 1.58 | A |
| | | | Gen | AG_vs_GG | 0.054 | 1.16 | 1 | 1.34 | A |
| hCV9327878 | OR7G1 (rs2217657) | MEGA1 | add | G_vs_C | 0.006 | 1.16 | 1.04 | 1.29 | G |
| | | LETS | add | G_vs_C | 0.033 | 1.24 | 1.02 | 1.5 | G |
| | | LETS | Gen | GC_vs_CC | 0.209 | 1.2 | 0.9 | 1.59 | G |
| | | | Gen | GG_vs_CC | 0.04 | 1.57 | 1.02 | 2.42 | G |
| | | MEGA1 | Gen | GC_vs_CC | 0.055 | 1.16 | 1 | 1.35 | G |
| | | | Gen | GG_vs_CC | 0.012 | 1.34 | 1.07 | 1.69 | G |
| hCV15990789 | OTOG (rs2355466) | MEGA1 | rec | GG_vs_GA + AA | 0.008 | 1.22 | 1.05 | 1.41 | G |
| | | LETS | rec | GG_vs_GA + AA | 0.013 | 1.43 | 1.08 | 1.89 | G |
| | | LETS | Gen | GA_vs_AA | 0.602 | 0.91 | 0.63 | 1.31 | G |
| | | | Gen | GG_vs_AA | 0.153 | 1.33 | 0.9 | 1.96 | G |
| | | MEGA1 | Gen | GA_vs_AA | 0.256 | 0.89 | 0.72 | 1.09 | G |
| | | | Gen | GG_vs_AA | 0.308 | 1.12 | 0.9 | 1.38 | G |
| hCV8361354 | PANX1 (rs1138800) | LETS | Gen | CC_vs_AA | 0.01 | 1.75 | 1.15 | 2.67 | C |
| | | MEGA1 | Gen | CA_vs_AA | 0.038 | 0.8 | 0.64 | 0.99 | C |
| | | LETS | Gen | CA_vs_AA | 0.179 | 1.33 | 0.88 | 2.01 | C |
| | | | Gen | CC_vs_AA | 0.01 | 1.75 | 1.15 | 2.67 | C |
| | | MEGA1 | Gen | CA_vs_AA | 0.038 | 0.8 | 0.64 | 0.99 | C |
| | | | Gen | CC_vs_AA | 0.455 | 0.92 | 0.74 | 1.15 | C |
| hCV30500334 | PHACTR3 (rs6128674) | LETS | add | G_vs_A | 0.006 | 1.31 | 1.08 | 1.59 | G |
| | | MEGA1 | add | G_vs_A | 0.017 | 1.13 | 1.02 | 1.25 | G |
| | | LETS | Gen | GA_vs_AA | 0.758 | 1.06 | 0.72 | 1.57 | G |
| | | | Gen | GG_vs_AA | 0.024 | 1.59 | 1.06 | 2.38 | G |
| | | MEGA1 | Gen | GA_vs_AA | 0.128 | 1.18 | 0.95 | 1.46 | G |
| | | | Gen | GG_vs_AA | 0.017 | 1.3 | 1.05 | 1.62 | G |
| hCV27474984 | PIK3R1 (rs3756668) | MEGA1 | add | A_vs_G | 0.011 | 1.14 | 1.03 | 1.26 | A |
| | | LETS | add | A_vs_G | 0.026 | 1.24 | 1.03 | 1.5 | A |
| | | LETS | Gen | AA_vs_GG | 0.025 | 1.54 | 1.06 | 2.25 | A |
| | | | Gen | AG_vs_GG | 0.305 | 1.18 | 0.86 | 1.61 | A |
| | | MEGA1 | Gen | AA_vs_GG | 0.029 | 1.25 | 1.02 | 1.53 | A |
| | | | Gen | AG_vs_GG | 1E-04 | 1.38 | 1.17 | 1.62 | A |
| hCV7625318 | PLEKHG4 (rs3868142) | LETS | Gen | AG_vs_GG | 0.003 | 1.79 | 1.22 | 2.62 | A |
| | | MEGA1 | Gen | AG_vs_GG | 0.035 | 1.24 | 1.02 | 1.51 | A |
| | | LETS | Gen | AA_vs_GG | 0.497 | 0.55 | 0.1 | 3.04 | A |
| | | | Gen | AG_vs_GG | 0.003 | 1.79 | 1.22 | 2.62 | A |
| | | MEGA1 | Gen | AA_vs_GG | 0.878 | 1.06 | 0.51 | 2.21 | A |
| | | | Gen | AG_vs_GG | 0.035 | 1.24 | 1.02 | 1.51 | A |
| hCV8598986 | POLR1A (rs4832233) | LETS | rec | CC_vs_CT + TT | 0.023 | 1.36 | 1.04 | 1.76 | C |
| | | MEGA1 | rec | CC_vs_CT + TT | 0.05 | 1.15 | 1 | 1.33 | C |
| | | LETS | Gen | CC_vs_TT | 0.019 | 1.83 | 1.1 | 3.04 | C |
| | | | Gen | CT_vs_TT | 0.173 | 1.43 | 0.85 | 2.39 | C |
| | | MEGA1 | Gen | CC_vs_TT | 0.478 | 1.1 | 0.85 | 1.42 | C |
| | | | Gen | CT_vs_TT | 0.663 | 0.94 | 0.72 | 1.23 | C |
| hCV926518 | PPP2R5C (rs7467981) | LETS | Gen | GT_vs_TT | 0.034 | 1.45 | 1.03 | 2.04 | G |
| | | MEGA1 | Gen | GT_vs_TT | 0.05 | 1.2 | 1 | 1.44 | G |
| | | LETS | Gen | GG_vs_TT | 0.842 | 0.87 | 0.23 | 3.28 | G |
| | | | Gen | GT_vs_TT | 0.034 | 1.45 | 1.03 | 2.04 | G |
| | | MEGA1 | Gen | GG_vs_TT | 0.525 | 0.82 | 0.44 | 1.53 | G |
| | | | Gen | GT_vs_TT | 0.05 | 1.2 | 1 | 1.44 | G |
| hCV1841975 | PROC (rs1799810) | LETS | Gen | TT_vs_AA | 0.064 | 1.43 | 0.98 | 2.08 | T |
| | | MEGA1 | Gen | TT_vs_AA | 0.006 | 1.33 | 1.09 | 1.62 | T |
| | | LETS | Gen | TA_vs_AA | 0.495 | 1.11 | 0.82 | 1.5 | T |
| | | | Gen | TT_vs_AA | 0.064 | 1.43 | 0.98 | 2.08 | T |
| | | MEGA1 | Gen | TA_vs_AA | 0.772 | 1.02 | 0.87 | 1.21 | T |
| | | | Gen | TT_vs_AA | 0.006 | 1.33 | 1.09 | 1.62 | T |
| hCV8957432 | RAC2 (rs6572) | MEGA1 | rec | CC_vs_CG + GG | 0.031 | 1.21 | 1.02 | 1.44 | C |
| | | LETS | rec | CC_vs_CG + GG | 0.043 | 1.41 | 1.01 | 1.96 | C |
| | | LETS | Gen | CC_vs_GG | 0.102 | 1.38 | 0.94 | 2.04 | C |
| | | | Gen | CG_vs_GG | 0.863 | 0.97 | 0.71 | 1.33 | C |
| | | MEGA1 | Gen | CC_vs_GG | 0.02 | 1.27 | 1.04 | 1.55 | C |
| | | | Gen | CG_vs_GG | 0.363 | 1.08 | 0.92 | 1.27 | C |
| hCV29271569 | RDH13 (rs1626971) | LETS | add | T_vs_C | 0.014 | 1.36 | 1.06 | 1.75 | T |
| | | MEGA1 | add | T_vs_C | 0.031 | 1.15 | 1.01 | 1.32 | T |
| | | LETS | Gen | TC_vs_CC | 0.322 | 1.53 | 0.66 | 3.56 | T |
| | | | Gen | TT_vs_CC | 0.089 | 2.04 | 0.9 | 4.66 | T |
| | | MEGA1 | Gen | TC_vs_CC | 0.906 | 0.98 | 0.65 | 1.47 | T |
| | | | Gen | TT_vs_CC | 0.445 | 1.17 | 0.78 | 1.75 | T |
| hCV8703249 | RDH13 (rs1654444) | LETS | add | G_vs_T | 0.052 | 1.28 | 1 | 1.64 | G |
| | | MEGA1 | add | G_vs_T | 0.02 | 1.17 | 1.03 | 1.33 | G |
| | | LETS | Gen | GG_vs_TT | 0.149 | 1.8 | 0.81 | 3.99 | G |
| | | | Gen | GT_vs_TT | 0.382 | 1.44 | 0.64 | 3.27 | G |
| | | MEGA1 | Gen | GG_vs_TT | 0.193 | 1.31 | 0.87 | 1.95 | G |
| | | | Gen | GT_vs_TT | 0.642 | 1.1 | 0.73 | 1.67 | G |
| hCV8717752 | RDH13 (rs1671217) | LETS | add | G_vs_A | 0.024 | 1.34 | 1.04 | 1.72 | G |
| | | MEGA1 | rec | GG_vs_GA + AA | 0.048 | 1.17 | 1 | 1.36 | G |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | GA_vs_AA | 0.114 | 2.09 | 0.84 | 5.22 | G |
| | | | Gen | GG_vs_AA | 0.038 | 2.58 | 1.06 | 6.32 | G |
| | | MEGA1 | Gen | GA_vs_AA | 0.9 | 1.03 | 0.66 | 1.61 | G |
| | | | Gen | GG_vs_AA | 0.414 | 1.2 | 0.78 | 1.85 | G |
| hCV11975296 | SELP (rs6131) | MEGA1 | add | T_vs_C | 0.003 | 1.2 | 1.06 | 1.36 | T |
| | | LETS | add | T_vs_C | 0.025 | 1.29 | 1.03 | 1.62 | T |
| | | LETS | Gen | TC_vs_CC | 0.049 | 1.34 | 1 | 1.8 | T |
| | | | Gen | TT_vs_CC | 0.157 | 1.54 | 0.85 | 2.81 | T |
| | | MEGA1 | Gen | TC_vs_CC | 0.004 | 1.25 | 1.07 | 1.46 | T |
| | | | Gen | TT_vs_CC | 0.148 | 1.3 | 0.91 | 1.86 | T |
| hCV9596963 | SERPINA5 (rs6115) | LETS | dom | AA + AG_vs_GG | 0.03 | 1.61 | 1.05 | 2.48 | A |
| | | MEGA1 | dom | AA + AG_vs_GG | 0.038 | 1.27 | 1.01 | 1.6 | A |
| | | LETS | Gen | AA_vs_GG | 0.033 | 1.65 | 1.04 | 2.6 | A |
| | | | Gen | AG_vs_GG | 0.043 | 1.59 | 1.01 | 2.48 | A |
| | | MEGA1 | Gen | AA_vs_GG | 0.05 | 1.27 | 1 | 1.61 | A |
| | | | Gen | AG_vs_GG | 0.047 | 1.27 | 1 | 1.62 | A |
| hCV16180170 | SERPINC1 (rs2227589) | MEGA1 | add | T_vs_C | 0.01 | 1.24 | 1.05 | 1.47 | T |
| | | LETS | add | T_vs_C | 0.026 | 1.42 | 1.04 | 1.94 | T |
| | | LETS | Gen | TC_vs_CC | 0.031 | 1.46 | 1.04 | 2.06 | T |
| | | | Gen | TT_vs_CC | 0.442 | 1.65 | 0.46 | 5.89 | T |
| | | MEGA1 | Gen | TC_vs_CC | 0.052 | 1.2 | 1 | 1.45 | T |
| | | | Gen | TT_vs_CC | 0.052 | 1.93 | 1 | 3.73 | T |
| hCV1650632 | SERPINC1 (rs5878) | MEGA1 | Gen | CC_vs_TT | 0.005 | 1.38 | 1.1 | 1.74 | C |
| | | LETS | Gen | CT_vs_TT | 0.026 | 1.38 | 1.04 | 1.83 | C |
| | | LETS | Gen | CC_vs_TT | 0.92 | 1.02 | 0.66 | 1.57 | C |
| | | | Gen | CT_vs_TT | 0.026 | 1.38 | 1.04 | 1.83 | C |
| | | MEGA1 | Gen | CC_vs_TT | 0.005 | 1.38 | 1.1 | 1.74 | C |
| | | | Gen | CT_vs_TT | 0.191 | 1r.11 | 0.95 | 1.29 | C |
| hCV3216426 | SFRS2IP (rs7315731) | LETS | dom | AA + AT_vs_TT | 0.016 | 1.47 | 1.07 | 2.02 | A |
| | | MEGA1 | dom | AA + AT_vs_TT | 0.02 | 1.22 | 1.03 | 1.44 | A |
| | | LETS | Gen | AA_vs_TT | 0.016 | 1.58 | 1.09 | 2.29 | A |
| | | | Gen | AT_vs_TT | 0.043 | 1.41 | 1.01 | 1.98 | A |
| | | MEGA1 | Gen | AA_vs_TT | 0.066 | 1.2 | 0.99 | 1.47 | A |
| | | | Gen | AT_vs_TT | 0.023 | 1.23 | 1.03 | 1.47 | A |
| hCV25602230 | SIRT6 (rs7246235) | MEGA1 | add | G_vs_T | 0.008 | 1.73 | 1.15 | 2.58 | G |
| | | LETS | add | G_vs_T | 0.012 | 3.45 | 1.31 | 9.07 | G |
| | | LETS | Gen | GG_vs_TT | 0.971 | 819571 | | Inf | G |
| | | | Gen | GT_vs_TT | 0.027 | 3.16 | 1.14 | 8.76 | G |
| | | MEGA1 | Gen | GG_vs_TT | 0.143 | 5.14 | 0.57 | 46 | G |
| | | | Gen | GT_vs_TT | 0.028 | 1.64 | 1.05 | 2.55 | G |
| hCV2086329 | SPARC (rs4958487) | MEGA1 | rec | GG_vs_GA + AA | 0.001 | 1.35 | 1.13 | 1.62 | G |
| | | LETS | rec | GG_vs_GA + AA | 0.013 | 1.52 | 1.09 | 2.12 | G |
| | | LETS | Gen | GA_vs_AA | 0.943 | 1.01 | 0.75 | 1.36 | G |
| | | | Gen | GG_vs_AA | 0.026 | 1.53 | 1.05 | 2.23 | G |
| | | MEGA1 | Gen | GA_vs_AA | 0.146 | 0.89 | 0.76 | 1.04 | G |
| | | | Gen | GG_vs_AA | 0.026 | 1.26 | 1.03 | 1.54 | G |
| hCV11466393 | TACR1 (rs881) | LETS | add | C_vs_G | 0.012 | 1.38 | 1.07 | 1.77 | C |
| | | MEGA1 | add | C_vs_G | 0.037 | 1.15 | 1.01 | 1.32 | C |
| | | LETS | Gen | CC_vs_GG | 0.121 | 1.88 | 0.85 | 4.17 | C |
| | | | Gen | CG_vs_GG | 0.465 | 1.36 | 0.6 | 3.08 | C |
| | | MEGA1 | Gen | CC_vs_GG | 0.185 | 1.35 | 0.86 | 2.12 | C |
| | | | Gen | CG_vs_GG | 0.487 | 1.18 | 0.74 | 1.87 | C |
| hCV3216649 | TAF1B (rs1054565) | LETS | dom | AA + AG_vs_GG | 0.059 | 1.29 | 0.99 | 1.68 | A |
| | | MEGA1 | dom | AA + AG_vs_GG | 0.044 | 1.16 | 1 | 1.33 | A |
| | | LETS | Gen | AA_vs_GG | 0.336 | 1.24 | 0.8 | 1.93 | A |
| | | | Gen | AG_vs_GG | 0.064 | 1.3 | 0.98 | 1.72 | A |
| | | MEGA1 | Gen | AA_vs_GG | 0.267 | 1.14 | 0.9 | 1.44 | A |
| | | | Gen | AG_vs_GG | 0.051 | 1.16 | 1 | 1.35 | A |
| hCV470708 | THBS2 (rs10945406) | LETS | add | T_vs_G | 0.031 | 1.25 | 1.02 | 1.52 | T |
| | | MEGA1 | Gen | TT_vs_GG | 0.041 | 1.29 | 1.01 | 1.65 | T |
| | | LETS | Gen | TG_vs_GG | 0.108 | 1.26 | 0.95 | 1.66 | T |
| | | | Gen | TT_vs_GG | 0.067 | 1.54 | 0.97 | 2.45 | T |
| | | MEGA1 | Gen | TG_vs_GG | 0.755 | 1.02 | 0.88 | 1.19 | T |
| | | | Gen | TT_vs_GG | 0.041 | 1.29 | 1.01 | 1.65 | T |
| hCV3272537 | TIAM1 (rs497689) | LETS | dom | AA + AT_vs_TT | 0.078 | 1.29 | 0.97 | 1.71 | A |
| | | MEGA1 | dom | AA + AT_vs_TT | 0.003 | 1.26 | 1.08 | 1.46 | A |
| | | LETS | Gen | AA_vs_TT | 0.106 | 1.36 | 0.94 | 1.96 | A |
| | | | Gen | AT_vs_TT | 0.132 | 1.26 | 0.93 | 1.71 | A |
| | | MEGA1 | Gen | AA_vs_TT | 0.113 | 1.18 | 0.96 | 1.44 | A |
| | | | Gen | AT_vs_TT | 0.002 | 1.29 | 1.1 | 1.52 | A |
| hCV27833944 | TNFSF4 (rs6702339) | LETS | add | C_vs_T | 0.061 | 1.35 | 0.99 | 1.85 | C |
| | | MEGA1 | add | C_vs_T | 0.009 | 1.24 | 1.06 | 1.46 | C |
| | | LETS | Gen | CC_vs_TT | 0.423 | 1.8 | 0.43 | 7.59 | C |
| | | | Gen | CT_vs_TT | 0.084 | 1.35 | 0.96 | 1.91 | C |
| | | MEGA1 | Gen | CC_vs_TT | 0.025 | 2.06 | 1.09 | 3.87 | C |
| | | | Gen | CT_vs_TT | 0.072 | 1.19 | 0.98 | 1.43 | C |
| hCV1723643 | UMODL1 (rs220130) | LETS | rec | AA_vs_AC + CC | 0.056 | 1.3 | 0.99 | 1.7 | A |
| | | MEGA1 | rec | AA_vs_AC + CC | 0.019 | 1.19 | 1.03 | 1.38 | A |

TABLE 20-continued

Unadjusted additive and genotypic association of 149 SNPs with DVT in LETS (p <= 0.1) and MEGA-1 (p <= 0.05)

| marker | annot | | | | | | | |
|---|---|---|---|---|---|---|---|---|
| | | LETS | Gen | AA_vs_CC | 0.481 | 1.26 | 0.67 | 2.38 | A |
| | | | Gen | AC_vs_CC | 0.912 | 0.96 | 0.5 | 1.85 | A |
| | | MEGA1 | Gen | AA_vs_CC | 0.075 | 1.36 | 0.97 | 1.9 | A |
| | | | Gen | AC_vs_CC | 0.396 | 1.16 | 0.82 | 1.65 | A |
| hCV7581501 | USP45 (rs1323717) | LETS | Gen | CG_vs_GG | 0.016 | 1.51 | 1.08 | 2.11 | C |
| | | MEGA1 | Gen | CC_vs_GG | 0.034 | 1.94 | 1.05 | 3.6 | C |
| | | LETS | Gen | CC_vs_GG | 0.481 | 1.43 | 0.53 | 3.89 | C |
| | | | Gen | CG_vs_GG | 0.016 | 1.51 | 1.08 | 2.11 | C |
| | | MEGA1 | Gen | CC_vs_GG | 0.034 | 1.94 | 1.05 | 3.6 | C |
| | | | Gen | CG_vs_GG | 0.949 | 0.99 | 0.84 | 1.18 | C |
| hCV15949414 | XYLB (rs2234628) | MEGA1 | rec | GG_vs_GA + AA | 0.003 | 1.48 | 1.14 | 1.92 | G |
| | | LETS | rec | GG_vs_GA + AA | 0.036 | 1.64 | 1.03 | 2.61 | G |
| | | LETS | Gen | GA_vs_AA | 0.968 | 0 | #### | #### | G |
| | | | Gen | GG_vs_AA | 0.969 | 0 | #### | #### | G |
| | | MEGA1 | Gen | GA_vs_AA | 0.04 | 0.1 | 0.01 | 0.9 | G |
| | | | Gen | GG_vs_AA | 0.095 | 0.16 | 0.02 | 1.38 | G |
| hCV356522 | ZBTB41 (rs10732295) | LETS | dom | TT + TC_vs_CC | 0.055 | 1.41 | 0.99 | 2 | T |
| | | MEGA1 | dom | TT + TC_vs_CC | 0.007 | 1.28 | 1.07 | 1.52 | T |
| | | LETS | Gen | TC_vs_CC | 0.07 | 1.39 | 0.97 | 2 | T |
| | | | Gen | TT_vs_CC | 0.454 | 1.63 | 0.46 | 5.81 | T |
| | | MEGA1 | Gen | TC_vs_CC | 0.014 | 1.26 | 1.05 | 1.51 | T |
| | | | Gen | TT_vs_CC | 0.174 | 1.54 | 0.83 | 2.85 | T |
| hCV25596789 | JF544 (rs651013 | LETS | add | G_vs_C | 0.004 | 2.54 | 1.34 | 4.83 | G |
| | | MEGA1 | add | G_vs_C | 0.01 | 1.55 | 1.11 | 2.18 | G |
| | | LETS | Gen | GC_vs_CC | 0.011 | 2.38 | 1.22 | 4.65 | G |
| | | | Gen | GG_vs_CC | 0.971 | 832450 | 51533 | Inf | G |
| | | MEGA1 | Gen | GC_vs_CC | 0.015 | 1.52 | 1.08 | 2.14 | G |
| | | | Gen | GG_vs_CC | 0.952 | 135256 | 0 | #### | G |
| hCV25951992 | ZWINT (rs11005328) | MEGA1 | dom | AA + AC_vs_CC | 0.001 | 2.11 | 1.34 | 3.32 | A |
| | | LETS | dom | AA + AC_vs_CC | 0.03 | 2.32 | 1.09 | 4.96 | A |
| | | LETS | Gen | AA_vs_CC | 0.969 | 0 | #### | #### | A |
| | | | Gen | AC_vs_CC | 0.018 | 2.58 | 1.17 | 5.66 | A |
| | | MEGA1 | Gen | AA_vs_CC | 0.09 | 6.41 | 0.75 | 55 | A |
| | | | Gen | AC_vs_CC | 0.004 | 1.97 | 1.23 | 3.13 | A |

| marker | annot | Endpoint | Model | Non Risk Allele | Allele (CONTROL frq | Genot | CASE cnt (CASE frq) | CONTROL cnt (CONTROL frq) | Genot2 |
|---|---|---|---|---|---|---|---|---|---|
| hCV505733 | (rs11126416) | LETS | Gen | G | A (0.3642 | A A | 71 (0.1603) | 54 (0.1192) | A G |
| | | MEGA1 | Gen | G | A (0.3489 | A A | 210 (0.1514) | 213 (0.1212) | A G |
| | | LETS | Gen | G | A (0.3642 | A A | 71 (0.1603) | 54 (0.1192) | A G |
| | | | Gen | G | A (0.3642 | A A | 71 (0.1603) | 54 (0.1192) | A G |
| | | MEGA1 | Gen | G | A (0.3489 | A A | 210 (0.1514) | 213 (0.1212) | A G |
| | | | Gen | G | A (0.3489 | A A | 210 (0.1514) | 213 (0.1212) | A G |
| hCV2879752 | (rs1244565) | LETS | add | A | G (0.4658 | G G | 115 (0.2608) | 104 (0.2296) | G A |
| | | MEGA1 | add | A | G (0.4692 | G G | 341 (0.2498) | 379 (0.2163) | G A |
| | | LETS | Gen | A | G (0.4658 | G G | 115 (0.2608) | 104 (0.2296) | G A |
| | | | Gen | A | G (0.4658 | G G | 115 (0.2608) | 104 (0.2296) | G A |
| | | MEGA1 | Gen | A | G (0.4692 | G G | 341 (0.2498) | 379 (0.2163) | G A |
| | | | Gen | A | G (0.4692 | G G | 341 (0.2498) | 379 (0.2163) | G A |
| hCV11503470 | (rs1800788) | MEGA1 | add | C | T (0.2163 | T T | 85 (0.0613) | 107 (0.0611) | T C |
| | | LETS | add | C | T (0.1969 | T T | 31 (0.07) | 17 (0.0376) | T C |
| | | LETS | Gen | C | T (0.1969 | T T | 31 (0.07) | 17 (0.0376) | T C |
| | | | Gen | C | T (0.1969 | T T | 31 (0.07) | 17 (0.0376) | T C |
| | | MEGA1 | Gen | C | T (0.2163 | T T | 85 (0.0613) | 107 (0.0611) | T C |
| | | | Gen | C | T (0.2163 | T T | 85 (0.0613) | 107 (0.0611) | T C |
| hCV15860433 | (rs2070006) | MEGA1 | add | C | T (0.4067 | T T | 296 (0.2129) | 297 (0.1694) | T C |
| | | LETS | add | C | T (0.4011 | T T | 95 (0.2154) | 72 (0.16) | T C |
| | | LETS | Gen | C | T (0.4011 | T T | 95 (0.2154) | 72 (0.16) | T C |
| | | | Gen | C | T (0.4011 | T T | 95 (0.2154) | 72 (0.16) | T C |
| | | MEGA1 | Gen | C | T (0.4067 | T T | 296 (0.2129) | 297 (0.1694) | T C |
| | | | Gen | C | T (0.4067 | T T | 296 (0.2129) | 297 (0.1694) | T C |
| hCV2744023 | (rs369328) | LETS | add | G | A (0.4491 | A A | 116 (0.2619) | 87 (0.1925) | A G |
| | | MEGA1 | add | G | A (0.4784 | A A | 370 (0.265) | 404 (0.2301) | A G |
| | | LETS | Gen | G | A (0.4491 | A A | 116 (0.2619) | 87 (0.1925) | A G |
| | | | Gen | G | A (0.4491 | A A | 116 (0.2619) | 87 (0.1925) | A G |
| | | MEGA1 | Gen | G | A (0.4784 | A A | 370 (0.265) | 404 (0.2301) | A G |
| | | | Gen | G | A (0.4784 | A A | 370 (0.265) | 404 (0.2301) | A G |
| hCV27477533 | (rs3756008) | MEGA1 | add | A | T (0.4064 | T T | 307 (0.2201) | 296 (0.1689) | T A |
| | | LETS | add | A | T (0.4159 | T T | 101 (0.2285) | 88 (0.1947) | T A |
| | | LETS | Gen | A | T (0.4159 | T T | 101 (0.2285) | 88 (0.1947) | T A |
| | | | Gen | A | T (0.4159 | T T | 101 (0.2285) | 88 (0.1947) | T A |
| | | MEGA1 | Gen | A | T (0.4064 | T T | 307 (0.2201) | 296 (0.1689) | T A |
| | | | Gen | A | T (0.4064 | T T | 307 (0.2201) | 296 (0.1689) | T A |
| hCV949676 | (rs480802) | MEGA1 | Gen | T | C (0.2049 | C C | 83 (0.0615) | 77 (0.0443) | C T |
| | | LETS | Gen | T | C (0.1914 | C C | 29 (0.0662) | 17 (0.0376) | C T |

TABLE 20-continued

Unadjusted additive and genotypic association of 149 SNPs with DVT in LETS (p <= 0.1) and MEGA-1 (p <= 0.05)

| | | | | | | | | | | |
|---|---|---|---|---|---|---|---|---|---|---|
| | | LETS | Gen | T | C (0.1914) | C C | 29 (0.0662) | 17 (0.0376) | C T |
| | | | Gen | T | C (0.1914) | C C | 29 (0.0662) | 17 (0.0376) | C T |
| | | MEGA1 | Gen | T | C (0.2049) | C C | 83 (0.0615) | 77 (0.0443) | C T |
| | | | Gen | T | C (0.2049) | C C | 83 (0.0615) | 77 (0.0443) | C T |
| hCV27904396 | (rs4829996) | LETS | rec | A | A (0.2969) | A A | 64 (0.1448) | 79 (0.1744) | A G |
| | | MEGA1 | Gen | A | A (0.2903) | A A | 231 (0.1662) | 335 (0.1914) | A G |
| | | LETS | Gen | A | A (0.2969) | A A | 64 (0.1448) | 79 (0.1744) | A G |
| | | | Gen | A | A (0.2969) | A A | 64 (0.1448) | 79 (0.1744) | A G |
| | | MEGA1 | Gen | A | A (0.2903) | A A | 231 (0.1662) | 335 (0.1914) | A G |
| | | | Gen | A | A (0.2903) | A A | 231 (0.1662) | 335 (0.1914) | A G |
| hCV837462 | (rs528088) | LETS | Gen | A | C (0.0796) | C C | 8 (0.0181) | 2 (0.0044) | C A |
| | | MEGA1 | dom | C | C (0.0785) | C C | 5 (0.0036) | 19 (0.0109) | C A |
| | | LETS | Gen | A | C (0.0796) | C C | 8 (0.0181) | 2 (0.0044) | C A |
| | | | Gen | A | C (0.0796) | C C | 8 (0.0181) | 2 (0.0044) | C A |
| | | MEGA1 | Gen | C | C (0.0785) | C C | 5 (0.0036) | 19 (0.0109) | C A |
| | | | Gen | C | C (0.0785) | C C | 5 (0.0036) | 19 (0.0109) | C A |
| hCV30440155 | (rs6699146) | LETS | add | G | C (0.4148) | C C | 100 (0.2278) | 84 (0.1858) | C G |
| | | MEGA1 | add | G | C (0.4445) | C C | 321 (0.2394) | 344 (0.1969) | C G |
| | | LETS | Gen | G | C (0.4148) | C C | 100 (0.2278) | 84 (0.1858) | C G |
| | | | Gen | G | C (0.4148) | C C | 100 (0.2278) | 84 (0.1858) | C G |
| | | MEGA1 | Gen | G | C (0.4445) | C C | 321 (0.2394) | 344 (0.1969) | C G |
| | | | Gen | G | C (0.4445) | C C | 321 (0.2394) | 344 (0.1969) | C G |
| hCV28960679 | (rs6844764) | LETS | rec | C | C (0.4403) | C C | 74 (0.1674) | 82 (0.1814) | C G |
| | | MEGA1 | dom | C | C (0.4389) | C C | 233 (0.1676) | 358 (0.2054) | C G |
| | | LETS | Gen | C | C (0.4403) | C C | 74 (0.1674) | 82 (0.1814) | C G |
| | | | Gen | C | C (0.4403) | C C | 74 (0.1674) | 82 (0.1814) | C G |
| | | MEGA1 | Gen | C | C (0.4389) | C C | 233 (0.1676) | 358 (0.2054) | C G |
| | | | Gen | C | C (0.4389) | C C | 233 (0.1676) | 358 (0.2054) | C G |
| hCV1952126 | (rs7223784) | LETS | add | C | C (0.3031) | C C | 31 (0.07) | 43 (0.0951) | C A |
| | | MEGA1 | add | C | C (0.2801) | C C | 91 (0.0658) | 147 (0.0839) | C A |
| | | LETS | Gen | C | C (0.3031) | C C | 31 (0.07) | 43 (0.0951) | C A |
| | | | Gen | C | C (0.3031) | C C | 31 (0.07) | 43 (0.0951) | C A |
| | | MEGA1 | Gen | C | C (0.2801) | C C | 91 (0.0658) | 147 (0.0839) | C A |
| | | | Gen | C | C (0.2801) | C C | 91 (0.0658) | 147 (0.0839) | C A |
| hCV31749285 | (rs8178591) | LETS | rec | T | T (0.2914) | T T | 40 (0.0903) | 32 (0.0706) | T C |
| | | MEGA1 | rec | T | T (0.2781) | T T | 86 (0.0618) | 126 (0.072) | T C |
| | | LETS | Gen | T | T (0.2914) | T T | 40 (0.0903) | 32 (0.0706) | T C |
| | | | Gen | T | T (0.2914) | T T | 40 (0.0903) | 32 (0.0706) | T C |
| | | MEGA1 | Gen | T | T (0.2781) | T T | 86 (0.0618) | 126 (0.072) | T C |
| | | | Gen | T | T (0.2781) | T T | 86 (0.0618) | 126 (0.072) | T C |
| hCV3187716 | AGTR1 (rs5186) | LETS | dom | A | C (0.2931) | C C | 44 (0.1005) | 39 (0.0872) | C A |
| | | MEGA1 | add | C | C (0.3088) | C C | 102 (0.0759) | 165 (0.0942) | C A |
| | | LETS | Gen | C | C (0.2931) | C C | 44 (0.1005) | 39 (0.0872) | C A |
| | | | Gen | C | C (0.2931) | C C | 44 (0.1005) | 39 (0.0872) | C A |
| | | MEGA1 | Gen | C | C (0.3088) | C C | 102 (0.0759) | 165 (0.0942) | C A |
| | | | Gen | C | C (0.3088) | C C | 102 (0.0759) | 165 (0.0942) | C A |
| hCV9493081 | AKT3 (rs1058304) | LETS | add | C | T (0.2639) | T T | 50 (0.1131) | 32 (0.071) | T C |
| | | MEGA1 | add | C | T (0.286) | T T | 152 (0.1126) | 128 (0.0729) | T C |
| | | LETS | Gen | C | T (0.2639) | T T | 50 (0.1131) | 32 (0.071) | T C |
| | | | Gen | C | T (0.2639) | T T | 50 (0.1131) | 32 (0.071) | T C |
| | | MEGA1 | Gen | C | T (0.286) | T T | 152 (0.1126) | 128 (0.0729) | T C |
| | | | Gen | C | T (0.286) | T T | 152 (0.1126) | 128 (0.0729) | T C |
| hCV30690780 | AKT3 (rs1073788) | LETS | add | A | C (0.204) | C C | 39 (0.0888) | 21 (0.0466) | C A |
| | | MEGA1 | add | A | C (0.2294) | C C | 114 (0.0845) | 89 (0.051) | C A |
| | | LETS | Gen | A | C (0.204) | C C | 39 (0.0888) | 21 (0.0466) | C A |
| | | | Gen | A | C (0.204) | C C | 39 (0.0888) | 21 (0.0466) | C A |
| | | MEGA1 | Gen | A | C (0.2294) | C C | 114 (0.0845) | 89 (0.051) | C A |
| | | | Gen | A | C (0.2294) | C C | 114 (0.0845) | 89 (0.051) | C A |
| hCV31523557 | AKT3 (rs10754807) | LETS | add | G | A (0.1667) | A A | 24 (0.0544) | 15 (0.0333) | A G |
| | | MEGA1 | add | G | A (0.1935) | A A | 74 (0.0548) | 74 (0.0421) | A G |
| | | LETS | Gen | G | A (0.1667) | A A | 24 (0.0544) | 15 (0.0333) | A G |
| | | | Gen | G | A (0.1667) | A A | 24 (0.0544) | 15 (0.0333) | A G |
| | | MEGA1 | Gen | G | A (0.1935) | A A | 74 (0.0548) | 74 (0.0421) | A G |
| | | | Gen | G | A (0.1935) | A A | 74 (0.0548) | 74 (0.0421) | A G |
| hCV26719108 | AKT3 (rs10927035) | LETS | add | T | C (0.3319) | C C | 70 (0.1584) | 49 (0.1084) | C T |
| | | MEGA1 | add | T | C (0.3579) | C C | 222 (0.1649) | 225 (0.1292) | C T |
| | | LETS | Gen | T | C (0.3319) | C C | 70 (0.1584) | 49 (0.1084) | C T |
| | | | Gen | T | C (0.3319) | C C | 70 (0.1584) | 49 (0.1084) | C T |
| | | MEGA1 | Gen | T | C (0.3579) | C C | 222 (0.1649) | 225 (0.1292) | C T |
| | | | Gen | T | C (0.3579) | C C | 222 (0.1649) | 225 (0.1292) | C T |
| hCV26719121 | AKT3 (rs10927041) | LETS | add | T | C (0.167) | C C | 25 (0.0566) | 15 (0.0332) | C T |
| | | MEGA1 | add | T | C (0.1929) | C C | 72 (0.0534) | 73 (0.0416) | C T |
| | | LETS | Gen | T | C (0.167) | C C | 25 (0.0566) | 15 (0.0332) | C T |
| | | | Gen | T | C (0.167) | C C | 25 (0.0566) | 15 (0.0332) | C T |
| | | MEGA1 | Gen | T | C (0.1929) | C C | 72 (0.0534) | 73 (0.0416) | C T |
| | | | Gen | T | C (0.1929) | C C | 72 (0.0534) | 73 (0.0416) | C T |
| hCV26719227 | AKT3 (rs10927065) | LETS | add | C | A (0.147) | A A | 12 (0.0271) | 10 (0.0223) | A C |
| | | MEGA1 | add | C | A (0.1654) | A A | 52 (0.0385) | 51 (0.0291) | A C |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | C | A (0.147 | A A | 12 (0.0271) | 10 (0.0223) | A C |
| | | | Gen | C | A (0.147 | A A | 12 (0.0271) | 10 (0.0223) | A C |
| | | MEGA1 | Gen | C | A (0.1654 | A A | 52 (0.0385) | 51 (0.0291) | A C |
| | | | Gen | C | A (0.1654 | A A | 52 (0.0385) | 51 (0.0291) | A C |
| hCV31523638 | AKT3 (rs12037013) | LETS | add | G | A (0.1294 | A A | 12 (0.0273) | 9 (0.0199) | A G |
| | | MEGA1 | add | G | A (0.1502 | A A | 40 (0.0296) | 36 (0.0205) | A G |
| | | LETS | Gen | G | A (0.1294 | A A | 12 (0.0273) | 9 (0.0199) | A G |
| | | | Gen | G | A (0.1294 | A A | 12 (0.0273) | 9 (0.0199) | A G |
| | | MEGA1 | Gen | G | A (0.1502 | A A | 40 (0.0296) | 36 (0.0205) | A G |
| | | | Gen | G | A (0.1502 | A A | 40 (0.0296) | 36 (0.0205) | A G |
| hCV30690777 | AKT3 (rs12045585) | MEGA1 | add | G | A (0.1439 | A A | 36 (0.0267) | 27 (0.0154) | A G |
| | | LETS | add | G | A (0.1396 | A A | 11 (0.0253) | 8 (0.018) | A G |
| | | LETS | Gen | G | A (0.1396 | A A | 11 (0.0253) | 8 (0.018) | A G |
| | | | Gen | G | A (0.1396 | A A | 11 (0.0253) | 8 (0.018) | A G |
| | | MEGA1 | Gen | G | A (0.1439 | A A | 36 (0.0267) | 27 (0.0154) | A G |
| | | | Gen | G | A (0.1439 | A A | 36 (0.0267) | 27 (0.0154) | A G |
| hCV31523650 | KT3 (rs12048930) | LETS | add | C | T (0.18 | T T | 25 (0.0571) | 16 (0.0356) | T C |
| | | MEGA1 | add | C | T (0.2011 | T T | 74 (0.0536) | 82 (0.0468) | T C |
| | | LETS | Gen | C | T (0.18 | T T | 25 (0.0571) | 16 (0.0356) | T C |
| | | | Gen | C | T (0.18 | T T | 25 (0.0571) | 16 (0.0356) | T C |
| | | MEGA1 | Gen | C | T (0.2011 | T T | 74 (0.0536) | 82 (0.0468) | T C |
| | | | Gen | C | T (0.2011 | T T | 74 (0.0536) | 82 (0.0468) | T C |
| hCV30690778 | KT3 (rs12140414) | LETS | add | T | C (0.1718 | C C | 19 (0.0433) | 15 (0.0333) | C T |
| | | MEGA1 | add | T | C (0.1872 | C C | 59 (0.0437) | 52 (0.0296) | C T |
| | | LETS | Gen | T | C (0.1718 | C C | 19 (0.0433) | 15 (0.0333) | C T |
| | | | Gen | T | C (0.1718 | C C | 19 (0.0433) | 15 (0.0333) | C T |
| | | MEGA1 | Gen | T | C (0.1872 | C C | 59 (0.0437) | 52 (0.0296) | C T |
| | | | Gen | T | C (0.1872 | C C | 59 (0.0437) | 52 (0.0296) | C T |
| hCV31523608 | KT3 (rs12744297) | MEGA1 | add | A | G (0.3236 | G G | 186 (0.138) | 197 (0.1124) | G A |
| | | LETS | add | A | G (0.296 | G G | 57 (0.1293) | 43 (0.0953) | G A |
| | | LETS | Gen | A | G (0.296 | G G | 57 (0.1293) | 43 (0.0953) | G A |
| | | | Gen | A | G (0.296 | G G | 57 (0.1293) | 43 (0.0953) | G A |
| | | MEGA1 | Gen | A | G (0.3236 | G G | 186 (0.138) | 197 (0.1124) | G A |
| | | | Gen | A | G (0.3236 | G G | 186 (0.138) | 197 (0.1124) | G A |
| hCV233148 | AKT3 (rs1417121) | LETS | add | G | C (0.2627 | C C | 50 (0.1129) | 32 (0.0706) | C G |
| | | MEGA1 | add | G | C (0.2854 | C C | 163 (0.1174) | 129 (0.0734) | C G |
| | | LETS | Gen | G | C (0.2627 | C C | 50 (0.1129) | 32 (0.0706) | C G |
| | | | Gen | G | C (0.2627 | C C | 50 (0.1129) | 32 (0.0706) | C G |
| | | MEGA1 | Gen | G | C (0.2854 | C C | 163 (0.1174) | 129 (0.0734) | C G |
| | | | Gen | G | C (0.2854 | C C | 163 (0.1174) | 129 (0.0734) | C G |
| hCV12073840 | AKT3 (rs14403) | LETS | Gen | C | T (0.2228 | T T | 29 (0.0664) | 24 (0.0532) | T C |
| | | MEGA1 | Gen | C | T (0.2392 | T T | 90 (0.0668) | 85 (0.0484) | T C |
| | | LETS | Gen | C | T (0.2228 | T T | 29 (0.0664) | 24 (0.0532) | T C |
| | | | Gen | C | T (0.2228 | T T | 29 (0.0664) | 24 (0.0532) | T C |
| | | MEGA1 | Gen | C | T (0.2392 | T T | 90 (0.0668) | 85 (0.0484) | T C |
| | | | Gen | C | T (0.2392 | T T | 90 (0.0668) | 85 (0.0484) | T C |
| hCV1678674 | AKT3 (rs1458023) | LETS | add | T | C (0.1808 | C C | 31 (0.0711) | 18 (0.0402) | C T |
| | | MEGA1 | add | T | C (0.2008 | C C | 80 (0.0593) | 82 (0.0468) | C T |
| | | LETS | Gen | T | C (0.1808 | C C | 31 (0.0711) | 18 (0.0402) | C T |
| | | | Gen | T | C (0.1808 | C C | 31 (0.0711) | 18 (0.0402) | C T |
| | | MEGA1 | Gen | T | C (0.2008 | C C | 80 (0.0593) | 82 (0.0468) | C T |
| | | | Gen | T | C (0.2008 | C C | 80 (0.0593) | 82 (0.0468) | C T |
| hCV97631 | AKT3 (rs1538773) | LETS | add | T | G (0.2051 | G G | 35 (0.0794) | 21 (0.0466) | G T |
| | | MEGA1 | add | T | G (0.2279 | G G | 102 (0.0756) | 89 (0.0508) | G T |
| | | LETS | Gen | T | G (0.2051 | G G | 35 (0.0794) | 21 (0.0466) | G T |
| | | | Gen | T | G (0.2051 | G G | 35 (0.0794) | 21 (0.0466) | G T |
| | | MEGA1 | Gen | T | G (0.2279 | G G | 102 (0.0756) | 89 (0.0508) | G T |
| | | | Gen | T | G (0.2279 | G G | 102 (0.0756) | 89 (0.0508) | G T |
| hCV8688111 | AKT3 (rs1578275) | LETS | add | G | C (0.167 | C C | 20 (0.0459) | 12 (0.0269) | C G |
| | | MEGA1 | add | G | C (0.1846 | C C | 58 (0.0432) | 52 (0.0298) | C G |
| | | LETS | Gen | G | C (0.167 | C C | 20 (0.0459) | 12 (0.0269) | C G |
| | | | Gen | G | C (0.167 | C C | 20 (0.0459) | 12 (0.0269) | C G |
| | | MEGA1 | Gen | G | C (0.1846 | C C | 58 (0.0432) | 52 (0.0298) | C G |
| | | | Gen | G | C (0.1846 | C C | 58 (0.0432) | 52 (0.0298) | C G |
| hCV15885425 | AKT3 (rs2290754) | LETS | add | A | C (0.1726 | C C | 27 (0.0615) | 15 (0.0332) | C A |
| | | MEGA1 | add | A | C (0.199 | C C | 76 (0.0564) | 85 (0.0485) | C A |
| | | LETS | Gen | A | C (0.1726 | C C | 27 (0.0615) | 15 (0.0332) | C A |
| | | | Gen | A | C (0.1726 | C C | 27 (0.0615) | 15 (0.0332) | C A |
| | | MEGA1 | Gen | A | C (0.199 | C C | 76 (0.0564) | 85 (0.0485) | C A |
| | | | Gen | A | C (0.199 | C C | 76 (0.0564) | 85 (0.0485) | C A |
| hCV1678682 | AKT3 (rs320339) | LETS | add | G | T (0.1752 | T T | 30 (0.0683) | 18 (0.0402) | T G |
| | | MEGA1 | add | G | T (0.1945 | T T | 84 (0.0624) | 75 (0.0428) | T G |
| | | LETS | Gen | G | T (0.1752 | T T | 30 (0.0683) | 18 (0.0402) | T G |
| | | | Gen | G | T (0.1752 | T T | 30 (0.0683) | 18 (0.0402) | T G |
| | | MEGA1 | Gen | G | T (0.1945 | T T | 84 (0.0624) | 75 (0.0428) | T G |
| | | | Gen | G | T (0.1945 | T T | 84 (0.0624) | 75 (0.0428) | T G |
| hCV29210363 | AKT3 (rs6656918) | LETS | add | A | G (0.2062 | G G | 38 (0.0868) | 22 (0.0488) | G A |
| | | MEGA1 | add | A | G (0.2303 | G G | 111 (0.0823) | 91 (0.0519) | G A |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | A | G (0.2062) | G G | 38 (0.0868) | 22 (0.0488) | G A |
| | | | Gen | A | G (0.2062) | G G | 38 (0.0868) | 22 (0.0488) | G A |
| | | MEGA1 | Gen | A | G (0.2303) | G G | 111 (0.0823) | 91 (0.0519) | G A |
| | | | Gen | A | G (0.2303) | G G | 111 (0.0823) | 91 (0.0519) | G A |
| hCV31523643 | AKT3 (rs6671475) | LETS | add | A | G (0.1737) | G G | 27 (0.0611) | 15 (0.0332) | G A |
| | | MEGA1 | add | A | G (0.198) | G G | 76 (0.0563) | 80 (0.0457) | G A |
| | | LETS | Gen | A | G (0.1737) | G G | 27 (0.0611) | 15 (0.0332) | G A |
| | | | Gen | A | G (0.1737) | G G | 27 (0.0611) | 15 (0.0332) | G A |
| | | MEGA1 | Gen | A | G (0.198) | G G | 76 (0.0563) | 80 (0.0457) | G A |
| | | | Gen | A | G (0.198) | G G | 76 (0.0563) | 80 (0.0457) | G A |
| hCV26719113 | AKT3 (rs7517340) | LETS | add | C | T (0.1602) | T T | 24 (0.0557) | 16 (0.0364) | T C |
| | | MEGA1 | add | C | T (0.1871) | T T | 78 (0.058) | 67 (0.0384) | T C |
| | | LETS | Gen | C | T (0.1602) | T T | 24 (0.0557) | 16 (0.0364) | T C |
| | | | Gen | C | T (0.1602) | T T | 24 (0.0557) | 16 (0.0364) | T C |
| | | MEGA1 | Gen | C | T (0.1871) | T T | 78 (0.058) | 67 (0.0384) | T C |
| | | | Gen | C | T (0.1871) | T T | 78 (0.058) | 67 (0.0384) | T C |
| hCV26034142 | AKT3 (rs9428576) | LETS | add | T | C (0.4347) | C C | 112 (0.2534) | 96 (0.2124) | C T |
| | | MEGA1 | rec | T | C (0.4504) | C C | 318 (0.2359) | 346 (0.1974) | C T |
| | | LETS | Gen | T | C (0.4347) | C C | 112 (0.2534) | 96 (0.2124) | C T |
| | | | Gen | T | C (0.4347) | C C | 112 (0.2534) | 96 (0.2124) | C T |
| | | MEGA1 | Gen | T | C (0.4504) | C C | 318 (0.2359) | 346 (0.1974) | C T |
| | | | Gen | T | C (0.4504) | C C | 318 (0.2359) | 346 (0.1974) | C T |
| hCV2303891 | POH (rs1801690) | MEGA1 | add | G | G (0.0555) | G G | 4 (0.0029) | 3 (0.0017) | G C |
| | | LETS | add | G | G (0.0512) | G G | 0 (0) | 1 (0.0022) | G C |
| | | LETS | Gen | G | G (0.0512) | G G | 0 (0) | 1 (0.0022) | G C |
| | | | Gen | G | G (0.0512) | G G | 0 (0) | 1 (0.0022) | G C |
| | | MEGA1 | Gen | G | G (0.0555) | G G | 4 (0.0029) | 3 (0.0017) | G C |
| | | | Gen | G | G (0.0555) | G G | 4 (0.0029) | 3 (0.0017) | G C |
| hCV2456747 | Corf114 (rs3820059) | MEGA1 | add | G | A (0.3342) | A A | 212 (0.152) | 215 (0.1229) | A G |
| | | LETS | add | G | A (0.2969) | A A | 55 (0.1244) | 44 (0.0971) | A G |
| | | LETS | Gen | G | A (0.2969) | A A | 55 (0.1244) | 44 (0.0971) | A G |
| | | | Gen | G | A (0.2969) | A A | 55 (0.1244) | 44 (0.0971) | A G |
| | | MEGA1 | Gen | G | A (0.3342) | A A | 212 (0.152) | 215 (0.1229) | A G |
| | | | Gen | G | A (0.3342) | A A | 212 (0.152) | 215 (0.1229) | A G |
| hCV2403368 | QTNF6 (rs2295261) | LETS | rec | C | C (0.2594) | C C | 25 (0.0566) | 26 (0.0574) | C G |
| | | MEGA1 | rec | C | C (0.2484) | C C | 78 (0.056) | 106 (0.0604) | C G |
| | | LETS | Gen | C | C (0.2594) | C C | 25 (0.0566) | 26 (0.0574) | C G |
| | | | Gen | C | C (0.2594) | C C | 25 (0.0566) | 26 (0.0574) | C G |
| | | MEGA1 | Gen | C | C (0.2484) | C C | 78 (0.056) | 106 (0.0604) | C G |
| | | | Gen | C | C (0.2484) | C C | 78 (0.056) | 106 (0.0604) | C G |
| hCV7574127 | Corf167 (rs1737145) | LETS | add | G | G (0.4746) | G G | 80 (0.181) | 97 (0.2141) | G A |
| | | MEGA1 | add | G | G (0.4837) | G G | 292 (0.2108) | 424 (0.242) | G A |
| | | LETS | Gen | G | G (0.4746) | G G | 80 (0.181) | 97 (0.2141) | G A |
| | | | Gen | G | G (0.4746) | G G | 80 (0.181) | 97 (0.2141) | G A |
| | | MEGA1 | Gen | G | G (0.4837) | G G | 292 (0.2108) | 424 (0.242) | G A |
| | | | Gen | G | G (0.4837) | G G | 292 (0.2108) | 424 (0.242) | G A |
| hCV25959498 | Corf46 (rs34518648) | LETS | add | A | A (0.083) | A A | 1 (0.0023) | 6 (0.0133) | A G |
| | | MEGA1 | add | A | A (0.0843) | A A | 6 (0.0043) | 17 (0.0097) | A G |
| | | LETS | Gen | A | A (0.083) | A A | 1 (0.0023) | 6 (0.0133) | A G |
| | | | Gen | A | A (0.083) | A A | 1 (0.0023) | 6 (0.0133) | A G |
| | | MEGA1 | Gen | A | A (0.0843) | A A | 6 (0.0043) | 17 (0.0097) | A G |
| | | | Gen | A | A (0.0843) | A A | 6 (0.0043) | 17 (0.0097) | A G |
| hCV25959466 | Corf46 (rs35495590) | MEGA1 | add | C | C (0.0854) | C C | 7 (0.005) | 18 (0.0103) | C T |
| | | LETS | add | C | C (0.0808) | C C | 1 (0.0023) | 5 (0.0111) | C T |
| | | LETS | Gen | C | C (0.0808) | C C | 1 (0.0023) | 5 (0.0111) | C T |
| | | | Gen | C | C (0.0808) | C C | 1 (0.0023) | 5 (0.0111) | C T |
| | | MEGA1 | Gen | C | C (0.0854) | C C | 7 (0.005) | 18 (0.0103) | C T |
| | | | Gen | C | C (0.0854) | C C | 7 (0.005) | 18 (0.0103) | C T |
| hCV25768636 | CCDC36 (rs4279134) | MEGA1 | rec | G | A (0.3444) | A A | 188 (0.1356) | 194 (0.1105) | A G |
| | | LETS | rec | G | A (0.3271) | A A | 68 (0.1538) | 48 (0.1064) | A G |
| | | LETS | Gen | G | A (0.3271) | A A | 68 (0.1538) | 48 (0.1064) | A G |
| | | | Gen | G | A (0.3271) | A A | 68 (0.1538) | 48 (0.1064) | A G |
| | | MEGA1 | Gen | G | A (0.3444) | A A | 188 (0.1356) | 194 (0.1105) | A G |
| | | | Gen | G | A (0.3444) | A A | 188 (0.1356) | 194 (0.1105) | A G |
| hCV25991132 | CCDC41 ( ) | MEGA1 | rec | A | A (0.0924) | A A | 13 (0.0094) | 6 (0.0034) | A G |
| | | LETS | rec | A | A (0.0971) | A A | 1 (0.0023) | 5 (0.011) | A G |
| | | LETS | Gen | A | A (0.0971) | A A | 1 (0.0023) | 5 (0.011) | A G |
| | | | Gen | A | A (0.0971) | A A | 1 (0.0023) | 5 (0.011) | A G |
| | | MEGA1 | Gen | A | A (0.0924) | A A | 13 (0.0094) | 6 (0.0034) | A G |
| | | | Gen | A | A (0.0924) | A A | 13 (0.0094) | 6 (0.0034) | A G |
| hCV3164397 | CMYA5 (rs10043986) | LETS | rec | T | T (0.1678) | T T | 9 (0.0204) | 8 (0.0177) | T C |
| | | MEGA1 | dom | T | T (0.1359) | T T | 12 (0.0086) | 34 (0.0194) | T C |
| | | LETS | Gen | T | T (0.1678) | T T | 9 (0.0204) | 8 (0.0177) | T C |
| | | | Gen | T | T (0.1678) | T T | 9 (0.0204) | 8 (0.0177) | T C |
| | | MEGA1 | Gen | T | T (0.1359) | T T | 12 (0.0086) | 34 (0.0194) | T C |
| | | | Gen | T | T (0.1359) | T T | 12 (0.0086) | 34 (0.0194) | T C |
| hCV3230083 | CYP4V2 (rs10013653) | MEGA1 | Gen | C | A (0.4278) | A A | 282 (0.2098) | 329 (0.1877) | A C |
| | | LETS | Gen | C | A (0.4533) | A A | 97 (0.2195) | 100 (0.2222) | A C |

TABLE 20-continued

Unadjusted additive and genotypic association of 149 SNPs with DVT in LETS (p <= 0.1) and MEGA-1 (p <= 0.05)

| hCV ID | Gene (rsID) | Study | Model | A1 | A2 (freq) | GT | Count1 (freq) | Count2 (freq) | Alleles |
|---|---|---|---|---|---|---|---|---|---|
| | | LETS | Gen | C | A (0.4533) | A A | 97 (0.2195) | 100 (0.2222) | A C |
| | | | Gen | C | A (0.4533) | A A | 97 (0.2195) | 100 (0.2222) | A C |
| | | MEGA1 | Gen | C | A (0.4278) | A A | 282 (0.2098) | 329 (0.1877) | A C |
| | | | Gen | C | A (0.4278) | A A | 282 (0.2098) | 329 (0.1877) | A C |
| hCV25990131 | CYP4V2 (rs13146272) | MEGA1 | add | C | C (0.36 | C C | 149 (0.1067) | 229 (0.1306) | C A |
| | | LETS | add | C | C (0.3492) | C C | 32 (0.0726) | 63 (0.1397) | C A |
| | | LETS | Gen | C | C (0.3492) | C C | 32 (0.0726) | 63 (0.1397) | C A |
| | | | Gen | C | C (0.3492) | C C | 32 (0.0726) | 63 (0.1397) | C A |
| | | MEGA1 | Gen | C | C (0.36 | C C | 149 (0.1067) | 229 (0.1306) | C A |
| | | | Gen | C | C (0.36 | C C | 149 (0.1067) | 229 (0.1306) | C A |
| hCV15968043 | CYP4V2 (rs2292423) | MEGA1 | dom | T | A (0.4126) | A A | 292 (0.2108) | 300 (0.172) | A T |
| | | LETS | dom | T | A (0.4327) | A A | 97 (0.219) | 92 (0.2031) | A T |
| | | LETS | Gen | T | A (0.4327) | A A | 97 (0.219) | 92 (0.2031) | A T |
| | | | Gen | T | A (0.4327) | A A | 97 (0.219) | 92 (0.2031) | A T |
| | | MEGA1 | Gen | T | A (0.4126) | A A | 292 (0.2108) | 300 (0.172) | A T |
| | | | Gen | T | A (0.4126) | A A | 292 (0.2108) | 300 (0.172) | A T |
| hCV3230096 | CYP4V2 (rs3817184) | LETS | dom | C | T (0.4369) | T T | 95 (0.2149) | 92 (0.2035) | T C |
| | | MEGA1 | dom | C | T (0.4164) | T T | 301 (0.2165) | 309 (0.1776) | T C |
| | | LETS | Gen | C | T (0.4369) | T T | 95 (0.2149) | 92 (0.2035) | T C |
| | | | Gen | C | T (0.4369) | T T | 95 (0.2149) | 92 (0.2035) | T C |
| | | MEGA1 | Gen | C | T (0.4164) | T T | 301 (0.2165) | 309 (0.1776) | T C |
| | | | Gen | C | T (0.4164) | T T | 301 (0.2165) | 309 (0.1776) | T C |
| hCV11786147 | CYP4V2 (rs4862662) | LETS | dom | G | T (0.433) | T T | 94 (0.2151) | 90 (0.2009) | T G |
| | | MEGA1 | dom | G | T (0.4111) | T T | 278 (0.2065) | 303 (0.1731) | T G |
| | | LETS | Gen | G | T (0.433) | T T | 94 (0.2151) | 90 (0.2009) | T G |
| | | | Gen | G | T (0.433) | T T | 94 (0.2151) | 90 (0.2009) | T G |
| | | MEGA1 | Gen | G | T (0.4111) | T T | 278 (0.2065) | 303 (0.1731) | T G |
| | | | Gen | G | T (0.4111) | T T | 278 (0.2065) | 303 (0.1731) | T G |
| hCV3230084 | CYP4V2 (rs7682918) | MEGA1 | Gen | C | T (0.3945) | T T | 247 (0.1839) | 288 (0.1648) | T C |
| | | LETS | Gen | C | T (0.4257) | T T | 75 (0.1705) | 87 (0.1929) | T C |
| | | LETS | Gen | C | T (0.4257) | T T | 75 (0.1705) | 87 (0.1929) | T C |
| | | | Gen | C | T (0.4257) | T T | 75 (0.1705) | 87 (0.1929) | T C |
| | | MEGA1 | Gen | C | T (0.3945) | T T | 247 (0.1839) | 288 (0.1648) | T C |
| | | | Gen | C | T (0.3945) | T T | 247 (0.1839) | 288 (0.1648) | T C |
| hCV26265231 | CYP4V2 (rs7684025) | MEGA1 | dom | G | A (0.459) | A A | 335 (0.2496) | 373 (0.2141) | A G |
| | | LETS | dom | G | A (0.4812) | A A | 116 (0.2619) | 116 (0.2561) | A G |
| | | LETS | Gen | G | A (0.4812) | A A | 116 (0.2619) | 116 (0.2561) | A G |
| | | | Gen | G | A (0.4812) | A A | 116 (0.2619) | 116 (0.2561) | A G |
| | | MEGA1 | Gen | G | A (0.459) | A A | 335 (0.2496) | 373 (0.2141) | A G |
| | | | Gen | G | A (0.459) | A A | 335 (0.2496) | 373 (0.2141) | A G |
| hCV9860072 | DHX38 (rs1050362) | LETS | Gen | C | A (0.3521) | A A | 62 (0.14) | 62 (0.1369) | A C |
| | | MEGA1 | Gen | C | A (0.354) | A A | 205 (0.1488) | 220 (0.1259) | A C |
| | | LETS | Gen | C | A (0.3521) | A A | 62 (0.14) | 62 (0.1369) | A C |
| | | | Gen | C | A (0.3521) | A A | 62 (0.14) | 62 (0.1369) | A C |
| | | MEGA1 | Gen | C | A (0.354) | A A | 205 (0.1488) | 220 (0.1259) | A C |
| | | | Gen | C | A (0.354) | A A | 205 (0.1488) | 220 (0.1259) | A C |
| hCV2103346 | DKFZP564J102 (rs11733307) | LETS | rec | T | C (0.4257) | C C | 104 (0.2358) | 77 (0.1707) | C T |
| | | MEGA1 | dom | T | C (0.4422) | C C | 301 (0.2231) | 359 (0.2046) | C T |
| | | LETS | Gen | T | C (0.4257) | C C | 104 (0.2358) | 77 (0.1707) | C T |
| | | | Gen | T | C (0.4257) | C C | 104 (0.2358) | 77 (0.1707) | C T |
| | | MEGA1 | Gen | T | C (0.4422) | C C | 301 (0.2231) | 359 (0.2046) | C T |
| | | | Gen | T | C (0.4422) | C C | 301 (0.2231) | 359 (0.2046) | C T |
| hCV12086148 | DKFZP564J102 (rs1877321) | LETS | rec | A | A (0.2417) | A A | 24 (0.0544) | 25 (0.0554) | A G |
| | | MEGA1 | Gen | A | A (0.2363) | A A | 56 (0.0404) | 100 (0.0573) | A G |
| | | LETS | Gen | A | A (0.2417) | A A | 24 (0.0544) | 25 (0.0554) | A G |
| | | | Gen | A | A (0.2417) | A A | 24 (0.0544) | 25 (0.0554) | A G |
| | | MEGA1 | Gen | A | A (0.2363) | A A | 56 (0.0404) | 100 (0.0573) | A G |
| | | | Gen | A | A (0.2363) | A A | 56 (0.0404) | 100 (0.0573) | A G |
| hCV25473516 | DUSSP11 (rs2272051) | LETS | Gen | C | T (0.365) | T T | 70 (0.1584) | 53 (0.1173) | T C |
| | | MEGA1 | Gen | C | T (0.3501) | T T | 206 (0.1483) | 209 (0.1194) | T C |
| | | LETS | Gen | C | T (0.365) | T T | 70 (0.1584) | 53 (0.1173) | T C |
| | | | Gen | C | T (0.365) | T T | 70 (0.1584) | 53 (0.1173) | T C |
| | | MEGA1 | Gen | C | T (0.3501) | T T | 206 (0.1483) | 209 (0.1194) | T C |
| | | | Gen | C | T (0.3501) | T T | 206 (0.1483) | 209 (0.1194) | T C |
| hCV15871021 | EBF1 (rs2072495) | LETS | rec | A | A (0.4084) | A A | 70 (0.1584) | 66 (0.1457) | A G |
| | | MEGA1 | dom | A | A (0.3927) | A A | 168 (0.1206) | 269 (0.154) | A G |
| | | LETS | Gen | A | A (0.4084) | A A | 70 (0.1584) | 66 (0.1457) | A G |
| | | | Gen | A | A (0.4084) | A A | 70 (0.1584) | 66 (0.1457) | A G |
| | | MEGA1 | Gen | A | A (0.3927) | A A | 168 (0.1206) | 269 (0.154) | A G |
| | | | Gen | A | A (0.3927) | A A | 168 (0.1206) | 269 (0.154) | A G |
| hCV491830 | EPS8L2 (rs3087546) | LETS | add | C | C (0.4601) | C C | 74 (0.1689) | 94 (0.2084) | C T |
| | | MEGA1 | add | C | C (0.4385) | C C | 236 (0.17) | 356 (0.2035) | C T |
| | | LETS | Gen | C | C (0.4601) | C C | 74 (0.1689) | 94 (0.2084) | C T |
| | | | Gen | C | C (0.4601) | C C | 74 (0.1689) | 94 (0.2084) | C T |
| | | MEGA1 | Gen | C | C (0.4385) | C C | 236 (0.17) | 356 (0.2035) | C T |
| | | | Gen | C | C (0.4385) | C C | 236 (0.17) | 356 (0.2035) | C T |
| hCV2017876 | EPS8L3 (rs3818562) | LETS | add | A | A (0.4889) | A A | 96 (0.2167) | 113 (0.25) | A G |
| | | MEGA1 | add | A | A (0.4794) | A A | 282 (0.2049) | 394 (0.2254) | A G |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | A | A (0.4889) | A A | 96 (0.2167) | 113 (0.25) | A G |
| | | | Gen | A | A (0.4889) | A A | 96 (0.2167) | 113 (0.25) | A G |
| | | MEGA1 | Gen | A | A (0.4794) | A A | 282 (0.2049) | 394 (0.2254) | A G |
| | | | Gen | A | A (0.4794) | A A | 282 (0.2049) | 394 (0.2254) | A G |
| hCV12066124 | F11 (rs2036914) | MEGA1 | add | T | T (0.4786) | T T | 233 (0.1675) | 407 (0.232) | T C |
| | | LETS | add | T | T (0.457) | T T | 69 (0.1558) | 99 (0.2185) | T C |
| | | LETS | Gen | T | T (0.457) | T T | 69 (0.1558) | 99 (0.2185) | T C |
| | | | Gen | T | T (0.457) | T T | 69 (0.1558) | 99 (0.2185) | T C |
| | | MEGA1 | Gen | T | T (0.4786) | T T | 233 (0.1675) | 407 (0.232) | T C |
| | | | Gen | T | T (0.4786) | T T | 233 (0.1675) | 407 (0.232) | T C |
| hCV16172935 | F11 (rs2241817) | LETS | rec | G | G (0.3451) | G G | 52 (0.1176) | 46 (0.1018) | G A |
| | | MEGA1 | rec | G | G (0.358) | G G | 139 (0.1004) | 219 (0.1259) | G A |
| | | LETS | Gen | G | G (0.3451) | G G | 52 (0.1176) | 46 (0.1018) | G A |
| | | | Gen | G | G (0.3451) | G G | 52 (0.1176) | 46 (0.1018) | G A |
| | | MEGA1 | Gen | G | G (0.358) | G G | 139 (0.1004) | 219 (0.1259) | G A |
| | | | Gen | G | G (0.358) | G G | 139 (0.1004) | 219 (0.1259) | G A |
| hCV3230038 | F11 (rs2289252) | LETS | add | C | T (0.4279) | T T | 107 (0.2426) | 93 (0.2062) | T C |
| | | MEGA1 | add | C | T (0.4166) | T T | 314 (0.2331) | 309 (0.1766) | T C |
| | | LETS | Gen | C | T (0.4279) | T T | 107 (0.2426) | 93 (0.2062) | T C |
| | | | Gen | C | T (0.4279) | T T | 107 (0.2426) | 93 (0.2062) | T C |
| | | MEGA1 | Gen | C | T (0.4166) | T T | 314 (0.2331) | 309 (0.1766) | T C |
| | | | Gen | C | T (0.4166) | T T | 314 (0.2331) | 309 (0.1766) | T C |
| hCV27474895 | F11 (rs3756011) | MEGA1 | add | C | A (0.4182) | A A | 326 (0.2364) | 312 (0.1785) | A C |
| | | LETS | add | C | A (0.4248) | A A | 107 (0.2415) | 92 (0.2035) | A C |
| | | LETS | Gen | C | A (0.4248) | A A | 107 (0.2415) | 92 (0.2035) | A C |
| | | | Gen | C | A (0.4248) | A A | 107 (0.2415) | 92 (0.2035) | A C |
| | | MEGA1 | Gen | C | A (0.4182) | A A | 326 (0.2364) | 312 (0.1785) | A C |
| | | | Gen | C | A (0.4182) | A A | 326 (0.2364) | 312 (0.1785) | A C |
| hCV25474413 | F11 (rs3822057) | LETS | Gen | A | A (0.4912) | A A | 91 (0.2054) | 116 (0.2561) | A C |
| | | MEGA1 | Gen | A | A (0.51) | A A | 269 (0.1971) | 457 (0.2604) | A C |
| | | LETS | Gen | A | A (0.4912) | A A | 91 (0.2054) | 116 (0.2561) | A C |
| | | | Gen | A | A (0.4912) | A A | 91 (0.2054) | 116 (0.2561) | A C |
| | | MEGA1 | Gen | A | A (0.51) | A A | 269 (0.1971) | 457 (0.2604) | A C |
| | | | Gen | A | A (0.51) | A A | 269 (0.1971) | 457 (0.2604) | A C |
| hCV27490984 | F11 (rs3822058) | LETS | rec | A | A (0.3462) | A A | 54 (0.1222) | 46 (0.1018) | A G |
| | | MEGA1 | rec | A | A (0.3589) | A A | 135 (0.097) | 219 (0.1254) | A G |
| | | LETS | Gen | A | A (0.3462) | A A | 54 (0.1222) | 46 (0.1018) | A G |
| | | | Gen | A | A (0.3462) | A A | 54 (0.1222) | 46 (0.1018) | A G |
| | | MEGA1 | Gen | A | A (0.3589) | A A | 135 (0.097) | 219 (0.1254) | A G |
| | | | Gen | A | A (0.3589) | A A | 135 (0.097) | 219 (0.1254) | A G |
| hCV25474414 | F11 (rs4253399) | MEGA1 | add | T | G (0.3872) | G G | 278 (0.2067) | 264 (0.1504) | G T |
| | | LETS | add | T | G (0.3902) | G G | 94 (0.2132) | 80 (0.1774) | G T |
| | | LETS | Gen | T | G (0.3902) | G G | 94 (0.2132) | 80 (0.1774) | G G |
| | | | Gen | T | G (0.3902) | G G | 94 (0.2132) | 80 (0.1774) | G T |
| | | MEGA1 | Gen | T | G (0.3872) | G G | 278 (0.2067) | 264 (0.1504) | G T |
| | | | Gen | T | G (0.3872) | G G | 278 (0.2067) | 264 (0.1504) | G T |
| hCV26038139 | F11 (rs4253405) | MEGA1 | Gen | G | G (0.3744) | G G | 142 (0.102) | 249 (0.1421) | G A |
| | | LETS | Gen | G | G (0.3639) | G G | 63 (0.1429) | 52 (0.115) | G A |
| | | LETS | Gen | G | G (0.3639) | G G | 63 (0.1429) | 52 (0.115) | G A |
| | | | Gen | G | G (0.3639) | G G | 63 (0.1429) | 52 (0.115) | G A |
| | | MEGA1 | Gen | G | G (0.3744) | G G | 142 (0.102) | 249 (0.1421) | G A |
| | | | Gen | G | G (0.3744) | G G | 142 (0.102) | 249 (0.1421) | G A |
| hCV3230119 | F11 (rs4253430) | LETS | rec | C | C (0.3518) | C C | 52 (0.1179) | 48 (0.1062) | C G |
| | | MEGA1 | rec | C | C (0.3562) | C C | 135 (0.0971) | 218 (0.1244) | C G |
| | | LETS | Gen | C | C (0.3518) | C C | 52 (0.1179) | 48 (0.1062) | C G |
| | | | Gen | C | C (0.3518) | C C | 52 (0.1179) | 48 (0.1062) | C G |
| | | MEGA1 | Gen | C | C (0.3562) | C C | 135 (0.0971) | 218 (0.1244) | C G |
| | | | Gen | C | C (0.3562) | C C | 135 (0.0971) | 218 (0.1244) | C G |
| hCV8241630 | F11 (rs925451) | MEGA1 | add | G | A (0.3886) | A A | 289 (0.2128) | 272 (0.1554) | A G |
| | | LETS | add | G | A (0.4071) | A A | 95 (0.2154) | 87 (0.1925) | A G |
| | | LETS | Gen | G | A (0.4071) | A A | 95 (0.2154) | 87 (0.1925) | A G |
| | | | Gen | G | A (0.4071) | A A | 95 (0.2154) | 87 (0.1925) | A G |
| | | MEGA1 | Gen | G | A (0.3886) | A A | 289 (0.2128) | 272 (0.1554) | A G |
| | | | Gen | G | A (0.3886) | A A | 289 (0.2128) | 272 (0.1554) | A G |
| hCV8726802 | F2 (rs1799963) | MEGA1 | add | G | A (0.0106) | A A | 0 (0) | 0 (0) | A G |
| | | LETS | add | G | A (0.0111) | A A | 0 (0) | 0 (0) | A G |
| | | LETS | Gen | G | G (0.0111) | G G | 0 (0) | 0 (0) | G A |
| | | MEGA1 | Gen | G | A (0.0106) | A A | 0 (0) | 0 (0) | A G |
| hCV27480803 | F5 (rs3766103) | MEGA1 | add | T | C (0.4411) | C C | 346 (0.2493) | 351 (0.2008) | C T |
| | | LETS | add | T | C (0.4062) | C C | 96 (0.2177) | 73 (0.1611) | C T |
| | | LETS | Gen | T | C (0.4062) | C C | 96 (0.2177) | 73 (0.1611) | C T |
| | | | Gen | T | C (0.4062) | C C | 96 (0.2177) | 73 (0.1611) | C T |
| | | MEGA1 | Gen | T | C (0.4411) | C C | 346 (0.2493) | 351 (0.2008) | C T |
| | | | Gen | T | C (0.4411) | C C | 346 (0.2493) | 351 (0.2008) | C T |
| hCV8919444 | F5 (rs4524) | MEGA1 | add | C | C (0.2553) | C C | 76 (0.0548) | 107 (0.0611) | C T |
| | | LETS | add | C | C (0.2577) | C C | 24 (0.0542) | 32 (0.0708) | C T |
| | | LETS | Gen | C | C (0.2577) | C C | 24 (0.0542) | 32 (0.0708) | C T |
| | | | Gen | C | C (0.2577) | C C | 24 (0.0542) | 32 (0.0708) | C T |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | MEGA1 | Gen | C | C (0.2553) | C C | 76 (0.0548) | 107 (0.0611) | C T |
| | | | Gen | C | C (0.2553) | C C | 76 (0.0548) | 107 (0.0611) | C T |
| hCV8919442 | F5 (rs4525) | MEGA1 | add | C | C (0.2558) | C C | 74 (0.0541) | 107 (0.0609) | C T |
| | | LETS | add | C | C (0.2556) | C C | 25 (0.0568) | 31 (0.0689) | C T |
| | | LETS | Gen | C | C (0.2556) | C C | 25 (0.0568) | 31 (0.0689) | C T |
| | | | Gen | C | C (0.2556) | C C | 25 (0.0568) | 31 (0.0689) | C T |
| | | MEGA1 | Gen | C | C (0.2558) | C C | 74 (0.0541) | 107 (0.0609) | C T |
| | | | Gen | C | C (0.2558) | C C | 74 (0.0541) | 107 (0.0609) | C T |
| hCV8919451 | F5 (rs6016) | MEGA1 | add | A | A (0.255) | A A | 78 (0.0562) | 108 (0.0615) | A G |
| | | LETS | add | A | A (0.2578) | A A | 24 (0.0544) | 31 (0.0689) | A G |
| | | LETS | Gen | A | A (0.2578) | A A | 24 (0.0544) | 31 (0.0689) | A G |
| | | | Gen | A | A (0.2578) | A A | 24 (0.0544) | 31 (0.0689) | A G |
| | | MEGA1 | Gen | A | A (0.255) | A A | 78 (0.0562) | 108 (0.061S) | A G |
| | | | Gen | A | A (0.255) | A A | 78 (0.0562) | 108 (0.0615) | A G |
| hCV2288095 | F9 (rs378815) | LETS | Gen | T | T (0.3711) | T T | 80 (0.1814) | 107 (0.2378) | T C |
| | | MEGA1 | Gen | T | T (0.3545) | T T | 306 (0.2201) | 431 (0.2464) | T C |
| | | LETS | Gen | T | T (0.3711) | T T | 80 (0.1814) | 107 (0.2378) | T C |
| | | | Gen | T | T (0.3711) | T T | 80 (0.1814) | 107 (0.2378) | T C |
| | | MEGA1 | Gen | T | T (0.3545) | T T | 306 (0.2201) | 431 (0.2464) | T C |
| | | | Gen | T | T (0.3545) | T T | 306 (0.2201) | 431 (0.2464) | T C |
| hCV596326 | F9 (rs398101) | LETS | rec | G | G (0.3363) | G G | 75 (0.1705) | 92 (0.2035) | G A |
| | | MEGA1 | Gen | G | G (0.3174) | G G | 257 (0.1857) | 381 (0.2175) | G A |
| | | LETS | Gen | G | G (0.3363) | G G | 75 (0.1705) | 92 (0.2035) | G A |
| | | | Gen | G | G (0.3363) | G G | 75 (0.1705) | 92 (0.2035) | G A |
| | | MEGA1 | Gen | G | G (0.3174) | G G | 257 (0.1857) | 381 (0.2175) | G A |
| | | | Gen | G | G (0.3174) | G G | 257 (0.1857) | 381 (0.2175) | G A |
| hCV596330 | F9 (rs422187) | LETS | add | C | C (0.3267) | C C | 70 (0.1587) | 87 (0.1933) | C A |
| | | MEGA1 | add | C | C (0.3178) | C C | 243 (0.176) | 376 (0.2147) | C A |
| | | LETS | Gen | C | C (0.3267) | C C | 70 (0.1587) | 87 (0.1933) | C A |
| | | | Gen | C | C (0.3267) | C C | 70 (0.1587) | 87 (0.1933) | C A |
| | | MEGA1 | Gen | C | C (0.3178) | C C | 243 (0.176) | 376 (0.2147) | C A |
| | | | Gen | C | C (0.3178) | C C | 243 (0.176) | 376 (0.2147) | C A |
| hCV596331 | F9 (rs6048) | LETS | rec | G | G (0.3267) | G G | 70 (0.158) | 87 (0.1921) | G A |
| | | MEGA1 | dom | G | C (0.3043) | G G | 233 (0.1698) | 356 (0.2046) | G A |
| | | LETS | Gen | G | C (0.3267) | G G | 70 (0.158) | 87 (0.1921) | G A |
| | | | Gen | G | G (0.3267) | G G | 70 (0.158) | 87 (0.1921) | G A |
| | | MEGA1 | Gen | G | G (0.3043) | G G | 233 (0.1698) | 356 (0.2046) | G A |
| | | | Gen | G | G (0.3043) | G G | 233 (0.1698) | 356 (0.2046) | G A |
| hCV2892877 | FGA (rs6050) | LETS | add | T | C (0.2494) | C C | 0 (0) | 0 (0) | C T |
| | | MEGA1 | add | T | C (0.2457) | C C | 0 (0) | 0 (0) | C T |
| | | LETS | Gen | T | C (0.2494) | C C | 0 (0) | 0 (0) | C T |
| | | MEGA1 | Gen | T | C (0.2457) | C C | 0 (0) | 0 (0) | C T |
| hCV11503469 | FGG (rs2066854) | MEGA1 | add | T | A (0.2751) | A A | 174 (0.1251) | 139 (0.0792) | A T |
| | | LETS | add | T | A (0.2619) | A A | 54 (0.1241) | 22 (0.0499) | A T |
| | | LETS | Gen | T | A (0.2619) | A A | 54 (0.1241) | 22 (0.0499) | A T |
| | | | Gen | T | A (0.2619) | A A | 54 (0.1241) | 22 (0.0499) | A T |
| | | MEGA1 | Gen | T | A (0.2751) | A A | 174 (0.1251) | 139 (0.0792) | A T |
| | | | Gen | T | A (0.2751) | A A | 174 (0.1251) | 139 (0.0792) | A T |
| hCV11503414 | FGG (rs2066865) | MEGA1 | add | G | A (0.2745) | A A | 166 (0.1231) | 136 (0.0774) | A G |
| | | LETS | add | G | A (0.264) | A A | 56 (0.1281) | 24 (0.0537) | A G |
| | | LETS | Gen | G | A (0.264) | A A | 56 (0.1281) | 24 (0.0537) | A G |
| | | | Gen | G | A (0.264) | A A | 56 (0.1281) | 24 (0.0537) | A G |
| | | MEGA1 | Gen | G | A (0.2745) | A A | 166 (0.1231) | 136 (0.0774) | A G |
| | | | Gen | G | A (0.2745) | A A | 166 (0.1231) | 136 (0.0774) | A G |
| hCV30505633 | GNG12 (rs7530537) | LETS | add | C | T (0.0596) | T T | 5 (0.0113) | 1 (0.0022) | T C |
| | | MEGA1 | add | C | T (0.072) | T T | 16 (0.0115) | 12 (0.0068) | T C |
| | | LETS | Gen | C | T (0.0596) | T T | 5 (0.0113) | 1 (0.0022) | T C |
| | | | Gen | C | T (0.0596) | T T | 5 (0.0113) | 1 (0.0022) | T C |
| | | MEGA1 | Gen | C | T (0.072) | T T | 16 (0.0115) | 12 (0.0068) | T C |
| | | | Gen | C | T (0.072) | T T | 16 (0.0115) | 12 (0.0068) | T C |
| hCV8717873 | GP6 (rs1613662) | MEGA1 | add | G | G (0.193) | G G | 45 (0.0324) | 61 (0.0349) | G A |
| | | LETS | add | G | G (0.1998) | G G | 10 (0.0226) | 19 (0.0419) | G A |
| | | LETS | Gen | G | G (0.1998) | G G | 10 (0.0226) | 19 (0.0419) | G A |
| | | | Gen | G | G (0.1998) | G G | 10 (0.0226) | 19 (0.0419) | G A |
| | | MEGA1 | Gen | G | G (0.193) | G G | 45 (0.0324) | 61 (0.0349) | G A |
| | | | Gen | G | G (0.193) | G G | 45 (0.0324) | 61 (0.0349) | G A |
| hCV1376342 | GP6 (rs1654416) | LETS | Gen | C | C (0.2141) | C C | 15 (0.0339) | 26 (0.0574) | C T |
| | | MEGA1 | rec | C | C (0.203) | C C | 49 (0.0358) | 66 (0.0376) | C T |
| | | LETS | Gen | C | C (0.2141) | C C | 15 (0.0339) | 26 (0.0574) | C T |
| | | | Gen | C | C (0.2141) | C C | 15 (0.0339) | 26 (0.0574) | C T |
| | | MEGA1 | Gen | C | C (0.203) | C C | 49 (0.0358) | 66 (0.0376) | C T |
| | | | Gen | C | C (0.203) | C C | 49 (0.0358) | 66 (0.0376) | C T |
| hCV8717893 | GP6 (rs1671192) | LETS | Gen | A | A (0.2141) | A A | 15 (0.0339) | 26 (0.0574) | A G |
| | | MEGA1 | rec | A | A (0.2027) | A A | 51 (0.0367) | 64 (0.0364) | A G |
| | | LETS | Gen | A | A (0.2141) | A A | 15 (0.0339) | 26 (0.0574) | A G |
| | | | Gen | A | A (0.2141) | A A | 15 (0.0339) | 26 (0.0574) | A G |
| | | MEGA1 | Gen | A | A (0.2027) | A A | 51 (0.0367) | 64 (0.0364) | A G |
| | | | Gen | A | A (0.2027) | A A | 51 (0.0367) | 64 (0.0364) | A G |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| hCV2575036 | GRB10 (rs34432772) | LETS | add | G | G (0.0265) | G G | 0 (0) | 0 (0) | G A |
| | | MEGA1 | add | A | G (0.0174) | G G | 1 (0.0007) | 0 (0) | G A |
| | | LETS | Gen | G | G (0.0265) | G G | 0 (0) | 0 (0) | G A |
| | | MEGA1 | Gen | A | G (0.0174) | G G | 1 (0.0007) | 0 (0) | G A |
| | | | Gen | A | G (0.0174) | G G | 1 (0.0007) | 0 (0) | G A |
| hCV2699725 | GUCY1B2 | LETS | Gen | G | C (0.0234) | C C | 3 (0.0069) | 1 (0.0022) | C G |
| | (rs11841997) | MEGA1 | Gen | C | G (0.0307) | G G | 4 (0.0029) | 5 (0.0028) | G C |
| | | LETS | Gen | G | C (0.0234) | C C | 3 (0.0069) | 1 (0.0022) | C G |
| | | | Gen | G | C (0.0234) | C C | 3 (0.0069) | 1 (0.0022) | C G |
| | | MEGA1 | Gen | C | G (0.0307) | G G | 4 (0.0029) | 5 (0.0028) | G C |
| | | | Gen | C | G (0.0307) | G G | 4 (0.0029) | 5 (0.0028) | G C |
| hCV25995678 | hCV25995678 | LETS | add | C | C (0.1117) | C C | 4 (0.009) | 8 (0.0177) | C T |
| | | MEGA1 | dom | C | C (0.0891) | C C | 5 (0.0036) | 17 (0.0097) | C T |
| | | LETS | Gen | C | C (0.1117) | C C | 4 (0.009) | 8 (0.0177) | C T |
| | | | Gen | C | C (0.1117) | C C | 4 (0.009) | 8 (0.0177) | C T |
| | | MEGA1 | Gen | C | C (0.0891) | C C | 5 (0.0036) | 17 (0.0097) | C T |
| | | | Gen | C | C (0.0891) | C C | 5 (0.0036) | 17 (0.0097) | C T |
| hCV25996277 | hCV25996277 | LETS | add | T | T (0.1126) | T T | 4 (0.009) | 8 (0.0177) | T A |
| | | MEGA1 | Gen | T | T (0.0904) | T T | 5 (0.0036) | 20 (0.0114) | T A |
| | | LETS | Gen | T | T (0.1126) | T T | 4 (0.009) | 8 (0.0177) | T A |
| | | | Gen | T | T (0.1126) | T T | 4 (0.009) | 8 (0.0177) | T A |
| | | MEGA1 | Gen | T | T (0.0904) | T T | 5 (0.0036) | 20 (0.0114) | T A |
| | | | Gen | T | T (0.0904) | T T | 5 (0.0036) | 20 (0.0114) | T A |
| hCV31199195 | KCTTD10 | LETS | dom | A | C (0.1534) | C C | 12 (0.0271) | 14 (0.0309) | C A |
| | (rs10850234) | MEGA1 | dom | A | C (0.1683) | C C | 52 (0.0375) | 52 (0.0297) | C A |
| | | LETS | Gen | A | C (0.1534) | C C | 12 (0.0271) | 14 (0.0309) | C A |
| | | | Gen | A | C (0.1534) | C C | 12 (0.0271) | 14 (0.0309) | C A |
| | | MEGA1 | Gen | A | C (0.1683) | C C | 52 (0.0375) | 52 (0.0297) | C A |
| | | | Gen | A | C (0.1683) | C C | 52 (0.0375) | 52 (0.0297) | C A |
| hCV27502514 | KLF3 (rs3796533) | MEGA1 | dom | G | A (0.1584) | A A | 44 (0.0318) | 45 (0.0257) | A G |
| | | LETS | dom | G | A (0.1678) | A A | 17 (0.0384) | 15 (0.0331) | A G |
| | | LETS | Gen | G | A (0.1678) | A A | 17 (0.0384) | 15 (0.0331) | A G |
| | | | Gen | G | A (0.1678) | A A | 17 (0.0384) | 15 (0.0331) | A G |
| | | MEGA1 | Gen | G | A (0.1584) | A A | 44 (0.0318) | 45 (0.0257) | A G |
| | | | Gen | G | A (0.1584) | A A | 44 (0.0318) | 45 (0.0257) | A G |
| hCV11786258 | KLKB1 (rs4253303) | LETS | Gen | G | A (0.4156) | A A | 83 (0.1886) | 83 (0.1844) | A G |
| | | MEGA1 | Gen | G | A (0.3933) | A A | 271 (0.1948) | 282 (0.1609) | A G |
| | | LETS | Gen | G | A (0.4156) | A A | 83 (0.1886) | 83 (0.1844) | A G |
| | | | Gen | G | A (0.4156) | A A | 83 (0.1886) | 83 (0.1844) | A G |
| | | MEGA1 | Gen | G | A (0.3933) | A A | 271 (0.1948) | 282 (0.1609) | A G |
| | | | Gen | G | A (0.3933) | A A | 271 (0.1948) | 282 (0.1609) | A G |
| hCV540410 | LASP1 (rs609529) | LETS | Gen | T | A (0.0552) | A A | 2 (0.0045) | 4 (0.0088) | A T |
| | | MEGA1 | Gen | T | A (0.0644) | A A | 15 (0.0108) | 5 (0.0028) | A T |
| | | LETS | Gen | T | A (0.0552) | A A | 2 (0.0045) | 4 (0.0088) | A T |
| | | | Gen | T | A (0.0552) | A A | 2 (0.0045) | 4 (0.0088) | A T |
| | | MEGA1 | Gen | T | A (0.0644) | A A | 15 (0.0108) | 5 (0.0028) | A T |
| | | | Gen | T | A (0.0644) | A A | 15 (0.0108) | 5 (0.0028) | A T |
| hDV70662128 | LOC129656 | LETS | add | G | A (0.0243) | A A | 0 (0) | 0 (0) | A G |
| | | MEGA1 | add | G | A (0.0259) | A A | 5 (0.0036) | 4 (0.0023) | A G |
| | (rs17043082) | LETS | Gen | G | A (0.0243) | A A | 0 (0) | 0 (0) | A G |
| | | MEGA1 | Gen | G | A (0.0259) | A A | 5 (0.0036) | 4 (0.0023) | A G |
| | | | Gen | G | A (0.0259) | A A | 5 (0.0036) | 4 (0.0023) | A G |
| hCV11541681 | LOC200420 | MEGA1 | add | G | C (0.3707) | C C | 228 (0.1638) | 243 (0.1385) | C G |
| | (rs2001490) | LETS | add | G | C (0.3841) | C C | 81 (0.1828) | 60 (0.1325) | C G |
| | | LETS | Gen | G | C (0.3841) | C C | 81 (0.1828) | 60 (0.1325) | C G |
| | | | Gen | G | C (0.3841) | C C | 81 (0.1828) | 60 (0.1325) | C G |
| | | MEGA1 | Gen | G | C (0.3707) | C C | 228 (0.1638) | 243 (0.1385) | C G |
| | | | Gen | G | C (0.3707) | C C | 228 (0.1638) | 243 (0.1385) | C G |
| hCV2706410 | LOC387646 | LETS | Gen | T | C (0.2279) | C C | 33 (0.0747) | 30 (0.0664) | C T |
| | (rs7896532) | MEGA1 | Gen | T | C (0.2459) | C C | 86 (0.0629) | 121 (0.0689) | C T |
| | | LETS | Gen | T | C (0.2279) | C C | 33 (0.0747) | 30 (0.0664) | C T |
| | | | Gen | T | C (0.2279) | C C | 33 (0.0747) | 30 (0.0664) | C T |
| | | MEGA1 | Gen | T | C (0.2459) | C C | 86 (0.0629) | 121 (0.0689) | C T |
| | | | Gen | T | C (0.2459) | C C | 86 (0.0629) | 121 (0.0689) | C T |
| hCV1547677 | LOC646030 | LETS | add | A | G (0.0089) | G G | 0 (0) | 0 (0) | G A |
| | (rs6505228) | MEGA1 | add | A | G (0.0168) | G G | 15 (0.011) | 6 (0.0034) | G A |
| | | LETS | Gen | A | G (0.0089) | G G | 0 (0) | 0 (0) | G A |
| | | MEGA1 | Gen | A | G (0.0168) | G G | 15 (0.011) | 6 (0.0034) | G A |
| | | | Gen | A | G (0.0168) | G G | 15 (0.011) | 6 (0.0034) | G A |
| hCV8827309 | LOC728221 | LETS | add | C | T (0.1029) | T T | 11 (0.0251) | 5 (0.0111) | T C |
| | (rs1110796) | MEGA1 | add | C | T (0.1204) | T T | 21 (0.0152) | 24 (0.0139) | T C |
| | | LETS | Gen | C | T (0.1029) | T T | 11 (0.0251) | 5 (0.0111) | T C |
| | | | Gen | C | T (0.1029) | T T | 11 (0.0251) | 5 (0.0111) | T C |
| | | MEGA1 | Gen | C | T (0.1204) | T T | 21 (0.0152) | 24 (0.0139) | T C |
| | | | Gen | C | T (0.1204) | T T | 21 (0.0152) | 24 (0.0139) | T C |
| hCV2103392 | LOC728284 | LETS | dom | T | T (0.3606) | T T | 49 (0.1109) | 67 (0.1482) | T C |
| | (rs12500826) | MEGA1 | dom | T | T (0.3796) | T T | 153 (0.1138) | 252 (0.1438) | T C |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | T | T (0.3606) | T T | 49 (0.1109) | 67 (0.1482) | T C |
| | | | Gen | T | T (0.3606) | T T | 49 (0.1109) | 67 (0.1482) | T C |
| | | MEGA1 | Gen | T | T (0.3796) | T T | 153 (0.1138) | 252 (0.1438) | T C |
| | | | Gen | T | T (0.3796) | T T | 153 (0.1138) | 252 (0.1438) | T C |
| hCV3230136 | LOC728284 (rs13116273) | MEGA1 | rec | A | A (0.2789) | A A | 75 (0.054) | 130 (0.0743) | A G |
| | | LETS | rec | A | A (0.271) | A A | 31 (0.0703) | 31 (0.0686) | A G |
| | | LETS | Gen | A | A (0.271) | A A | 31 (0.0703) | 31 (0.0686) | A G |
| | | | Gen | A | A (0.271) | A A | 31 (0.0703) | 31 (0.0686) | A G |
| | | MEGA1 | Gen | A | A (0.2789) | A A | 75 (0.054) | 130 (0.0743) | A G |
| | | | Gen | A | A (0.2789) | A A | 75 (0.054) | 130 (0.0743) | A G |
| hCV3230131 | LOC728284 (rs13136269) | LETS | rec | C | C (0.2705) | C C | 31 (0.0701) | 31 (0.0687) | C T |
| | | MEGA1 | rec | C | C (0.2817) | C C | 74 (0.0532) | 134 (0.0765) | C T |
| | | LETS | Gen | C | C (0.2705) | C C | 31 (0.0701) | 31 (0.0687) | C T |
| | | | Gen | C | C (0.2705) | C C | 31 (0.0701) | 31 (0.0687) | C T |
| | | MEGA1 | Gen | C | C (0.2817) | C C | 74 (0.0532) | 134 (0.0765) | C T |
| | | | Gen | C | C (0.2817) | C C | 74 (0.0532) | 134 (0.0765) | C T |
| hCV29821005 | LOC728284 (rs65522970) | LETS | Gen | C | T (0.2056) | T T | 20 (0.0455) | 19 (0.0422) | T C |
| | | MEGA1 | Gen | C | T (0.1943) | T T | 62 (0.0461) | 77 (0.0439) | T C |
| | | LETS | Gen | C | T (0.2056) | T T | 20 (0.0455) | 19 (0.0422) | T C |
| | | | Gen | C | T (0.2056) | T T | 20 (0.0455) | 19 (0.0422) | T C |
| | | MEGA1 | Gen | C | T (0.1943) | T T | 62 (0.0461) | 77 (0.0439) | T C |
| | | | Gen | C | T (0.1943) | T T | 62 (0.0461) | 77 (0.0439) | T C |
| hCV32209621 | LOC728284 (rs6552971) | LETS | Gen | G | G (0.4766) | G G | 91 (0.2063) | 113 (0.2517) | G A |
| | | MEGA1 | Gen | G | G (0.4997) | G G | 305 (0.2261) | 450 (0.2564) | G A |
| | | LETS | Gen | G | G (0.4766) | G G | 91 (0.2063) | 113 (0.2517) | G A |
| | | | Gen | G | G (0.4766) | G G | 91 (0.2063) | 113 (0.2517) | G A |
| | | MEGA1 | Gen | G | G (0.4997) | G G | 305 (0.2261) | 450 (0.2564) | G A |
| | | | Gen | G | G (0.4997) | G G | 305 (0.2261) | 450 (0.2564) | G A |
| hCV32209620 | LOC728284 (rs6552972) | LETS | dom | T | C (0.2073) | C C | 23 (0.0523) | 21 (0.0466) | C T |
| | | MEGA1 | dom | T | C (0.1947) | C C | 62 (0.0463) | 76 (0.0436) | C T |
| | | LETS | Gen | T | C (0.2073) | C C | 23 (0.0523) | 21 (0.0466) | C T |
| | | | Gen | T | C (0.2073) | C C | 23 (0.0523) | 21 (0.0466) | C T |
| | | MEGA1 | Gen | T | C (0.1947) | C C | 62 (0.0463) | 76 (0.0436) | C T |
| | | | Gen | T | C (0.1947) | C C | 62 (0.0463) | 76 (0.0436) | C T |
| hCV916107 | LOC729138 (rs670659) | LETS | add | T | T (0.3554) | T T | 41 (0.0928) | 61 (0.1347) | T C |
| | | MEGA1 | add | T | T (0.3571) | T T | 149 (0.1071) | 238 (0.1361) | T C |
| | | LETS | Gen | T | T (0.3554) | T T | 41 (0.0928) | 61 (0.1347) | T C |
| | | | Gen | T | T (0.3554) | T T | 41 (0.0928) | 61 (0.1347) | T C |
| | | MEGA1 | Gen | T | T (0.3571) | T T | 149 (0.1071) | 238 (0.1361) | T C |
| | | | Gen | T | T (0.3571) | T T | 149 (0.1071) | 238 (0.1361) | T C |
| hCV30922162 | LOC729672 (rs4334028) | LETS | add | C | T (0.287) | T T | 50 (0.1131) | 29 (0.064) | T C |
| | | MEGA1 | add | C | T (0.2889) | T T | 132 (0.0951) | 133 (0.0758) | T C |
| | | LETS | Gen | C | T (0.287) | T T | 50 (0.1131) | 29 (0.064) | T C |
| | | | Gen | C | T (0.287) | T T | 50 (0.1131) | 29 (0.064) | T C |
| | | MEGA1 | Gen | C | T (0.2889) | T T | 132 (0.0951) | 133 (0.0758) | T C |
| | | | Gen | C | T (0.2889) | T T | 132 (0.0951) | 133 (0.0758) | T C |
| hCV7504118 | LOC729672 (rs967257) | MEGA1 | add | A | G (0.2773) | G G | 123 (0.0887) | 120 (0.0683) | G A |
| | | LETS | add | A | G (0.2792) | G G | 44 (0.0995) | 29 (0.064) | G A |
| | | LETS | Gen | A | G (0.2792) | G G | 44 (0.0995) | 29 (0.064) | G A |
| | | | Gen | A | G (0.2792) | G G | 44 (0.0995) | 29 (0.064) | G A |
| | | MEGA1 | Gen | A | G (0.2773) | G G | 123 (0.0887) | 120 (0.0683) | G A |
| | | | Gen | A | G (0.2773) | G G | 123 (0.0887) | 120 (0.0683) | G A |
| hCV11633415 | LOC730144 (rs4262503) | MEGA1 | add | C | C (0.0798) | C C | 6 (0.0043) | 11 (0.0063) | C T |
| | | LETS | add | C | C (0.083) | C C | 0 (0) | 4 (0.0088) | C T |
| | | LETS | Gen | C | C (0.083) | C C | 0 (0) | 4 (0.0088) | C T |
| | | | Gen | C | C (0.083) | C C | 0 (0) | 4 (0.0088) | C T |
| | | MEGA1 | Gen | C | C (0.0798) | C C | 6 (0.0043) | 11 (0.0063) | C T |
| | | | Gen | C | C (0.0798) | C C | 6 (0.0043) | 11 (0.0063) | C T |
| hCV2494846 | LUZP1 (rs3765407) | MEGA1 | rec | T | G (0.1657) | G G | 55 (0.0395) | 45 (0.0257) | G T |
| | | LETS | rec | T | G (0.1416) | G G | 21 (0.0475) | 10 (0.0221) | G T |
| | | LETS | Gen | T | G (0.1416) | G G | 21 (0.0475) | 10 (0.0221) | G T |
| | | | Gen | T | G (0.1416) | G G | 21 (0.0475) | 10 (0.0221) | G T |
| | | MEGA1 | Gen | T | G (0.1657) | G G | 55 (0.0395) | 45 (0.0257) | G T |
| | | | Gen | T | G (0.1657) | G G | 55 (0.0395) | 45 (0.0257) | G T |
| hCV25752810 | MDN1 (rs4707557) | MEGA1 | add | A | C (0.0191) | C C | 7 (0.0051) | 4 (0.0023) | C A |
| | | LETS | add | A | C (0.0144) | C C | 3 (0.0068) | 1 (0.0022) | C A |
| | | LETS | Gen | A | C (0.0144) | C C | 3 (0.0068) | 1 (0.0022) | C A |
| | | | Gen | A | C (0.0144) | C C | 3 (0.0068) | 1 (0.0022) | C A |
| | | MEGA1 | Gen | A | C (0.0191) | C C | 7 (0.0051) | 4 (0.0023) | C A |
| | | | Gen | A | C (0.0191) | C C | 7 (0.0051) | 4 (0.0023) | C A |
| hCV16170613 | MET (rs2237712) | MEGA1 | add | A | G (0.0313) | G G | 3 (0.0022) | 1 (0.0006) | G A |
| | | LETS | add | A | G (0.0299) | G G | 4 (0.009) | 0 (0) | G A |
| | | LETS | Gen | A | G (0.0299) | G G | 4 (0.009) | 0 (0) | G A |
| | | | Gen | A | G (0.0299) | G G | 4 (0.009) | 0 (0) | G A |
| | | MEGA1 | Gen | A | G (0.0313) | G G | 3 (0.0022) | 1 (0.0006) | G A |
| | | | Gen | A | G (0.0313) | G G | 3 (0.0022) | 1 (0.0006) | G A |
| hCV11726971 | NFIA (rs2065841) | LETS | Gen | A | G (0.1512) | G G | 23 (0.0519) | 10 (0.0221) | G A |
| | | MEGA1 | Gen | A | G (0.1927) | G G | 51 (0.0369) | 75 (0.0428) | G A |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | A | G (0.1512) | G G | 23 (0.0519) | 10 (0.0221) | G A |
| | | | Gen | A | G (0.1512) | G G | 23 (0.0519) | 10 (0.0221) | G A |
| | | MEGA1 | Gen | A | G (0.1927) | G G | 51 (0.0369) | 75 (0.0428) | G A |
| | | | Gen | A | G (0.1927) | G G | 51 (0.0369) | 75 (0.0428) | G A |
| hCV30747430 | NR1I2 (rs11712211) | MEGA1 | add | C | T (0.1852) | T T | 76 (0.0563) | 65 (0.037) | T C |
| | | LETS | add | C | T (0.1519) | T T | 26 (0.0591) | 11 (0.0244) | T C |
| | | LETS | Gen | C | T (0.1519) | T T | 26 (0.0591) | 11 (0.0244) | T C |
| | | | Gen | C | T (0.1519) | T T | 26 (0.0591) | 11 (0.0244) | T C |
| | | MEGA1 | Gen | C | T (0.1852) | T T | 76 (0.0563) | 65 (0.037) | T C |
| | | | Gen | C | T (0.1852) | T T | 76 (0.0563) | 65 (0.037) | T C |
| hCV263841 | NR1I2 (rs1523127) | LETS | add | A | C (0.3296) | C C | 88 (0.2018) | 49 (0.1106) | C A |
| | | MEGA1 | add | A | C (0.3907) | C C | 250 (0.1788) | 261 (0.1485) | C A |
| | | LETS | Gen | A | C (0.3296) | C C | 88 (0.2018) | 49 (0.1106) | C A |
| | | | Gen | A | C (0.3296) | C C | 88 (0.2018) | 49 (0.1106) | C A |
| | | MEGA1 | Gen | A | C (0.3907) | C C | 250 (0.1788) | 261 (0.1485) | C A |
| | | | Gen | A | C (0.3907) | C C | 250 (0.1788) | 261 (0.1485) | C A |
| hCV4041 | NR3C1 (rs6190) | MEGA1 | dom | C | T (0.0268) | T T | 4 (0.0029) | 1 (0.0006) | T C |
| | | LETS | dom | C | T (0.031) | T T | 1 (0.0023) | 1 (0.0022) | T C |
| | | LETS | Gen | C | T (0.031) | T T | 1 (0.0023) | 1 (0.0022) | T C |
| | | | Gen | C | T (0.031) | T T | 1 (0.0023) | 1 (0.0022) | T C |
| | | MEGA1 | Gen | C | T (0.0268) | T T | 4 (0.0029) | 1 (0.0006) | T C |
| | | | Gen | C | T (0.0268) | T T | 4 (0.0029) | 1 (0.0006) | T C |
| hCV2915511 | OBSL1 (rs627530) | LETS | Gen | T | C (0.0265) | C C | 3 (0.0068) | 1 (0.0022) | C T |
| | | MEGA1 | Gen | T | C (0.0387) | C C | 13 (0.0093) | 5 (0.0028) | C T |
| | | LETS | Gen | T | C (0.0265) | C C | 3 (0.0068) | 1 (0.0022) | C T |
| | | | Gen | T | C (0.0265) | C C | 3 (0.0068) | 1 (0.0022) | C T |
| | | MEGA1 | Gen | T | C (0.0387) | C C | 13 (0.0093) | 5 (0.0028) | C T |
| | | | Gen | T | C (0.0387) | C C | 13 (0.0093) | 5 (0.0028) | C T |
| hCV16177220 | ODZ1 (rs2266911) | MEGA1 | add | T | T (0.2098) | T T | 125 (0.0899) | 214 (0.122) | T C |
| | | LETS | add | T | T (0.213) | T T | 35 (0.079) | 54 (0.1192) | T C |
| | | LETS | Gen | T | T (0.213) | T T | 35 (0.079) | 54 (0.1192) | T C |
| | | | Gen | T | T (0.213) | T T | 35 (0.079) | 54 (0.1192) | T C |
| | | MEGA1 | Gen | T | T (0.2098) | T T | 125 (0.0899) | 214 (0.122) | T C |
| | | | Gen | T | T (0.2098) | T T | 125 (0.0899) | 214 (0.122) | T C |
| hCV7584272 | OR1B1 (rs1536929) | LETS | Gen | G | A (0.2367) | A A | 26 (0.059) | 24 (0.0531) | A G |
| | | MEGA1 | dom | G | A (0.2396) | A A | 83 (0.0607) | 98 (0.0558) | A G |
| | | LETS | Gen | G | A (0.2367) | A A | 26 (0.059) | 24 (0.0531) | A G |
| | | | Gen | G | A (0.2367) | A A | 26 (0.059) | 24 (0.0531) | A G |
| | | MEGA1 | Gen | G | A (0.2396) | A A | 83 (0.0607) | 98 (0.0558) | A G |
| | | | Gen | G | A (0.2396) | A A | 83 (0.0607) | 98 (0.0558) | A G |
| hCV9327878 | OR7G1 (rs2217657) | MEGA1 | add | C | G (0.3169) | G G | 180 (0.1316) | 190 (0.1082) | G C |
| | | LETS | add | C | G (0.3069) | G G | 61 (0.1386) | 45 (0.1004) | G C |
| | | LETS | Gen | C | G (0.3069) | G G | 61 (0.1386) | 45 (0.1004) | G C |
| | | | Gen | C | G (0.3069) | G G | 61 (0.1386) | 45 (0.1004) | G C |
| | | MEGA1 | Gen | C | G (0.3169) | G G | 180 (0.1316) | 190 (0.1082) | G C |
| | | | Gen | C | G (0.3169) | G G | 180 (0.1316) | 190 (0.1082) | G C |
| hCV15990789 | OTOG (rs2355466) | MEGA1 | rec | A | A (0.4036) | A A | 220 (0.1614) | 279 (0.1592) | A G |
| | | LETS | rec | A | A (0.4446) | A A | 75 (0.1697) | 80 (0.1774) | A G |
| | | LETS | Gen | A | A (0.4446) | A A | 75 (0.1697) | 80 (0.1774) | A G |
| | | | Gen | A | A (0.4446) | A A | 75 (0.1697) | 80 (0.1774) | A G |
| | | MEGA1 | Gen | A | A (0.4036) | A A | 220 (0.1614) | 279 (0.1592) | A G |
| | | | Gen | A | A (0.4036) | A A | 220 (0.1614) | 279 (0.1592) | A G |
| hCV8361354 | PANX1 (rs1138800) | LETS | Gen | A | A (0.4007) | A A | 48 (0.1084) | 70 (0.1545) | A C |
| | | MEGA1 | Gen | A | A (0.3793) | A A | 207 (0.1491) | 227 (0.1296) | A C |
| | | LETS | Gen | A | A (0.4007) | A A | 48 (0.1084) | 70 (0.1545) | A C |
| | | | Gen | A | A (0.4007) | A A | 48 (0.1084) | 70 (0.1545) | A C |
| | | MEGA1 | Gen | A | A (0.3793) | A A | 207 (0.1491) | 227 (0.1296) | A C |
| | | | Gen | A | A (0.3793) | A A | 207 (0.1491) | 227 (0.1296) | A C |
| hCV30500334 | PHACTR3 (rs6128674) | LETS | add | A | A (0.4172) | A A | 59 (0.1332) | 74 (0.1634) | A G |
| | | MEGA1 | add | A | A (0.3969) | A A | 185 (0.1358) | 285 (0.1624) | A G |
| | | LETS | Gen | A | A (0.4172) | A A | 59 0.1332) | 74 (0.1634) | A G |
| | | | Gen | A | A (0.4172) | A A | 59 (0.1332) | 74 (0.1634) | A G |
| | | MEGA1 | Gen | A | A (0.3969) | A A | 185 (0.1358) | 285 (0.1624) | A G |
| | | | Gen | A | A (0.3969) | A A | 185 (0.1358) | 285 (0.1624) | A G |
| hCV27474984 | PIK3R1 (rs3756668) | MEGA1 | add | G | A (0.4412) | A A | 293 (0.2108) | 362 (0.2067) | A G |
| | | LETS | add | G | A (0.449) | A A | 110 (0.2489) | 87 (0.1929) | A G |
| | | LETS | Gen | G | A (0.449) | A A | 110 (0.2489) | 87 (0.1929) | A G |
| | | | Gen | G | A (0.449) | A A | 110 (0.2489) | 87 (0.1929) | A G |
| | | MEGA1 | Gen | G | A (0.4412) | A A | 293 (0.2108) | 362 (0.2067) | A G |
| | | | Gen | G | A (0.4412) | A A | 293 (0.2108) | 362 (0.2067) | A G |
| hCV7625318 | PLEKHG4 (rs3868142) | LETS | Gen | G | A (0.0629) | A A | 2 (0.0045) | 4 (0.0088) | A G |
| | | MEGA1 | Gen | G | A (0.0764) | A A | 13 (0.0094) | 16 (0.0091) | A G |
| | | LETS | Gen | G | A (0.0629) | A A | 2 (0.0045) | 4 (0.0088) | A G |
| | | | Gen | G | A (0.0629) | A A | 2 (0.0045) | 4 (0.0088) | A G |
| | | MEGA1 | Gen | G | A (0.0764) | A A | 13 (0.0094) | 16 (0.0091) | A G |
| | | | Gen | G | A (0.0764) | A A | 13 (0.0094) | 16 (0.0091) | A G |
| hCV8598986 | POLR1A (rs4832233) | LETS | rec | T | T (0.3186) | T T | 28 (0.0633) | 45 (0.0996) | T C |
| | | MEGA1 | rec | T | T (0.2873) | T T | 119 (0.0858) | 154 (0.0882) | T C |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | T | T (0.3186) | T T | 28 (0.0633) | 45 (0.0996) | T C |
| | | | Gen | T | T (0.3186) | T T | 28 (0.0633) | 45 (0.0996) | T C |
| | | MEGA1 | Gen | T | T (0.2873) | T T | 119 (0.0858) | 154 (0.0882) | T C |
| | | | Gen | T | T (0.2873) | T T | 119 (0.0858) | 154 (0.0882) | T C |
| hCV926518 | PPP2R5C (rs7467981) | LETS | Gen | T | G (0.0896) | G G | 4 (0.009) | 5 (0.0111) | G T |
| | | MEGA1 | Gen | T | G (0.0994) | G G | 16 (0.0117) | 26 (0.0148) | G T |
| | | LETS | Gen | T | G (0.0896) | G G | 4 (0.009) | 5 (0.0111) | G T |
| | | | Gen | T | G (0.0896) | G G | 4 (0.009) | 5 (0.0111) | G T |
| | | MEGA1 | Gen | T | G (0.0994) | G G | 16 (0.0117) | 26 (0.0148) | G T |
| | | | Gen | T | G (0.0994) | G G | 16 (0.0117) | 26 (0.0148) | G T |
| hCV1841975 | PROC (rs1799810) | LETS | Gen | A | T (0.427) | T T | 100 (0.2262) | 81 (0.1792) | T A |
| | | MEGA1 | Gen | A | T (0.4356) | T T | 323 (0.2327) | 329 (0.1883) | T A |
| | | LETS | Gen | A | T (0.427) | T T | 100 (0.2262) | 81 (0.1792) | T A |
| | | | Gen | A | T (0.427) | T T | 100 (0.2262) | 81 (0.1792) | T A |
| | | MEGA1 | Gen | A | T (0.4356) | T T | 323 (0.2327) | 329 (0.1883) | T A |
| | | | Gen | A | T (0.4356) | T T | 323 (0.2327) | 329 (0.1883) | T A |
| hCV8957432 | RAC2 (rs6572) | MEGA1 | rec | G | C (0.4364) | C C | 308 (0.2217) | 334 (0.1905) | C G |
| | | LETS | rec | G | C (0.4458) | C C | 99 (0.2245) | 77 (0.1704) | C G |
| | | LETS | Gen | G | C (0.4458) | C C | 99 (0.2245) | 77 (0.1704) | C G |
| | | | Gen | G | C (0.4458) | C C | 99 (0.2245) | 77 (0.1704) | C G |
| | | MEGA1 | Gen | G | C (0.4364) | C C | 308 (0.2217) | 334 (0.1905) | C G |
| | | | Gen | G | C (0.4364) | C C | 308 (0.2217) | 334 (0.1905) | C G |
| hCV29271569 | RDH13 (rs1626971) | LETS | add | C | C (0.1954) | C C | 9 (0.0204) | 17 (0.0375) | C T |
| | | MEGA1 | add | C | C (0.1867) | C C | 43 (0.031) | 60 (0.0342) | C T |
| | | LETS | Gen | C | C (0.1954) | C C | 9 (0.0204) | 17 (0.0375) | C T |
| | | | Gen | C | C (0.1954) | C C | 9 (0.0204) | 17 (0.0375) | C T |
| | | MEGA1 | Gen | C | C (0.1867) | C C | 43 (0.031) | 60 (0.0342) | C T |
| | | | Gen | C | C (0.1867) | C C | 43 (0.031) | 60 (0.0342) | C T |
| hCV8703249 | RDH13 (rs1654444) | LETS | add | T | T (0.1898) | T T | 10 (0.0226) | 17 (0.0375) | T G |
| | | MEGA1 | add | T | T (0.1879) | T T | 41 (0.0296) | 64 (0.0364) | T G |
| | | LETS | Gen | T | T (0.1898) | T T | 10 (0.0226) | 17 (0.0375) | T G |
| | | | Gen | T | T (0.1898) | T T | 10 (0.0226) | 17 (0.0375) | T G |
| | | MEGA1 | Gen | T | T (0.1879) | T T | 41 (0.0296) | 64 (0.0364) | T G |
| | | | Gen | T | T (0.1879) | T T | 41 (0.0296) | 64 (0.0364) | T G |
| hCV8717752 | RDH13 (rs1671217) | LETS | add | A | A (0.1892) | A A | 7 (0.0158) | 17 (0.0376) | A G |
| | | MEGA1 | rec | A | A (0.1774) | A A | 36 (0.026) | 52 (0.0297) | A G |
| | | LETS | Gen | A | A (0.1892) | A A | 7 (0.0158) | 17 (0.0376) | A G |
| | | | Gen | A | A (0.1892) | A A | 7 (0.0158) | 17 (0.0376) | A G |
| | | MEGA1 | Gen | A | A (0.1774) | A A | 36 (0.026) | 52 (0.0297) | A G |
| | | | Gen | A | A (0.1774) | A A | 36 (0.026) | 52 (0.0297) | A G |
| hCV11975296 | SELP (rs6131) | MEGA1 | add | C | T (0.1818) | T T | 63 (0.0453) | 66 (0.0377) | T C |
| | | LETS | add | C | T (0.1777) | T T | 27 (0.0611) | 20 (0.0442) | T C |
| | | LETS | Gen | C | T (0.1777) | T T | 27 (0.0611) | 20 (0.0442) | T C |
| | | | Gen | C | T (0.1777) | T T | 27 (0.0611) | 20 (0.0442) | T C |
| | | MEGA1 | Gen | C | T (0.1818) | T T | 63 (0.0453) | 66 (0.0377) | T C |
| | | | Gen | C | T (0.1818) | T T | 63 (0.0453) | 66 (0.0377) | T C |
| hCV9596963 | SERPINA5 (rs6115) | LETS | dom | G | G (0.3831) | G G | 38 (0.0874) | 60 (0.1336) | G A |
| | | MEGA1 | dom | G | G (0.3441) | G G | 137 (0.0988) | 214 (0.1224) | G A |
| | | LETS | Gen | G | G (0.3831) | G G | 38 (0.0874) | 60 (0.1336) | G A |
| | | | Gen | G | G (0.3831) | G G | 38 (0.0874) | 60 (0.1336) | G A |
| | | MEGA1 | Gen | G | G (0.3441) | G G | 137 (0.0988) | 214 (0.1224) | G A |
| | | | Gen | G | G (0.3441) | G G | 137 (0.0988) | 214 (0.1224) | G A |
| hCV16180170 | SERPINC1 (rs2227589) | MEGA1 | add | C | T (0.0892) | T T | 22 (0.0158) | 15 (0.0085) | T C |
| | | LETS | add | C | T (0.0863) | T T | 6 (0.0135) | 4 (0.0088) | T C |
| | | LETS | Gen | C | T (0.0863) | T T | 6 (0.0135) | 4 (0.0088) | T C |
| | | | Gen | C | T (0.0863) | T T | 6 (0.0135) | 4 (0.0088) | T C |
| | | MEGA1 | Gen | C | T (0.0892) | T T | 22 (0.0158) | 15 (0.0085) | T C |
| | | | Gen | C | T (0.0892) | T T | 22 (0.0158) | 15 (0.0085) | T C |
| hCV1650632 | SERPINC1 (rs5878) | MEGA1 | Gen | T | C (0.3391) | C C | 191 (0.1426) | 197 (0.1126) | C T |
| | | LETS | Gen | T | C (0.3213) | C C | 49 (0.1119) | 56 (0.1258) | C T |
| | | LETS | Gen | T | C (0.3213) | C C | 49 (0.1119) | 56 (0.1258) | C T |
| | | | Gen | T | C (0.3213) | C C | 49 (0.1119) | 56 (0.1258) | C T |
| | | MEGA1 | Gen | T | C (0.3391) | C C | 191 (0.1426) | 197 (0.1126) | C T |
| | | | Gen | T | C (0.3391) | C C | 191 (0.1426) | 197 (0.1126) | C T |
| hCV3216426 | SFRS2IP (rs7315731) | LETS | dom | T | T (0.5022) | T T | 87 (0.1977) | 119 (0.2662) | T A |
| | | MEGA1 | dom | T | T (0.4909) | T T | 301 (0.2155) | 441 (0.251) | T A |
| | | LETS | Gen | T | T (0.5022) | T T | 87 (0.1977) | 119 (0.2662) | T A |
| | | | Gen | T | T (0.5022) | T T | 87 (0.1977) | 119 (0.2662) | T A |
| | | MEGA1 | Gen | T | T (0.4909) | T T | 301 (0.2155) | 441 (0.251) | T A |
| | | | Gen | T | T (0.4909) | T T | 301 (0.2155) | 441 (0.251) | T A |
| hCV25602230 | SIRT6 (rs7246235) | MEGA1 | add | T | G (0.0108) | G G | 4 (0.0029) | 1 (0.0006) | G T |
| | | LETS | add | T | G (0.0055) | G G | 2 (0.0045) | 0 (0) | G T |
| | | LETS | Gen | T | G (0.0055) | G G | 2 (0.0045) | 0 (0) | G T |
| | | | Gen | T | G (0.0055) | G G | 2 (0.0045) | 0 (0) | G T |
| | | MEGA1 | Gen | T | G (0.0108) | G G | 4 (0.0029) | 1 (0.0006) | G T |
| | | | Gen | T | G (0.0108) | G G | 4 (0.0029) | 1 (0.0006) | G T |
| hCV2086329 | SPARC (rs4958487) | MEGA1 | rec | A | G (0.4219) | G G | 298 (0.2152) | 296 (0.1688) | G A |
| | | LETS | rec | A | G (0.4183) | G G | 104 (0.2348) | 76 (0.1678) | G A |

TABLE 20-continued

Unadjusted additive and genotypic association of 149 SNPs with DVT in LETS (p <= 0.1) and MEGA-1 (p <= 0.05)

| marker | annot | Endpoint | Model | | | | | | |
|---|---|---|---|---|---|---|---|---|---|
| | | LETS | Gen | A | G (0.4183) | G G | 104 (0.2348) | 76 (0.1678) | G A |
| | | | Gen | A | G (0.4183) | G G | 104 (0.2348) | 76 (0.1678) | G A |
| | | MEGA1 | Gen | A | G (0.4219) | G G | 298 (0.2152) | 296 (0.1688) | G A |
| | | | Gen | A | G (0.4219) | G G | 298 (0.2152) | 296 (0.1688) | G A |
| hCV11466393 | TACR1 (rs881) | LETS | add | G | G (0.1953) | G G | 10 (0.0228) | 17 (0.0384) | G C |
| | | MEGA1 | add | G | G (0.1746) | G G | 32 (0.023) | 52 (0.0297) | G C |
| | | LETS | Gen | G | G (0.1953) | G G | 10 (0.0228) | 17 (0.0384) | G C |
| | | | Gen | G | G (0.1953) | G G | 10 (0.0228) | 17 (0.0384) | G C |
| | | MEGA1 | Gen | G | G (0.1746) | G G | 32 (0.023) | 52 (0.0297) | G C |
| | | | Gen | G | G (0.1746) | G G | 32 (0.023) | 52 (0.0297) | G C |
| hCV3216649 | TAF1B (rs1054565) | LETS | dom | G | A (0.2971) | A A | 50 (0.1134) | 47 (0.1042) | A G |
| | | MEGA1 | dom | G | A (0.3179) | A A | 160 (0.115) | 191 (0.109) | A G |
| | | LETS | Gen | G | A (0.2971) | A A | 50 (0.1134) | 47 (0.1042) | A G |
| | | | Gen | G | A (0.2971) | A A | 50 (0.1134) | 47 (0.1042) | A G |
| | | MEGA1 | Gen | G | A (0.3179) | A A | 160 (0.115) | 191 (0.109) | A G |
| | | | Gen | G | A (0.3179) | A A | 160 (0.115) | 191 (0.109) | A G |
| hCV470708 | THBS2 (rs10945406) | LETS | add | G | T (0.2838) | T T | 50 (0.1131) | 38 (0.0843) | T G |
| | | MEGA1 | Gen | G | T (0.3005) | T T | 152 (0.109) | 153 (0.0873) | T G |
| | | LETS | Gen | G | T (0.2838) | T T | 50 (0.1131) | 38 (0.0843) | T G |
| | | | Gen | G | T (0.2838) | T T | 50 (0.1131) | 38 (0.0843) | T G |
| | | MEGA1 | Gen | G | T (0.3005) | T T | 152 (0.109) | 153 (0.0873) | T G |
| | | | Gen | G | T (0.3005) | T T | 152 (0.109) | 153 (0.0873) | T G |
| hCV3272537 | TIAM1 (rs497689) | LETS | dom | T | A (0.4281) | A A | 100 (0.2268) | 90 (0.1991) | A T |
| | | MEGA1 | dom | T | A (0.4287) | A A | 277 (0.2003) | 347 (0.1989) | A T |
| | | LETS | Gen | T | A (0.4281) | A A | 100 (0.2268) | 90 (0.1991) | A T |
| | | | Gen | T | A (0.4281) | A A | 100 (0.2268) | 90 (0.1991) | A T |
| | | MEGA1 | Gen | T | A (0.4287) | A A | 277 (0.2003) | 347 (0.1989) | A T |
| | | | Gen | T | A (0.4287) | A A | 277 (0.2003) | 347 (0.1989) | A T |
| hCV27833944 | TNFSF4 (rs6702339) | LETS | add | T | C (0.0856) | C C | 5 (0.0113) | 3 (0.0067) | C T |
| | | MEGA1 | add | T | C (0.0901) | C C | 25 (0.018) | 16 (0.0091) | C T |
| | | LETS | Gen | T | C (0.0856) | C C | 5 (0.0113) | 3 (0.0067) | C T |
| | | | Gen | T | C (0.0856) | C C | 5 (0.0113) | 3 (0.0067) | C T |
| | | MEGA1 | Gen | T | C (0.0901) | C C | 25 (0.018) | 16 (0.0091) | C T |
| | | | Gen | T | C (0.0901) | C C | 25 (0.018) | 16 (0.0091) | C T |
| hCV1723643 | UMODL1 (rs220130) | LETS | rec | C | C (0.2406) | C C | 19 (0.0431) | 22 (0.0488) | C A |
| | | MEGA1 | rec | C | C (0.2246) | C C | 59 (0.0426) | 95 (0.0542) | C A |
| | | LETS | Gen | C | C (0.2406) | C C | 19 (0.0431) | 22 (0.0488) | C A |
| | | | Gen | C | C (0.2406) | C C | 19 (0.0431) | 22 (0.0488) | C A |
| | | MEGA1 | Gen | C | C (0.2246) | C C | 59 (0.0426) | 95 (0.0542) | C A |
| | | | Gen | C | C (0.2246) | C C | 59 (0.0426) | 95 (0.0542) | C A |
| hCV7581501 | USP45 (rs1323717) | LETS | Gen | G | C (0.096) | C C | 9 (0.0203) | 7 (0.0155) | C G |
| | | MEGA1 | Gen | G | C (0.1142) | C C | 26 (0.0187) | 17 (0.0097) | C G |
| | | LETS | Gen | G | C (0.096) | C C | 9 (0.0203) | 7 (0.0155) | C G |
| | | | Gen | G | C (0.096) | C C | 9 (0.0203) | 7 (0.0155) | C G |
| | | MEGA1 | Gen | G | C (0.1142) | C C | 26 (0.0187) | 17 (0.0097) | C G |
| | | | Gen | G | C (0.1142) | C C | 26 (0.0187) | 17 (0.0097) | C G |
| hCV15949414 | XYLB (rs2234628) | MEGA1 | rec | A | A (0.0496) | A A | 5 (0.0037) | 1 (0.0006) | A G |
| | | LETS | rec | A | A (0.0569) | A A | 1 (0.0023) | 0 (0) | A G |
| | | LETS | Gen | A | A (0.0569) | A A | 1 (0.0023) | 0 (0) | A G |
| | | | Gen | A | A (0.0569) | A A | 1 (0.0023) | 0 (0) | A G |
| | | MEGA1 | Gen | A | A (0.0496) | A A | 5 (0.0037) | 1 (0.0006) | A G |
| | | | Gen | A | A (0.0496) | A A | 5 (0.0037) | 1 (0.0006) | A G |
| hCV356522 | ZBTB41 (rs10732295) | LETS | dom | C | T (0.0784) | T T | 6 (0.0135) | 4 (0.0088) | T C |
| | | MEGA1 | dom | C | T (0.0931) | T T | 22 (0.0159) | 19 (0.0108) | T C |
| | | LETS | Gen | C | T (0.0784) | T T | 6 (0.0135) | 4 (0.0088) | T C |
| | | | Gen | C | T (0.0784) | T T | 6 (0.0135) | 4 (0.0088) | T C |
| | | MEGA1 | Gen | C | T (0.0931) | T T | 22 (0.0159) | 19 (0.0108) | T C |
| | | | Gen | C | T (0.0931) | T T | 22 (0.0159) | 19 (0.0108) | T C |
| hCV25596789 | JF544 (rs651013) | LETS | add | C | G (0.0144) | G G | 2 (0.0045) | 0 (0) | G C |
| | | MEGA1 | add | C | G (0.0182) | G G | 1 (0.0007) | 0 (0) | G C |
| | | LETS | Gen | C | G (0.0144) | G G | 2 (0.0045) | 0 (0) | G C |
| | | | Gen | C | G (0.0144) | G G | 2 (0.0045) | 0 (0) | G C |
| | | MEGA1 | Gen | C | G (0.0182) | G G | 1 (0.0007) | 0 (0) | G C |
| | | | Gen | C | G (0.0182) | G G | 1 (0.0007) | 0 (0) | G C |
| hCV25951992 | ZWINT (rs11005328) | MEGA1 | dom | C | A (0.0091) | A A | 5 (0.0036) | 1 (0.0006) | A C |
| | | LETS | dom | C | A (0.0122) | A A | 0 (0) | 1 (0.0022) | A C |
| | | LETS | Gen | C | A (0.0122) | A A | 0 (0) | 1 (0.0022) | A C |
| | | | Gen | C | A (0.0122) | A A | 0 (0) | 1 (0.0022) | A C |
| | | MEGA1 | Gen | C | A (0.0091) | A A | 5 (0.0036) | 1 (0.0006) | A C |
| | | | Gen | C | A (0.0091) | A A | 5 (0.0036) | 1 (0.0006) | A C |

| marker | annot | Endpoint | Model | CASE cnt (CASE frq)2 | CONTROL cnt (CONTROL frq)2 | Genot3 | CASE cnt (CASE frq)3 | CONTROL cnt (CONTROL frq)3 |
|---|---|---|---|---|---|---|---|---|
| hCV505733 | (rs11126416) | LETS | Gen | 215 (0.4853) | 222 (0.4901) | G G | 157 (0.3544) | 177 (0.3907) |
| | | MEGA1 | Gen | 637 (0.4593) | 800 (0.4553) | G G | 540 (0.3893) | 744 (0.4234) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 215 (0.4853 | 222 (0.4901) | G G | 157 (0.3544 | 177 (0.3907) |
| | | | Gen | 215 (0.4853 | 222 (0.4901) | G G | 157 (0.3544 | 177 (0.3907) |
| | | MEGA1 | Gen | 637 (0.4593 | 800 (0.4553) | G G | 540 (0.3893 | 744 (0.4234) |
| | | | Gen | 637 (0.4593 | 800 (0.4553) | G G | 540 (0.3893 | 744 (0.4234) |
| hCV2879752 | (rs1244565) | LETS | add | 227 (0.5147 | 214 (0.4724) | A A | 99 (0.2245 | 135 (0.298) |
| | | MEGA1 | add | 672 (0.4923 | 886 (0.5057) | A A | 352 (0.2579 | 487 (0.278) |
| | | LETS | Gen | 227 (0.5147 | 214 (0.4724) | A A | 99 (0.2245 | 135 (0.298) |
| | | | Gen | 227 (0.5147 | 214 (0.4724) | A A | 99 (0.2245 | 135 (0.298) |
| | | MEGA1 | Gen | 672 (0.4923 | 886 (0.5057) | A A | 352 (0.2579 | 487 (0.278) |
| | | | Gen | 672 (0.4923 | 886 (0.5057) | A A | 352 (0.2579 | 487 (0.278) |
| hCV11503470 | (rs1800788) | MEGA1 | add | 512 (0.3691 | 544 (0.3105) | C C | 790 (0.5696 | 1101 (0.6284) |
| | | LETS | add | 156 (0.3521 | 144 (0.3186) | C C | 256 (0.5779 | 291 (0.6438) |
| | | LETS | Gen | 156 (0.3521 | 144 (0.3186) | C C | 256 (0.5779 | 291 (0.6438) |
| | | | Gen | 156 (0.3521 | 144 (0.3186) | C C | 256 (0.5779 | 291 (0.6438) |
| | | MEGA1 | Gen | 512 (0.3691 | 544 (0.3105) | C C | 790 (0.5696 | 1101 (0.6284) |
| | | | Gen | 512 (0.3691 | 544 (0.3105) | C C | 790 (0.5696 | 1101 (0.6284) |
| hCV15860433 | (rs2070006) | MEGA1 | add | 689 (0.4957 | 832 (0.4746) | C C | 405 (0.2914 | 624 (0.356) |
| | | LETS | add | 211 (0.4785 | 217 (0.4822) | C C | 135 (0.3061 | 161 (0.3578) |
| | | LETS | Gen | 211 (0.4785 | 217 (0.4822) | C C | 135 (0.3061 | 161 (0.3578) |
| | | | Gen | 211 (0.4785 | 217 (0.4822) | C C | 135 (0.3061 | 161 (0.3578) |
| | | MEGA1 | Gen | 689 (0.4957 | 832 (0.4746) | C C | 405 (0.2914 | 624 (0.356) |
| | | | Gen | 689 (0.4957 | 832 (0.4746) | C C | 405 (0.2914 | 624 (0.356) |
| hCV2744023 | (rs369328) | LETS | add | 229 (0.5169 | 232 (0.5133) | G G | 98 (0.2212 | 133 (0.2942) |
| | | MEGA1 | add | 680 (0.4871 | 872 (0.4966) | G G | 346 (0.2479 | 480 (0.2733) |
| | | LETS | Gen | 229 (0.5169 | 232 (0.5133) | G G | 98 (0.2212 | 133 (0.2942) |
| | | | Gen | 229 (0.5169 | 232 (0.5133) | G G | 98 (0.2212 | 133 (0.2942) |
| | | MEGA1 | Gen | 680 (0.4871 | 872 (0.4966) | G G | 346 (0.2479 | 480 (0.2733) |
| | | | Gen | 680 (0.4871 | 872 (0.4966) | G G | 346 (0.2479 | 480 (0.2733) |
| hCV27477533 | (rs3756008) | MEGA1 | add | 691 (0.4953 | 832 (0.4749) | A A | 397 (0.2846 | 624 (0.3562) |
| | | LETS | add | 212 (0.4796 | 200 (0.4425) | A A | 129 (0.2919 | 164 (0.3628) |
| | | LETS | Gen | 212 (0.4796 | 200 (0.4425) | A A | 129 (0.2919 | 164 (0.3628) |
| | | | Gen | 212 (0.4796 | 200 (0.4425) | A A | 129 (0.2919 | 164 (0.3628) |
| | | MEGA1 | Gen | 691 (0.4953 | 832 (0.4749) | A A | 397 (0.2846 | 624 (0.3562) |
| | | | Gen | 691 (0.4953 | 832 (0.4749) | A A | 397 (0.2846 | 624 (0.3562) |
| hCV949676 | (rs480802) | MEGA1 | Gen | 440 (0.3262 | 559 (0.3213) | T T | 826 (0.6123 | 1104 (0.6345) |
| | | LETS | Gen | 138 (0.3151 | 139 (0.3075) | T T | 271 (0.6187 | 296 (0.6549) |
| | | LETS | Gen | 138 (0.3151 | 139 (0.3075) | T T | 271 (0.6187 | 296 (0.6549) |
| | | | Gen | 138 (0.3151 | 139 (0.3075) | T T | 271 (0.6187 | 296 (0.6549) |
| | | MEGA1 | Gen | 440 (0.3262 | 559 (0.3213) | T T | 826 (0.6123 | 1104 (0.6345) |
| | | | Gen | 440 (0.3262 | 559 (0.3213) | T T | 826 (0.6123 | 1104 (0.6345) |
| hCV27904396 | (rs4829996) | LETS | rec | 92 (0.2081 | 111 (0.245) | G G | 286 (0.6471 | 263 (0.5806) |
| | | MEGA1 | Gen | 300 (0.2158 | 346 (0.1977) | G G | 859 (0.618 | 1069 (0.6109) |
| | | LETS | Gen | 92 (0.2081 | 111 (0.245) | G G | 286 (0.6471 | 263 (0.5806) |
| | | | Gen | 92 (0.2081 | 111 (0.245) | G G | 286 (0.6471 | 263 (0.5806) |
| | | MEGA1 | Gen | 300 (0.2158 | 346 (0.1977) | G G | 859 (0.618 | 1069 (0.6109) |
| | | | Gen | 300 (0.2158 | 346 (0.1977) | G G | 859 (0.618 | 1069 (0.6109) |
| hCV837462 | (rs528088) | LETS | Gen | 70 (0.1584 | 68 (0.1504) | A A | 364 (0.8235 | 382 (0.8451) |
| | | MEGA1 | dom | 193 (0.1385 | 237 (0.1354) | A A | 1196 (0.858 | 1495 (0.8538) |
| | | LETS | Gen | 70 (0.1584 | 68 (0.1504) | A A | 364 (0.8235 | 382 (0.8451) |
| | | | Gen | 70 (0.1584 | 68 (0.1504) | A A | 364 (0.8235 | 382 (0.8451) |
| | | MEGA1 | Gen | 193 (0.1385 | 237 (0.1354) | A A | 1196 (0.858 | 1495 (0.8538) |
| | | | Gen | 193 (0.1385 | 237 (0.1354) | A A | 1196 (0.858 | 1495 (0.8538) |
| hCV30440155 | (rs6699146) | LETS | add | 204 (0.4647 | 207 (0.458) | G G | 135 (0.3075 | 161 (0.3562) |
| | | MEGA1 | add | 651 (0.4855 | 865 (0.4951) | G G | 369 (0.2752 | 538 (0.308) |
| | | LETS | Gen | 204 (0.4647 | 207 (0.458) | G G | 135 (0.3075 | 161 (0.3562) |
| | | | Gen | 204 (0.4647 | 207 (0.458) | G G | 135 (0.3075 | 161 (0.3562) |
| | | MEGA1 | Gen | 651 (0.4855 | 865 (0.4951) | G G | 369 (0.2752 | 538 (0.308) |
| | | | Gen | 651 (0.4855 | 865 (0.4951) | G G | 369 (0.2752 | 538 (0.308) |
| hCV28960679 | (rs6844764) | LETS | rec | 210 (0.4751 | 234 (0.5177) | G G | 158 (0.3575 | 136 (0.3009) |
| | | MEGA1 | dom | 690 (0.4964 | 814 (0.467) | G G | 467 (0.336 | 571 (0.3276) |
| | | LETS | Gen | 210 (0.4751 | 234 (0.5177) | G G | 158 (0.3575 | 136 (0.3009) |
| | | | Gen | 210 (0.4751 | 234 (0.5177) | G G | 158 (0.3575 | 136 (0.3009) |
| | | MEGA1 | Gen | 690 (0.4964 | 814 (0.467) | G G | 467 (0.336 | 571 (0.3276) |
| | | | Gen | 690 (0.4964 | 814 (0.467) | G G | 467 (0.336 | 571 (0.3276) |
| hCV1952126 | (rs7223784) | LETS | add | 164 (0.3702 | 188 (0.4159) | A A | 248 (0.5598 | 221 (0.4889) |
| | | MEGA1 | add | 527 (0.3808 | 688 (0.3925) | A A | 766 (0.5535 | 918 (0.5237) |
| | | LETS | Gen | 164 (0.3702 | 188 (0.4159) | A A | 248 (0.5598 | 221 (0.4889) |
| | | | Gen | 164 (0.3702 | 188 (0.4159) | A A | 248 (0.5598 | 221 (0.4889) |
| | | MEGA1 | Gen | 527 (0.3808 | 688 (0.3925) | A A | 766 (0.5535 | 918 (0.5237) |
| | | | Gen | 527 (0.3808 | 688 (0.3925) | A A | 766 (0.5535 | 918 (0.5237) |
| hCV31749285 | (rs8178591) | LETS | rec | 160 (0.3612 | 200 (0.4415) | C C | 243 (0.5485 | 221 (0.4879) |
| | | MEGA1 | rec | 526 (0.3781 | 722 (0.4123) | C C | 779 (0.56 | 903 (0.5157) |
| | | LETS | Gen | 160 (0.3612 | 200 (0.4415) | C C | 243 (0.5485 | 221 (0.4879) |
| | | | Gen | 160 (0.3612 | 200 (0.4415) | C C | 243 (0.5485 | 221 (0.4879) |
| | | MEGA1 | Gen | 526 (0.3781 | 722 (0.4123) | C C | 779 (0.56 | 903 (0.5157) |
| | | | Gen | 526 (0.3781 | 722 (0.4123) | C C | 779 (0.56 | 903 (0.5157) |
| hCV3187716 | AGTR1 (rs5186) | LETS | dom | 199 (0.4543 | 184 (0.4116) | A A | 195 (0.4452 | 224 (0.5011) |
| | | MEGA1 | add | 530 (0.3946 | 752 (0.4292) | A A | 711 (0.5294 | 835 (0.4766) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 199 (0.4543) | 184 (0.4116) | A A | 195 (0.4452) | 224 (0.5011) |
| | | | Gen | 199 (0.4543) | 184 (0.4116) | A A | 195 (0.4452) | 224 (0.5011) |
| | | MEGA1 | Gen | 530 (0.3946) | 752 (0.4292) | A A | 711 (0.5294) | 835 (0.4766) |
| | | | Gen | 530 (0.3946) | 752 (0.4292) | A A | 711 (0.5294) | 835 (0.4766) |
| hCV9493081 | AKT3 (rs1058304) | LETS | add | 202 (0.457) | 174 (0.3858) | C C | 190 (0.4299) | 245 (0.5432) |
| | | MEGA1 | add | 553 (0.4096) | 748 (0.4262) | C C | 645 (0.4778) | 879 (0.5009) |
| | | LETS | Gen | 202 (0.457) | 174 (0.3858) | C C | 190 (0.4299) | 245 (0.5432) |
| | | | Gen | 202 (0.457) | 174 (0.3858) | C C | 190 (0.4299) | 245 (0.5432) |
| | | MEGA1 | Gen | 553 (0.4096) | 748 (0.4262) | C C | 645 (0.4778) | 879 (0.5009) |
| | | | Gen | 553 (0.4096) | 748 (0.4262) | C C | 645 (0.4778) | 879 (0.5009) |
| hCV30690780 | AKT3 (rs1073788) | LETS | add | 177 (0.4032) | 142 (0.3149) | A A | 223 (0.508) | 288 (0.6386) |
| | | MEGA1 | add | 490 (0.3632) | 623 (0.3568) | A A | 745 (0.5523) | 1034 (0.5922) |
| | | LETS | Gen | 177 (0.4032) | 142 (0.3149) | A A | 223 (0.508) | 288 (0.6386) |
| | | | Gen | 177 (0.4032) | 142 (0.3149) | A A | 223 (0.508) | 288 (0.6386) |
| | | MEGA1 | Gen | 490 (0.3632) | 623 (0.3568) | A A | 745 (0.5523) | 1034 (0.5922) |
| | | | Gen | 490 (0.3632) | 623 (0.3568) | A A | 745 (0.5523) | 1034 (0.5922) |
| hCV31523557 | AKT3 (rs10754807) | LETS | add | 163 (0.3696) | 120 (0.2667) | G G | 254 (0.576) | 315 (0.7) |
| | | MEGA1 | add | 461 (0.3415) | 532 (0.3028) | G G | 815 (0.6037) | 1151 (0.6551) |
| | | LETS | Gen | 163 (0.3696) | 120 (0.2667) | G G | 254 (0.576) | 315 (0.7) |
| | | | Gen | 163 (0.3696) | 120 (0.2667) | G G | 254 (0.576) | 315 (0.7) |
| | | MEGA1 | Gen | 461 (0.3415) | 532 (0.3028) | G G | 815 (0.6037) | 1151 (0.6551) |
| | | | Gen | 461 (0.3415) | 532 (0.3028) | G G | 815 (0.6037) | 1151 (0.6551) |
| hCV26719108 | AKT3 (rs10927035) | LETS | add | 216 (0.4887) | 202 (0.4469) | T T | 156 (0.3529) | 201 (0.4447) |
| | | MEGA1 | add | 624 (0.4636) | 797 (0.4575) | T T | 500 (0.3715) | 720 (0.4133) |
| | | LETS | Gen | 216 (0.4887) | 202 (0.4469) | T T | 156 (0.3529) | 201 (0.4447) |
| | | | Gen | 216 (0.4887) | 202 (0.4469) | T T | 156 (0.3529) | 201 (0.4447) |
| | | MEGA1 | Gen | 624 (0.4636) | 797 (0.4575) | T T | 500 (0.3715) | 720 (0.4133) |
| | | | Gen | 624 (0.4636) | 797 (0.4575) | T T | 500 (0.3715) | 720 (0.4133) |
| hCV26719121 | AKT3 (rs10927041) | LETS | add | 164 (0.371) | 121 (0.2677) | T T | 253 (0.5724) | 316 (0.6991) |
| | | MEGA1 | add | 453 (0.3358) | 531 (0.3026) | T T | 824 (0.6108) | 1151 (0.6558) |
| | | LETS | Gen | 164 (0.371) | 121 (0.2677) | T T | 253 (0.5724) | 316 (0.6991) |
| | | | Gen | 164 (0.371) | 121 (0.2677) | T T | 253 (0.5724) | 316 (0.6991) |
| | | MEGA1 | Gen | 453 (0.3358) | 531 (0.3026) | T T | 824 (0.6108) | 1151 (0.6558) |
| | | | Gen | 453 (0.3358) | 531 (0.3026) | T T | 824 (0.6108) | 1151 (0.6558) |
| hCV26719227 | AKT3 (rs10927065) | LETS | add | 146 (0.3303) | 112 (0.2494) | C C | 284 (0.6425) | 327 (0.7283) |
| | | MEGA1 | add | 409 (0.303) | 478 (0.2727) | C C | 889 (0.6585) | 1224 (0.6982) |
| | | LETS | Gen | 146 (0.3303) | 112 (0.2494) | C C | 284 (0.6425) | 327 (0.7283) |
| | | | Gen | 146 (0.3303) | 112 (0.2494) | C C | 284 (0.6425) | 327 (0.7283) |
| | | MEGA1 | Gen | 409 (0.303) | 478 (0.2727) | C C | 889 (0.6585) | 1224 (0.6982) |
| | | | Gen | 409 (0.303) | 478 (0.2727) | C C | 889 (0.6585) | 1224 (0.6982) |
| hCV31523638 | AKT3 (rs12037013) | LETS | add | 135 (0.3068) | 99 (0.219) | G G | 293 (0.6659) | 344 (0.7611) |
| | | MEGA1 | add | 384 (0.2844) | 455 (0.2594) | G G | 926 (0.6859) | 1263 (0.7201) |
| | | LETS | Gen | 135 (0.3068) | 99 (0.219) | G G | 293 (0.6659) | 344 (0.7611) |
| | | | Gen | 135 (0.3068) | 99 (0.219) | G G | 293 (0.6659) | 344 (0.7611) |
| | | MEGA1 | Gen | 384 (0.2844) | 455 (0.2594) | G G | 926 (0.6859) | 1263 (0.7201) |
| | | | Gen | 384 (0.2844) | 455 (0.2594) | G G | 926 (0.6859) | 1263 (0.7201) |
| hCV30690777 | AKT3 (rs12045585) | MEGA1 | add | 392 (0.291) | 451 (0.257) | G G | 919 (0.6823) | 1277 (0.7276) |
| | | LETS | add | 131 (0.3011) | 108 (0.2432) | G G | 293 (0.6736) | 328 (0.7387) |
| | | LETS | Gen | 131 (0.3011) | 108 (0.2432) | G G | 293 (0.6736) | 328 (0.7387) |
| | | | Gen | 131 (0.3011) | 108 (0.2432) | G G | 293 (0.6736) | 328 (0.7387) |
| | | MEGA1 | Gen | 392 (0.291) | 451 (0.257) | G G | 919 (0.6823) | 1277 (0.7276) |
| | | | Gen | 392 (0.291) | 451 (0.257) | G G | 919 (0.6823) | 1277 (0.7276) |
| hCV31523650 | KT3 (rs12048930) | LETS | add | 163 (0.3721) | 130 (0.2889) | C C | 250 (0.5708) | 304 (0.6756) |
| | | MEGA1 | add | 472 (0.342) | 541 (0.3086) | C C | 834 (0.6043) | 1130 (0.6446) |
| | | LETS | Gen | 163 (0.3721) | 130 (0.2889) | C C | 250 (0.5708) | 304 (0.6756) |
| | | | Gen | 163 (0.3721) | 130 (0.2889) | C C | 250 (0.5708) | 304 (0.6756) |
| | | MEGA1 | Gen | 472 (0.342) | 541 (0.3086) | C C | 834 (0.6043) | 1130 (0.6446) |
| | | | Gen | 472 (0.342) | 541 (0.3086) | C C | 834 (0.6043) | 1130 (0.6446) |
| hCV30690778 | KT3 (rs12140414) | LETS | add | 163 (0.3713) | 125 (0.2772) | T T | 257 (0.5854) | 311 (0.6896) |
| | | MEGA1 | add | 443 (0.3284) | 553 (0.3151) | T T | 847 (0.6279) | 1150 (0.6553) |
| | | LETS | Gen | 163 (0.3713) | 125 (0.2772) | T T | 257 (0.5854) | 311 (0.6896) |
| | | | Gen | 163 (0.3713) | 125 (0.2772) | T T | 257 (0.5854) | 311 (0.6896) |
| | | MEGA1 | Gen | 443 (0.3284) | 553 (0.3151) | T T | 847 (0.6279) | 1150 (0.6553) |
| | | | Gen | 443 (0.3284) | 553 (0.3151) | T T | 847 (0.6279) | 1150 (0.6553) |
| hCV31523608 | KT3 (rs12744297) | MEGA1 | add | 609 (0.4518) | 740 (0.4224) | A A | 553 (0.4102) | 815 (0.4652) |
| | | LETS | add | 202 (0.458) | 181 (0.4013) | A A | 182 (0.4127) | 227 (0.5033) |
| | | LETS | Gen | 202 (0.458) | 181 (0.4013) | A A | 182 (0.4127) | 227 (0.5033) |
| | | | Gen | 202 (0.458) | 181 (0.4013) | A A | 182 (0.4127) | 227 (0.5033) |
| | | MEGA1 | Gen | 609 (0.4518) | 740 (0.4224) | A A | 553 (0.4102) | 815 (0.4652) |
| | | | Gen | 609 (0.4518) | 740 (0.4224) | A A | 553 (0.4102) | 815 (0.4652) |
| hCV233148 | AKT3 (rs1417121) | LETS | add | 202 (0.456) | 174 (0.3841) | G G | 191 (0.4312) | 247 (0.5453) |
| | | MEGA1 | add | 573 (0.4128) | 745 (0.424) | G G | 652 (0.4697) | 883 (0.5026) |
| | | LETS | Gen | 202 (0.456) | 174 (0.3841) | G G | 191 (0.4312) | 247 (0.5453) |
| | | | Gen | 202 (0.456) | 174 (0.3841) | G G | 191 (0.4312) | 247 (0.5453) |
| | | MEGA1 | Gen | 573 (0.4128) | 745 (0.424) | G G | 652 (0.4697) | 883 (0.5026) |
| | | | Gen | 573 (0.4128) | 745 (0.424) | G G | 652 (0.4697) | 883 (0.5026) |
| hCV12073840 | AKT3 (rs14403) | LETS | Gen | 186 (0.4256) | 153 (0.3392) | C C | 222 (0.508) | 274 (0.6075) |
| | | MEGA1 | Gen | 510 (0.3783) | 670 (0.3815) | C C | 748 (0.5549) | 1001 (0.57) |

TABLE 20-continued

Unadjusted additive and genotypic association of 149 SNPs with DVT in LETS (p <= 0.1) and MEGA-1 (p <= 0.05)

| | | | | | | | | | |
|---|---|---|---|---|---|---|---|---|---|
| | | LETS | Gen | 186 (0.4256 | 153 (0.3392) | C C | 222 (0.508 | 274 (0.6075) |
| | | | Gen | 186 (0.4256 | 153 (0.3392) | C C | 222 (0.508 | 274 (0.6075) |
| | | MEGA1 | Gen | 510 (0.3783 | 670 (0.3815) | C C | 748 (0.5549 | 1001 (0.57) |
| | | | Gen | 510 (0.3783 | 670 (0.3815) | C C | 748 (0.5549 | 1001 (0.57) |
| hCV1678674 | AKT3 (rs1458023) | LETS | add | 158 (0.3624 | 126 (0.2812) | T T | 247 (0.5665 | 304 (0.6786) |
| | | MEGA1 | add | 462 (0.3422 | 540 (0.308) | T T | 808 (0.5985 | 1131 (0.6452) |
| | | LETS | Gen | 158 (0.3624 | 126 (0.2812) | T T | 247 (0.5665 | 304 (0.6786) |
| | | | Gen | 158 (0.3624 | 126 (0.2812) | T T | 247 (0.5665 | 304 (0.6786) |
| | | MEGA1 | Gen | 462 (0.3422 | 540 (0.308) | T T | 808 (0.5985 | 1131 (0.6452) |
| | | | Gen | 462 (0.3422 | 540 (0.308) | T T | 808 (0.5985 | 1131 (0.6452) |
| hCV97631 | AKT3 (rs1538773) | LETS | add | 182 (0.4127 | 143 (0.3171) | T T | 224 (0.5079 | 287 (0.6364) |
| | | MEGA1 | add | 493 (0.3655 | 621 (0.3542) | T T | 754 (0.5589 | 1043 (0.595) |
| | | LETS | Gen | 182 (0.4127 | 143 (0.3171) | T T | 224 (0.5079 | 287 (0.6364) |
| | | | Gen | 182 (0.4127 | 143 (0.3171) | T T | 224 (0.5079 | 287 (0.6364) |
| | | MEGA1 | Gen | 493 (0.3655 | 621 (0.3542) | T T | 754 (0.5589 | 1043 (0.595) |
| | | | Gen | 493 (0.3655 | 621 (0.3542) | T T | 754 (0.5589 | 1043 (0.595) |
| hCV8688111 | AKT3 (rs1578275) | LETS | add | 159 (0.3647 | 125 (0.2803) | G G | 257 (0.5894 | 309 (0.6928) |
| | | MEGA1 | add | 434 (0.3229 | 541 (0.3097) | G G | 852 (0.6339 | 1154 (0.6606) |
| | | LETS | Gen | 159 (0.3647 | 125 (0.2803) | G G | 257 (0.5894 | 309 (0.6928) |
| | | | Gen | 159 (0.3647 | 125 (0.2803) | G G | 257 (0.5894 | 309 (0.6928) |
| | | MEGA1 | Gen | 434 (0.3229 | 541 (0.3097) | G G | 852 (0.6339 | 1154 (0.6606) |
| | | | Gen | 434 (0.3229 | 541 (0.3097) | G G | 852 (0.6339 | 1154 (0.6606) |
| hCV15885425 | AKT3 (rs2290754) | LETS | add | 163 (0.3713 | 126 (0.2788) | A A | 249 (0.5672 | 311 (0.6881) |
| | | MEGA1 | add | 452 (0.3353 | 528 (0.301) | A A | 820 (0.6083 | 1141 (0.6505) |
| | | LETS | Gen | 163 (0.3713 | 126 (0.2788) | A A | 249 (0.5672 | 311 (0.6881) |
| | | | Gen | 163 (0.3713 | 126 (0.2788) | A A | 249 (0.5672 | 311 (0.6881) |
| | | MEGA1 | Gen | 452 (0.3353 | 528 (0.301) | A A | 820 (0.6083 | 1141 (0.6505) |
| | | | Gen | 452 (0.3353 | 528 (0.301) | A A | 820 (0.6083 | 1141 (0.6505) |
| hCV1678682 | AKT3 (rs320339) | LETS | add | 157 (0.3576 | 121 (0.2701) | G G | 252 (0.574 | 309 (0.6897) |
| | | MEGA1 | add | 446 (0.3311 | 532 (0.3035) | G G | 817 (0.6065 | 1146 (0.6537) |
| | | LETS | Gen | 157 (0.3576 | 121 (0.2701) | G G | 252 (0.574 | 309 (0.6897) |
| | | | Gen | 157 (0.3576 | 121 (0.2701) | G G | 252 (0.574 | 309 (0.6897) |
| | | MEGA1 | Gen | 446 (0.3311 | 532 (0.3035) | G G | 817 (0.6065 | 1146 (0.6537) |
| | | | Gen | 446 (0.3311 | 532 (0.3035) | G G | 817 (0.6065 | 1146 (0.6537) |
| hCV29210363 | AKT3 (rs6656918) | LETS | add | 179 (0.4087 | 142 (0.3149) | A A | 221 (0.5046 | 287 (0.6364) |
| | | MEGA1 | add | 490 (0.3632 | 626 (0.3569) | A A | 748 (0.5545 | 1037 (0.5912) |
| | | LETS | Gen | 179 (0.4087 | 142 (0.3149) | A A | 221 (0.5046 | 287 (0.6364) |
| | | | Gen | 179 (0.4087 | 142 (0.3149) | A A | 221 (0.5046 | 287 (0.6364) |
| | | MEGA1 | Gen | 490 (0.3632 | 626 (0.3569) | A A | 748 (0.5545 | 1037 (0.5912) |
| | | | Gen | 490 (0.3632 | 626 (0.3569) | A A | 748 (0.5545 | 1037 (0.5912) |
| hCV31523643 | AKT3 (rs6671475) | LETS | add | 161 (0.3643 | 127 (0.281) | A A | 254 (0.5747 | 310 (0.6858) |
| | | MEGA1 | add | 453 (0.3356 | 533 (0.3046) | A A | 821 (0.6081 | 1137 (0.6497) |
| | | LETS | Gen | 161 (0.3643 | 127 (0.281) | A A | 254 (0.5747 | 310 (0.6858) |
| | | | Gen | 161 (0.3643 | 127 (0.281) | A A | 254 (0.5747 | 310 (0.6858) |
| | | MEGA1 | Gen | 453 (0.3356 | 533 (0.3046) | A A | 821 (0.6081 | 1137 (0.6497) |
| | | | Gen | 453 (0.3356 | 533 (0.3046) | A A | 821 (0.6081 | 1137 (0.6497) |
| hCV26719113 | AKT3 (rs7517340) | LETS | add | 154 (0.3573 | 109 (0.2477) | C C | 253 (0.587 | 315 (0.7159) |
| | | MEGA1 | add | 431 (0.3207 | 519 (0.2974) | C C | 835 (0.6213 | 1159 (0.6642) |
| | | LETS | Gen | 154 (0.3573 | 109 (0.2477) | C C | 253 (0.587 | 315 (0.7159) |
| | | | Gen | 154 (0.3573 | 109 (0.2477) | C C | 253 (0.587 | 315 (0.7159) |
| | | MEGA1 | Gen | 431 (0.3207 | 519 (0.2974) | C C | 835 (0.6213 | 1159 (0.6642) |
| | | | Gen | 431 (0.3207 | 519 (0.2974) | C C | 835 (0.6213 | 1159 (0.6642) |
| hCV26034142 | AKT3 (rs9428576) | LETS | add | 209 (0.4729 | 201 (0.4447) | T T | 121 (0.2738 | 155 (0.3429) |
| | | MEGA1 | rec | 634 (0.4703 | 887 (0.506) | T T | 396 (0.2938 | 520 (0.2966) |
| | | LETS | Gen | 209 (0.4729 | 201 (0.4447) | T T | 121 (0.2738 | 155 (0.3429) |
| | | | Gen | 209 (0.4729 | 201 (0.4447) | T T | 121 (0.2738 | 155 (0.3429) |
| | | MEGA1 | Gen | 634 (0.4703 | 887 (0.506) | T T | 396 (0.2938 | 520 (0.2966) |
| | | | Gen | 634 (0.4703 | 887 (0.506) | T T | 396 (0.2938 | 520 (0.2966) |
| hCV2303891 | POH (rs1801690) | MEGA1 | add | 106 (0.0758 | 189 (0.1076) | C C | 1288 (0.9213 | 1565 (0.8907) |
| | | LETS | add | 29 (0.0662 | 44 (0.098) | C C | 409 (0.9338 | 404 (0.8998) |
| | | LETS | Gen | 29 (0.0662 | 44 (0.098) | C C | 409 (0.9338 | 404 (0.8998) |
| | | | Gen | 29 (0.0662 | 44 (0.098) | C C | 409 (0.9338 | 404 (0.8998) |
| | | MEGA1 | Gen | 106 (0.0758 | 189 (0.1076) | C C | 1288 (0.9213 | 1565 (0.8907) |
| | | | Gen | 106 (0.0758 | 189 (0.1076) | C C | 1288 (0.9213 | 1565 (0.8907) |
| hCV2456747 | Corf114 (rs3820059) | MEGA1 | add | 641 (0.4595 | 739 (0.4225) | G G | 542 (0.3885 | 795 (0.4545) |
| | | LETS | add | 210 (0.4751 | 181 (0.3996) | G G | 177 (0.4005 | 228 (0.5033) |
| | | LETS | Gen | 210 (0.4751 | 181 (0.3996) | G G | 177 (0.4005 | 228 (0.5033) |
| | | | Gen | 210 (0.4751 | 181 (0.3996) | G G | 177 (0.4005 | 228 (0.5033) |
| | | MEGA1 | Gen | 641 (0.4595 | 739 (0.4225) | G G | 542 (0.3885 | 795 (0.4545) |
| | | | Gen | 641 (0.4595 | 739 (0.4225) | G G | 542 (0.3885 | 795 (0.4545) |
| hCV2403368 | QTNF6 (rs2295261) | LETS | rec | 145 (0.3281 | 183 (0.404) | G G | 272 (0.6154 | 244 (0.5386) |
| | | MEGA1 | rec | 477 (0.3427 | 660 (0.3761) | G G | 837 (0.6013 | 989 (0.5635) |
| | | LETS | Gen | 145 (0.3281 | 183 (0.404) | G G | 272 (0.6154 | 244 (0.5386) |
| | | | Gen | 145 (0.3281 | 183 (0.404) | G G | 272 (0.6154 | 244 (0.5386) |
| | | MEGA1 | Gen | 477 (0.3427 | 660 (0.3761) | G G | 837 (0.6013 | 989 (0.5635) |
| | | | Gen | 477 (0.3427 | 660 (0.3761) | G G | 837 (0.6013 | 989 (0.5635) |
| hCV7574127 | Corf167 (rs1737145) | LETS | add | 225 (0.509 | 236 (0.521) | A A | 137 (0.31 | 120 (0.2649) |
| | | MEGA1 | add | 663 (0.4787 | 847 (0.4834) | A A | 430 (0.3105 | 481 (0.2745) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 225 (0.509) | 236 (0.521) | A A | 137 (0.31) | 120 (0.2649) |
| | | | Gen | 225 (0.509) | 236 (0.521) | A A | 137 (0.31) | 120 (0.2649) |
| | | MEGA1 | Gen | 663 (0.4787) | 847 (0.4834) | A A | 430 (0.3105) | 481 (0.2745) |
| | | | Gen | 663 (0.4787) | 847 (0.4834) | A A | 430 (0.3105) | 481 (0.2745) |
| hCV25959498 | C9orf46 (rs34518648) | LETS | add | 48 (0.1086) | 63 (0.1394) | G G | 393 (0.8891) | 383 (0.8473) |
| | | MEGA1 | add | 183 (0.1315) | 262 (0.1493) | G G | 1203 (0.8642) | 1476 (0.841) |
| | | LETS | Gen | 48 (0.1086) | 63 (0.1394) | G G | 393 (0.8891) | 383 (0.8473) |
| | | | Gen | 48 (0.1086) | 63 (0.1394) | G G | 393 (0.8891) | 383 (0.8473) |
| | | MEGA1 | Gen | 183 (0.1315) | 262 (0.1493) | G G | 1203 (0.8642) | 1476 (0.841) |
| | | | Gen | 183 (0.1315) | 262 (0.1493) | G G | 1203 (0.8642) | 1476 (0.841) |
| hCV25959466 | C9orf46 (rs35495590) | MEGA1 | add | 182 (0.1307) | 263 (0.1503) | T T | 1203 (0.8642) | 1469 (0.8394) |
| | | LETS | add | 48 (0.1086) | 63 (0.1394) | T T | 393 (0.8891) | 384 (0.8496) |
| | | LETS | Gen | 48 (0.1086) | 63 (0.1394) | T T | 393 (0.8891) | 384 (0.8496) |
| | | | Gen | 48 (0.1086) | 63 (0.1394) | T T | 393 (0.8891) | 384 (0.8496) |
| | | MEGA1 | Gen | 182 (0.1307) | 263 (0.1503) | T T | 1203 (0.8642) | 1469 (0.8394) |
| | | | Gen | 182 (0.1307) | 263 (0.1503) | T T | 1203 (0.8642) | 1469 (0.8394) |
| hCV25768636 | CCDC36 (rs4279134) | MEGA1 | rec | 639 (0.461) | 821 (0.4678) | G G | 559 (0.4033) | 740 (0.4217) |
| | | LETS | rec | 197 (0.4457) | 199 (0.4412) | G G | 177 (0.4005) | 204 (0.4523) |
| | | LETS | Gen | 197 (0.4457) | 199 (0.4412) | G G | 177 (0.4005) | 204 (0.4523) |
| | | | Gen | 197 (0.4457) | 199 (0.4412) | G G | 177 (0.4005) | 204 (0.4523) |
| | | MEGA1 | Gen | 639 (0.461) | 821 (0.4678) | G G | 559 (0.4033) | 740 (0.4217) |
| | | | Gen | 639 (0.461) | 821 (0.4678) | G G | 559 (0.4033) | 740 (0.4217) |
| hCV25991132 | CCDC41 ( ) | MEGA1 | rec | 195 (0.1403) | 311 (0.178) | G G | 1182 (0.8504) | 1430 (0.8185) |
| | | LETS | rec | 58 (0.1309) | 78 (0.1722) | G G | 384 (0.8668) | 370 (0.8168) |
| | | LETS | Gen | 58 (0.1309) | 78 (0.1722) | G G | 384 (0.8668) | 370 (0.8168) |
| | | | Gen | 58 (0.1309) | 78 (0.1722) | G G | 384 (0.8668) | 370 (0.8168) |
| | | MEGA1 | Gen | 195 (0.1403) | 311 (0.178) | G G | 1182 (0.8504) | 1430 (0.8185) |
| | | | Gen | 195 (0.1403) | 311 (0.178) | G G | 1182 (0.8504) | 1430 (0.8185) |
| hCV3164397 | CMYA5 (rs10043986) | LETS | rec | 93 (0.2109) | 136 (0.3002) | C C | 339 (0.7687) | 309 (0.6821) |
| | | MEGA1 | dom | 347 (0.2487) | 408 (0.233) | C C | 1036 (0.7427) | 1309 (0.7476) |
| | | LETS | Gen | 93 (0.2109) | 136 (0.3002) | C C | 339 (0.7687) | 309 (0.6821) |
| | | | Gen | 93 (0.2109) | 136 (0.3002) | C C | 339 (0.7687) | 309 (0.6821) |
| | | MEGA1 | Gen | 347 (0.2487) | 408 (0.233) | C C | 1036 (0.7427) | 1309 (0.7476) |
| | | | Gen | 347 (0.2487) | 408 (0.233) | C C | 1036 (0.7427) | 1309 (0.7476) |
| hCV3230083 | CYP4V2 (rs10013653) | MEGA1 | Gen | 702 (0.5223) | 842 (0.4803) | C C | 360 (0.2679) | 582 (0.332) |
| | | LETS | Gen | 230 (0.5204) | 208 (0.4622) | C C | 115 (0.2602) | 142 (0.3156) |
| | | LETS | Gen | 230 (0.5204) | 208 (0.4622) | C C | 115 (0.2602) | 142 (0.3156) |
| | | | Gen | 230 (0.5204) | 208 (0.4622) | C C | 115 (0.2602) | 142 (0.3156) |
| | | MEGA1 | Gen | 702 (0.5223) | 842 (0.4803) | C C | 360 (0.2679) | 582 (0.332) |
| | | | Gen | 702 (0.5223) | 842 (0.4803) | C C | 360 (0.2679) | 582 (0.332) |
| hCV25990131 | CYP4V2 (rs13146272) | MEGA1 | add | 600 (0.4295) | 805 (0.459) | A A | 648 (0.4639) | 720 (0.4105) |
| | | LETS | add | 208 (0.4717) | 189 (0.4191) | A A | 201 (0.4558) | 199 (0.4412) |
| | | LETS | Gen | 208 (0.4717) | 189 (0.4191) | A A | 201 (0.4558) | 199 (0.4412) |
| | | | Gen | 208 (0.4717) | 189 (0.4191) | A A | 201 (0.4558) | 199 (0.4412) |
| | | MEGA1 | Gen | 600 (0.4295) | 805 (0.459) | A A | 648 (0.4639) | 720 (0.4105) |
| | | | Gen | 600 (0.4295) | 805 (0.459) | A A | 648 (0.4639) | 720 (0.4105) |
| hCV15968043 | CYP4V2 (rs2292423) | MEGA1 | dom | 698 (0.504) | 839 (0.4811) | T T | 395 (0.2852) | 605 (0.3469) |
| | | LETS | dom | 224 (0.5056) | 208 (0.4592) | T T | 122 (0.2754) | 153 (0.3377) |
| | | LETS | Gen | 224 (0.5056) | 208 (0.4592) | T T | 122 (0.2754) | 153 (0.3377) |
| | | | Gen | 224 (0.5056) | 208 (0.4592) | T T | 122 (0.2754) | 153 (0.3377) |
| | | MEGA1 | Gen | 698 (0.504) | 839 (0.4811) | T T | 395 (0.2852) | 605 (0.3469) |
| | | | Gen | 698 (0.504) | 839 (0.4811) | T T | 395 (0.2852) | 605 (0.3469) |
| hCV3230096 | CYP4V2 (rs3817184) | LETS | dom | 227 (0.5136) | 211 (0.4668) | C C | 120 (0.2715) | 149 (0.3296) |
| | | MEGA1 | dom | 680 (0.4892) | 831 (0.4776) | C C | 409 (0.2942) | 600 (0.3448) |
| | | LETS | Gen | 227 (0.5136) | 211 (0.4668) | C C | 120 (0.2715) | 149 (0.3296) |
| | | | Gen | 227 (0.5136) | 211 (0.4668) | C C | 120 (0.2715) | 149 (0.3296) |
| | | MEGA1 | Gen | 680 (0.4892) | 831 (0.4776) | C C | 409 (0.2942) | 600 (0.3448) |
| | | | Gen | 680 (0.4892) | 831 (0.4776) | C C | 409 (0.2942) | 600 (0.3448) |
| hCV11786147 | CYP4V2 (rs4862662) | LETS | dom | 223 (0.5103) | 208 (0.4643) | G G | 120 (0.2746) | 150 (0.3348) |
| | | MEGA1 | dom | 665 (0.4941) | 833 (0.476) | G G | 403 (0.2994) | 614 (0.3509) |
| | | LETS | Gen | 223 (0.5103) | 208 (0.4643) | G G | 120 (0.2746) | 150 (0.3348) |
| | | | Gen | 223 (0.5103) | 208 (0.4643) | G G | 120 (0.2746) | 150 (0.3348) |
| | | MEGA1 | Gen | 665 (0.4941) | 833 (0.476) | G G | 403 (0.2994) | 614 (0.3509) |
| | | | Gen | 665 (0.4941) | 833 (0.476) | G G | 403 (0.2994) | 614 (0.3509) |
| hCV3230084 | CYP4V2 (rs7682918) | MEGA1 | Gen | 670 (0.4989) | 803 (0.4594) | C C | 426 (0.3172) | 657 (0.3759) |
| | | LETS | Gen | 239 (0.5432) | 210 (0.4656) | C C | 126 (0.2864) | 154 (0.3415) |
| | | LETS | Gen | 239 (0.5432) | 210 (0.4656) | C C | 126 (0.2864) | 154 (0.3415) |
| | | | Gen | 239 (0.5432) | 210 (0.4656) | C C | 126 (0.2864) | 154 (0.3415) |
| | | MEGA1 | Gen | 670 (0.4989) | 803 (0.4594) | C C | 426 (0.3172) | 657 (0.3759) |
| | | | Gen | 670 (0.4989) | 803 (0.4594) | C C | 426 (0.3172) | 657 (0.3759) |
| hCV26265231 | CYP4V2 (rs7684025) | MEGA1 | dom | 682 (0.5082) | 853 (0.4897) | G G | 325 (0.2422) | 516 (0.2962) |
| | | LETS | dom | 228 (0.5147) | 204 (0.4503) | G G | 99 (0.2235) | 133 (0.2936) |
| | | LETS | Gen | 228 (0.5147) | 204 (0.4503) | G G | 99 (0.2235) | 133 (0.2936) |
| | | | Gen | 228 (0.5147) | 204 (0.4503) | G G | 99 (0.2235) | 133 (0.2936) |
| | | MEGA1 | Gen | 682 (0.5082) | 853 (0.4897) | G G | 325 (0.2422) | 516 (0.2962) |
| | | | Gen | 682 (0.5082) | 853 (0.4897) | G G | 325 (0.2422) | 516 (0.2962) |
| hCV9860072 | DHX38 (rs1050362) | LETS | Gen | 224 (0.5056) | 195 (0.4305) | C C | 157 (0.3544) | 196 (0.4327) |
| | | MEGA1 | Gen | 632 (0.4586) | 797 (0.4562) | C C | 541 (0.3926) | 730 (0.4179) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 224 (0.5056 | 195 (0.4305) | C C | 157 (0.3544 | 196 (0.4327) |
| | | | Gen | 224 (0.5056 | 195 (0.4305) | C C | 157 (0.3544 | 196 (0.4327) |
| | | MEGA1 | Gen | 632 (0.4586 | 797 (0.4562) | C C | 541 (0.3926 | 730 (0.4179) |
| | | | Gen | 632 (0.4586 | 797 (0.4562) | C C | 541 (0.3926 | 730 (0.4179) |
| hCV2103346 | DKFZP564J102 | LETS | rec | 194 (0.4399 | 230 (0.51) | T T | 143 (0.3243 | 144 (0.3193) |
| | (rs11733307) | MEGA1 | dom | 668 (0.4952 | 834 (0.4752) | T T | 380 (0.2817 | 562 (0.3202) |
| | | LETS | Gen | 194 (0.4399 | 230 (0.51) | T T | 143 (0.3243 | 144 (0.3193) |
| | | | Gen | 194 (0.4399 | 230 (0.51) | T T | 143 (0.3243 | 144 (0.3193) |
| | | MEGA1 | Gen | 668 (0.4952 | 834 (0.4752) | T T | 380 (0.2817 | 562 (0.3202) |
| | | | Gen | 668 (0.4952 | 834 (0.4752) | T T | 380 (0.2817 | 562 (0.3202) |
| hCV12086148 | DKFZP564J102 | LETS | rec | 138 (0.3129 | 168 (0.3725) | G G | 279 (0.6327 | 258 (0.5721) |
| | (rs1877321) | MEGA1 | Gen | 491 (0.3543 | 625 (0.358) | G G | 839 (0.6053 | 1021 (0.5848) |
| | | LETS | Gen | 138 (0.3129 | 168 (0.3725) | G G | 279 (0.6327 | 258 (0.5721) |
| | | | Gen | 138 (0.3129 | 168 (0.3725) | G G | 279 (0.6327 | 258 (0.5721) |
| | | MEGA1 | Gen | 491 (0.3543 | 625 (0.358) | G G | 839 (0.6053 | 1021 (0.5848) |
| | | | Gen | 491 (0.3543 | 625 (0.358) | G G | 839 (0.6053 | 1021 (0.5848) |
| hCV25473516 | DUSSP11 (rs2272051) | LETS | Gen | 214 (0.4842 | 224 (0.4956) | C C | 158 (0.3575 | 175 (0.3872) |
| | | MEGA1 | Gen | 641 (0.4615 | 808 (0.4615) | C C | 542 (0.3902 | 734 (0.4192) |
| | | LETS | Gen | 214 (0.4842 | 224 (0.4956) | C C | 158 (0.3575 | 175 (0.3872) |
| | | | Gen | 214 (0.4842 | 224 (0.4956) | C C | 158 (0.3575 | 175 (0.3872) |
| | | MEGA1 | Gen | 641 (0.4615 | 808 (0.4615) | C C | 542 (0.3902 | 734 (0.4192) |
| | | | Gen | 641 (0.4615 | 808 (0.4615) | C C | 542 (0.3902 | 734 (0.4192) |
| hCV15871021 | EBF1 (rs2072495) | LETS | rec | 191 (0.4321 | 238 (0.5254) | G G | 181 (0.4095 | 149 (0.3289) |
| | | MEGA1 | dom | 699 (0.5018 | 834 (0.4774) | G G | 526 (0.3776 | 644 (0.3686) |
| | | LETS | Gen | 191 (0.4321 | 238 (0.5254) | G G | 181 (0.4095 | 149 (0.3289) |
| | | | Gen | 191 (0.4321 | 238 (0.5254) | G G | 181 (0.4095 | 149 (0.3289) |
| | | MEGA1 | Gen | 699 (0.5018 | 834 (0.4774) | G G | 526 (0.3776 | 644 (0.3686) |
| | | | Gen | 699 (0.5018 | 834 (0.4774) | G G | 526 (0.3776 | 644 (0.3686) |
| hCV491830 | EPS8L2 (rs3087546) | LETS | add | 206 (0.4703 | 227 (0.5033) | T T | 158 (0.3607 | 130 (0.2882) |
| | | MEGA1 | add | 667 (0.4805 | 822 (0.47) | T T | 485 (0.3494 | 571 (0.3265) |
| | | LETS | Gen | 206 (0.4703 | 227 (0.5033) | T T | 158 (0.3607 | 130 (0.2882) |
| | | | Gen | 206 (0.4703 | 227 (0.5033) | T T | 158 (0.3607 | 130 (0.2882) |
| | | MEGA1 | Gen | 667 (0.4805 | 822 (0.47) | T T | 485 (0.3494 | 571 (0.3265) |
| | | | Gen | 667 (0.4805 | 822 (0.47) | T T | 485 (0.3494 | 571 (0.3265) |
| hCV2017876 | EPS8L3 (rs3818562) | LETS | add | 202 (0.456 | 216 (0.4779) | G G | 145 (0.3273 | 123 (0.2721) |
| | | MEGA1 | add | 677 (0.492 | 888 (0.508) | G G | 417 (0.3031 | 466 (0.2666) |
| | | LETS | Gen | 202 (0.456 | 216 (0.4779) | G G | 145 (0.3273 | 123 (0.2721) |
| | | | Gen | 202 (0.456 | 216 (0.4779) | G G | 145 (0.3273 | 123 (0.2721) |
| | | MEGA1 | Gen | 677 (0.492 | 888 (0.508) | G G | 417 (0.3031 | 466 (0.2666) |
| | | | Gen | 677 (0.492 | 888 (0.508) | G G | 417 (0.3031 | 466 (0.2666) |
| hCV12066124 | F11 (rs2036914) | MEGA1 | add | 682 (0.4903 | 865 (0.4932) | C C | 476 (0.3422 | 482 (0.2748) |
| | | LETS | add | 215 (0.4853 | 216 (0.4768) | C C | 159 (0.3589 | 138 (0.3046) |
| | | LETS | Gen | 215 (0.4853 | 216 (0.4768) | C C | 159 (0.3589 | 138 (0.3046) |
| | | | Gen | 215 (0.4853 | 216 (0.4768) | C C | 159 (0.3589 | 138 (0.3046) |
| | | MEGA1 | Gen | 682 (0.4903 | 865 (0.4932) | C C | 476 (0.3422 | 482 (0.2748) |
| | | | Gen | 682 (0.4903 | 865 (0.4932) | C C | 476 (0.3422 | 482 (0.2748) |
| hCV16172935 | F11 (rs2241817) | LETS | rec | 182 (0.4118 | 220 (0.4867) | A A | 208 (0.4706 | 186 (0.4115) |
| | | MEGA1 | rec | 625 (0.4516 | 808 (0.4644) | A A | 620 (0.448 | 713 (0.4098) |
| | | LETS | Gen | 182 (0.4118 | 220 (0.4867) | A A | 208 (0.4706 | 186 (0.4115) |
| | | | Gen | 182 (0.4118 | 220 (0.4867) | A A | 208 (0.4706 | 186 (0.4115) |
| | | MEGA1 | Gen | 625 (0.4516 | 808 (0.4644) | A A | 620 (0.448 | 713 (0.4098) |
| | | | Gen | 625 (0.4516 | 808 (0.4644) | A A | 620 (0.448 | 713 (0.4098) |
| hCV3230038 | F11 (rs2289252) | LETS | add | 204 (0.4626 | 200 (0.4435) | C C | 130 (0.2948 | 158 (0.3503) |
| | | MEGA1 | add | 689 (0.5115 | 840 (0.48) | C C | 344 (0.2554 | 601 (0.3434) |
| | | LETS | Gen | 204 (0.4626 | 200 (0.4435) | C C | 130 (0.2948 | 158 (0.3503) |
| | | | Gen | 204 (0.4626 | 200 (0.4435) | C C | 130 (0.2948 | 158 (0.3503) |
| | | MEGA1 | Gen | 689 (0.5115 | 840 (0.48) | C C | 344 (0.2554 | 601 (0.3434) |
| | | | Gen | 689 (0.5115 | 840 (0.48) | C C | 344 (0.2554 | 601 (0.3434) |
| hCV27474895 | F11 (rs3756011) | MEGA1 | add | 692 (0.5018 | 838 (0.4794) | C C | 361 (0.2618 | 598 (0.3421) |
| | | LETS | add | 208 (0.4695 | 200 (0.4425) | C C | 128 (0.2889 | 160 (0.354) |
| | | LETS | Gen | 208 (0.4695 | 200 (0.4425) | C C | 128 (0.2889 | 160 (0.354) |
| | | | Gen | 208 (0.4695 | 200 (0.4425) | C C | 128 (0.2889 | 160 (0.354) |
| | | MEGA1 | Gen | 692 (0.5018 | 838 (0.4794) | C C | 361 (0.2618 | 598 (0.3421) |
| | | | Gen | 692 (0.5018 | 838 (0.4794) | C C | 361 (0.2618 | 598 (0.3421) |
| hCV25474413 | F11 (rs3822057) | LETS | Gen | 214 (0.4831 | 213 (0.4702) | C C | 138 (0.3115 | 124 (0.2737) |
| | | MEGA1 | Gen | 690 (0.5055 | 876 (0.4991) | C C | 406 (0.2974 | 422 (0.2405) |
| | | LETS | Gen | 214 (0.4831 | 213 (0.4702) | C C | 138 (0.3115 | 124 (0.2737) |
| | | | Gen | 214 (0.4831 | 213 (0.4702) | C C | 138 (0.3115 | 124 (0.2737) |
| | | MEGA1 | Gen | 690 (0.5055 | 876 (0.4991) | C C | 406 (0.2974 | 422 (0.2405) |
| | | | Gen | 690 (0.5055 | 876 (0.4991) | C C | 406 (0.2974 | 422 (0.2405) |
| hCV27490984 | F11 (rs3822058) | LETS | rec | 181 (0.4095 | 221 (0.4889) | G G | 207 (0.4683 | 185 (0.4093) |
| | | MEGA1 | rec | 633 (0.4547 | 816 (0.4671) | G G | 624 (0.4483 | 712 (0.4076) |
| | | LETS | Gen | 181 (0.4095 | 221 (0.4889) | G G | 207 (0.4683 | 185 (0.4093) |
| | | | Gen | 181 (0.4095 | 221 (0.4889) | G G | 207 (0.4683 | 185 (0.4093) |
| | | MEGA1 | Gen | 633 (0.4547 | 816 (0.4671) | G G | 624 (0.4483 | 712 (0.4076) |
| | | | Gen | 633 (0.4547 | 816 (0.4671) | G G | 624 (0.4483 | 712 (0.4076) |
| hCV25474414 | F11 (rs4253399) | MEGA1 | add | 658 (0.4892 | 831 (0.4735) | T T | 409 (0.3041 | 660 (0.3761) |
| | | LETS | add | 205 (0.4649 | 192 (0.4257) | T T | 142 (0.322 | 179 (0.3969) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 205 (0.4649) | 192 (0.4257) | G T | 142 (0.322) | 179 (0.3969) |
| | | | Gen | 205 (0.4649) | 192 (0.4257) | T T | 142 (0.322) | 179 (0.3969) |
| | | MEGA1 | Gen | 658 (0.4892) | 831 (0.4735) | T T | 409 (0.3041) | 660 (0.3761) |
| | | | Gen | 658 (0.4892) | 831 (0.4735) | T T | 409 (0.3041) | 660 (0.3761) |
| hCV26038139 | F11 (rs4253405) | MEGA1 | Gen | 643 (0.4619) | 814 (0.4646) | A A | 607 (0.4361) | 689 (0.3933) |
| | | LETS | Gen | 179 (0.4059) | 225 (0.4978) | A A | 199 (0.4512) | 175 (0.3872) |
| | | LETS | Gen | 179 (0.4059) | 225 (0.4978) | A A | 199 (0.4512) | 175 (0.3872) |
| | | | Gen | 179 (0.4059) | 225 (0.4978) | A A | 199 (0.4512) | 175 (0.3872) |
| | | MEGA1 | Gen | 643 (0.4619) | 814 (0.4646) | A A | 607 (0.4361) | 689 (0.3933) |
| | | | Gen | 643 (0.4619) | 814 (0.4646) | A A | 607 (0.4361) | 689 (0.3933) |
| hCV3230119 | F11 (rs4253430) | LETS | rec | 183 (0.415) | 222 (0.4912) | G G | 206 (0.4671) | 182 (0.4027) |
| | | MEGA1 | rec | 631 (0.454) | 812 (0.4635) | G G | 624 (0.4489) | 722 (0.4121) |
| | | LETS | Gen | 183 (0.415) | 222 (0.4912) | G G | 206 (0.4671) | 182 (0.4027) |
| | | | Gen | 183 (0.415) | 222 (0.4912) | G G | 206 (0.4671) | 182 (0.4027) |
| | | MEGA1 | Gen | 631 (0.454) | 812 (0.4635) | G G | 624 (0.4489) | 722 (0.4121) |
| | | | Gen | 631 (0.454) | 812 (0.4635) | G G | 624 (0.4489) | 722 (0.4121) |
| hCV8241630 | F11 (rs925451) | MEGA1 | add | 666 (0.4904) | 816 (0.4663) | G G | 403 (0.2968) | 662 (0.3783) |
| | | LETS | add | 212 (0.4807) | 194 (0.4292) | G G | 134 (0.3039) | 171 (0.3783) |
| | | LETS | Gen | 212 (0.4807) | 194 (0.4292) | G G | 134 (0.3039) | 171 (0.3783) |
| | | | Gen | 212 (0.4807) | 194 (0.4292) | G G | 134 (0.3039) | 171 (0.3783) |
| | | MEGA1 | Gen | 666 (0.4904) | 816 (0.4663) | G G | 403 (0.2968) | 662 (0.3783) |
| | | | Gen | 666 (0.4904) | 816 (0.4663) | G G | 403 (0.2968) | 662 (0.3783) |
| hCV8726802 | F2 (rs1799963) | MEGA1 | add | 80 (0.0579) | 37 (0.0211) | G G | 1301 (0.9421) | 1716 (0.9789) |
| | | LETS | add | 28 (0.0633) | 10 (0.0221) | G G | 414 (0.9367) | 442 (0.9779) |
| | | LETS | Gen | 28 (0.0633) | 10 (0.0221) | A A | 414 (0.9367) | 442 (0.9779) |
| | | MEGA1 | Gen | 80 (0.0579) | 37 (0.0211) | G G | 1301 (0.9421) | 1716 (0.9789) |
| hCV27480803 | F5 (rs3766103) | MEGA1 | add | 660 (0.4755) | 840 (0.4805) | T T | 382 (0.2752) | 557 (0.3186) |
| | | LETS | add | 216 (0.4898) | 222 (0.4901) | T T | 129 (0.2925) | 158 (0.3488) |
| | | LETS | Gen | 216 (0.4898) | 222 (0.4901) | T T | 129 (0.2925) | 158 (0.3488) |
| | | | Gen | 216 (0.4898) | 222 (0.4901) | T T | 129 (0.2925) | 158 (0.3488) |
| | | MEGA1 | Gen | 660 (0.4755) | 840 (0.4805) | T T | 382 (0.2752) | 557 (0.3186) |
| | | | Gen | 660 (0.4755) | 840 (0.4805) | T T | 382 (0.2752) | 557 (0.3186) |
| hCV8919444 | F5 (rs4524) | MEGA1 | add | 440 (0.317) | 680 (0.3883) | T T | 872 (0.6282) | 964 (0.5505) |
| | | LETS | add | 130 (0.2935) | 169 (0.3739) | T T | 289 (0.6524) | 251 (0.5553) |
| | | LETS | Gen | 130 (0.2935) | 169 (0.3739) | T T | 289 (0.6524) | 251 (0.5553) |
| | | | Gen | 130 (0.2935) | 169 (0.3739) | T T | 289 (0.6524) | 251 (0.5553) |
| | | MEGA1 | Gen | 440 (0.317) | 680 (0.3883) | T T | 872 (0.6282) | 964 (0.5505) |
| | | | Gen | 440 (0.317) | 680 (0.3883) | T T | 872 (0.6282) | 964 (0.5505) |
| hCV8919442 | F5 (rs4525) | MEGA1 | add | 431 (0.3148) | 685 (0.3899) | T T | 864 (0.6311) | 965 (0.5492) |
| | | LETS | add | 128 (0.2909) | 168 (0.3733) | T T | 287 (0.6523) | 251 (0.5578) |
| | | LETS | Gen | 128 (0.2909) | 168 (0.3733) | T T | 287 (0.6523) | 251 (0.5578) |
| | | | Gen | 128 (0.2909) | 168 (0.3733) | T T | 287 (0.6523) | 251 (0.5578) |
| | | MEGA1 | Gen | 431 (0.3148) | 685 (0.3899) | T T | 864 (0.6311) | 965 (0.5492) |
| | | | Gen | 431 (0.3148) | 685 (0.3899) | T T | 864 (0.6311) | 965 (0.5492) |
| hCV8919451 | F5 (rs6016) | MEGA1 | add | 430 (0.31) | 679 (0.3869) | G G | 879 (0.6337) | 968 (0.5516) |
| | | LETS | add | 130 (0.2948) | 170 (0.3778) | G G | 287 (0.6508) | 249 (0.5533) |
| | | LETS | Gen | 130 (0.2948) | 170 (0.3778) | G G | 287 (0.6508) | 249 (0.5533) |
| | | | Gen | 130 (0.2948) | 170 (0.3778) | G G | 287 (0.6508) | 249 (0.5533) |
| | | MEGA1 | Gen | 430 (0.31) | 679 (0.3869) | G G | 879 (0.6337) | 968 (0.5516) |
| | | | Gen | 430 (0.31) | 679 (0.3869) | G G | 879 (0.6337) | 968 (0.5516) |
| hCV2288095 | F9 (rs378815) | LETS | Gen | 111 (0.2517) | 120 (0.2667) | C C | 250 (0.5669) | 223 (0.4956) |
| | | MEGA1 | Gen | 331 (0.2381) | 378 (0.2161) | C C | 753 (0.5417) | 940 (0.5374) |
| | | LETS | Gen | 111 (0.2517) | 120 (0.2667) | C C | 250 (0.5669) | 223 (0.4956) |
| | | | Gen | 111 (0.2517) | 120 (0.2667) | C C | 250 (0.5669) | 223 (0.4956) |
| | | MEGA1 | Gen | 331 (0.2381) | 378 (0.2161) | C C | 753 (0.5417) | 940 (0.5374) |
| | | | Gen | 331 (0.2381) | 378 (0.2161) | C C | 753 (0.5417) | 940 (0.5374) |
| hCV596326 | F9 (rs398101) | LETS | rec | 91 (0.2068) | 120 (0.2655) | A A | 274 (0.6227) | 240 (0.531) |
| | | MEGA1 | rec | 310 (0.224) | 350 (0.1998) | A A | 817 (0.5903) | 1021 (0.5828) |
| | | LETS | Gen | 91 (0.2068) | 120 (0.2655) | A A | 274 (0.6227) | 240 (0.531) |
| | | | Gen | 91 (0.2068) | 120 (0.2655) | A A | 274 (0.6227) | 240 (0.531) |
| | | MEGA1 | Gen | 310 (0.224) | 350 (0.1998) | A A | 817 (0.5903) | 1021 (0.5828) |
| | | | Gen | 310 (0.224) | 350 (0.1998) | A A | 817 (0.5903) | 1021 (0.5828) |
| hCV596330 | F9 (rs422187) | LETS | add | 103 (0.2336) | 120 (0.2667) | A A | 268 (0.6077) | 243 (0.54) |
| | | MEGA1 | add | 314 (0.2274) | 361 (0.2062) | A A | 824 (0.5967) | 1014 (0.5791) |
| | | LETS | Gen | 103 (0.2336) | 120 (0.2667) | A A | 268 (0.6077) | 243 (0.54) |
| | | | Gen | 103 (0.2336) | 120 (0.2667) | A A | 268 (0.6077) | 243 (0.54) |
| | | MEGA1 | Gen | 314 (0.2274) | 361 (0.2062) | A A | 824 (0.5967) | 1014 (0.5791) |
| | | | Gen | 314 (0.2274) | 361 (0.2062) | A A | 824 (0.5967) | 1014 (0.5791) |
| hCV596331 | F9 (rs6048) | LETS | rec | 99 (0.2235) | 122 (0.2693) | A A | 274 (0.6185) | 244 (0.5386) |
| | | MEGA1 | dom | 295 (0.215) | 347 (0.1994) | A A | 844 (0.6152) | 1037 (0.596) |
| | | LETS | Gen | 99 (0.2235) | 122 (0.2693) | A A | 274 (0.6185) | 244 (0.5386) |
| | | | Gen | 99 (0.2235) | 122 (0.2693) | A A | 274 (0.6185) | 244 (0.5386) |
| | | MEGA1 | Gen | 295 (0.215) | 347 (0.1994) | A A | 844 (0.6152) | 1037 (0.596) |
| | | | Gen | 295 (0.215) | 347 (0.1994) | A A | 844 (0.6152) | 1037 (0.596) |
| hCV2892877 | FGA (rs6050) | LETS | add | 249 (0.5621) | 226 (0.4989) | T T | 194 (0.4379) | 227 (0.5011) |
| | | MEGA1 | add | 807 (0.5814) | 859 (0.4914) | T T | 581 (0.4186) | 889 (0.5086) |
| | | LETS | Gen | 249 (0.5621) | 226 (0.4989) | T T | 194 (0.4379) | 227 (0.5011) |
| | | MEGA1 | Gen | 807 (0.5814) | 859 (0.4914) | T T | 581 (0.4186) | 889 (0.5086) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| hCV11503469 | FGG (rs2066854) | MEGA1 | add | 624 (0.4486) | 687 (0.3917) | T T | 593 (0.4263) | 928 (0.5291) |
| | | LETS | add | 183 (0.4207) | 187 (0.424) | T T | 198 (0.4552) | 232 (0.5261) |
| | | LETS | Gen | 183 (0.4207) | 187 (0.424) | T T | 198 (0.4552) | 232 (0.5261) |
| | | | Gen | 183 (0.4207) | 187 (0.424) | T T | 198 (0.4552) | 232 (0.5261) |
| | | MEGA1 | Gen | 624 (0.4486) | 687 (0.3917) | T T | 593 (0.4263) | 928 (0.5291) |
| | | | Gen | 624 (0.4486) | 687 (0.3917) | T T | 593 (0.4263) | 928 (0.5291) |
| hCV11503414 | FGG (rs2066865) | MEGA1 | add | 608 (0.451) | 692 (0.3941) | G G | 574 (0.4258) | 928 (0.5285) |
| | | LETS | add | 186 (0.4256) | 188 (0.4206) | G G | 195 (0.4462) | 235 (0.5257) |
| | | LETS | Gen | 186 (0.4256) | 188 (0.4206) | G G | 195 (0.4462) | 235 (0.5257) |
| | | | Gen | 186 (0.4256) | 188 (0.4206) | G G | 195 (0.4462) | 235 (0.5257) |
| | | MEGA1 | Gen | 608 (0.451) | 692 (0.3941) | G G | 574 (0.4258) | 928 (0.5285) |
| | | | Gen | 608 (0.451) | 692 (0.3941) | G G | 574 (0.4258) | 928 (0.5285) |
| hCV30505633 | GNG12 (rs7530537) | LETS | add | 68 (0.1538) | 52 (0.1148) | C C | 369 (0.8348) | 400 (0.883) |
| | | MEGA1 | add | 206 (0.1486) | 229 (0.1304) | C C | 1164 (0.8398) | 1515 (0.8628) |
| | | LETS | Gen | 68 (0.1538) | 52 (0.1148) | C C | 369 (0.8348) | 400 (0.883) |
| | | | Gen | 68 (0.1538) | 52 (0.1148) | C C | 369 (0.8348) | 400 (0.883) |
| | | MEGA1 | Gen | 206 (0.1486) | 229 (0.1304) | C C | 1164 (0.8398) | 1515 (0.8628) |
| | | | Gen | 206 (0.1486) | 229 (0.1304) | C C | 1164 (0.8398) | 1515 (0.8628) |
| hCV8717873 | GP6 (rs1613662) | MEGA1 | add | 368 (0.2651) | 553 (0.3162) | A A | 975 (0.7024) | 1135 (0.6489) |
| | | LETS | add | 117 (0.2641) | 143 (0.3157) | A A | 316 (0.7133) | 291 (0.6424) |
| | | LETS | Gen | 117 (0.2641) | 143 (0.3157) | A A | 316 (0.7133) | 291 (0.6424) |
| | | | Gen | 117 (0.2641) | 143 (0.3157) | A A | 316 (0.7133) | 291 (0.6424) |
| | | MEGA1 | Gen | 368 (0.2651) | 553 (0.3162) | A A | 975 (0.7024) | 1135 (0.6489) |
| | | | Gen | 368 (0.2651) | 553 (0.3162) | A A | 975 (0.7024) | 1135 (0.6489) |
| hCV1376342 | GP6 (rs1654416) | LETS | Gen | 130 (0.2935) | 142 (0.3135) | T T | 298 (0.6727) | 285 (0.6291) |
| | | MEGA1 | rec | 393 (0.2875) | 580 (0.3307) | T T | 925 (0.6767) | 1108 (0.6317) |
| | | LETS | Gen | 130 (0.2935) | 142 (0.3135) | T T | 298 (0.6727) | 285 (0.6291) |
| | | | Gen | 130 (0.2935) | 142 (0.3135) | T T | 298 (0.6727) | 285 (0.6291) |
| | | MEGA1 | Gen | 393 (0.2875) | 580 (0.3307) | T T | 925 (0.6767) | 1108 (0.6317) |
| | | | Gen | 393 (0.2875) | 580 (0.3307) | T T | 925 (0.6767) | 1108 (0.6317) |
| hCV8717893 | GP6 (rs1671192) | LETS | Gen | 130 (0.2941) | 142 (0.3135) | G G | 297 (0.6719) | 285 (0.6291) |
| | | MEGA1 | rec | 393 (0.2831) | 584 (0.3326) | G G | 944 (0.6801) | 1108 (0.631) |
| | | LETS | Gen | 130 (0.2941) | 142 (0.3135) | G G | 297 (0.6719) | 285 (0.6291) |
| | | | Gen | 130 (0.2941) | 142 (0.3135) | G G | 297 (0.6719) | 285 (0.6291) |
| | | MEGA1 | Gen | 393 (0.2831) | 584 (0.3326) | G G | 944 (0.6801) | 1108 (0.631) |
| | | | Gen | 393 (0.2831) | 584 (0.3326) | G G | 944 (0.6801) | 1108 (0.631) |
| hCV2575036 | GRB10 (rs34432772) | LETS | add | 8 (0.0181) | 24 (0.053) | A A | 433 (0.9819) | 429 (0.947) |
| | | MEGA1 | add | 68 (0.0498) | 61 (0.0348) | A A | 1297 (0.9495) | 1692 (0.9652) |
| | | LETS | Gen | 8 (0.0181) | 24 (0.053) | A A | 433 (0.9819) | 429 (0.947) |
| | | MEGA1 | Gen | 68 (0.0498) | 61 (0.0348) | A A | 1297 (0.9495) | 1692 (0.9652) |
| | | | Gen | 68 (0.0498) | 61 (0.0348) | A A | 1297 (0.9495) | 1692 (0.9652) |
| hCV2699725 | GUCY1B2 (rs11841997) | LETS | Gen | 33 (0.0755) | 19 (0.0424) | G G | 401 (0.9176) | 428 (0.9554) |
| | | MEGA1 | Gen | 102 (0.0731) | 98 (0.0558) | C C | 1290 (0.9241) | 1654 (0.9414) |
| | | LETS | Gen | 33 (0.0755) | 19 (0.0424) | G G | 401 (0.9176) | 428 (0.9554) |
| | | | Gen | 33 (0.0755) | 19 (0.0424) | G G | 401 (0.9176) | 428 (0.9554) |
| | | MEGA1 | Gen | 102 (0.0731) | 98 (0.0558) | C C | 1290 (0.9241) | 1654 (0.9414) |
| | | | Gen | 102 (0.0731) | 98 (0.0558) | C C | 1290 (0.9241) | 1654 (0.9414) |
| hCV25995678 | hCV25995678 | LETS | add | 61 (0.138) | 85 (0.1881) | T T | 377 (0.8529) | 359 (0.7942) |
| | | MEGA1 | dom | 222 (0.1594) | 277 (0.1586) | T T | 1166 (0.837) | 1452 (0.8316) |
| | | LETS | Gen | 61 (0.138) | 85 (0.1881) | T T | 377 (0.8529) | 359 (0.7942) |
| | | | Gen | 61 (0.138) | 85 (0.1881) | T T | 377 (0.8529) | 359 (0.7942) |
| | | MEGA1 | Gen | 222 (0.1594) | 277 (0.1586) | T T | 1166 (0.837) | 1452 (0.8316) |
| | | | Gen | 222 (0.1594) | 277 (0.1586) | T T | 1166 (0.837) | 1452 (0.8316) |
| hCV25996277 | hCV25996277 | LETS | add | 63 (0.1422) | 86 (0.1898) | A A | 376 (0.8488) | 359 (0.7925) |
| | | MEGA1 | Gen | 217 (0.157) | 277 (0.158) | A A | 1160 (0.8394) | 1456 (0.8306) |
| | | LETS | Gen | 63 (0.1422) | 86 (0.1898) | A A | 376 (0.8488) | 359 (0.7925) |
| | | | Gen | 63 (0.1422) | 86 (0.1898) | A A | 376 (0.8488) | 359 (0.7925) |
| | | MEGA1 | Gen | 217 (0.157) | 277 (0.158) | A A | 1160 (0.8394) | 1456 (0.8306) |
| | | | Gen | 217 (0.157) | 277 (0.158) | A A | 1160 (0.8394) | 1456 (0.8306) |
| hCV31199195 | KCTTD10 (rs10850234) | LETS | dom | 142 (0.3205) | 111 (0.245) | A A | 289 (0.6524) | 328 (0.7241) |
| | | MEGA1 | dom | 423 (0.3048) | 486 (0.2772) | A A | 913 (0.6578) | 1215 (0.6931) |
| | | LETS | Gen | 142 (0.3205) | 111 (0.245) | A A | 289 (0.6524) | 328 (0.7241) |
| | | | Gen | 142 (0.3205) | 111 (0.245) | A A | 289 (0.6524) | 328 (0.7241) |
| | | MEGA1 | Gen | 423 (0.3048) | 486 (0.2772) | A A | 913 (0.6578) | 1215 (0.6931) |
| | | | Gen | 423 (0.3048) | 486 (0.2772) | A A | 913 (0.6578) | 1215 (0.6931) |
| hCV27502514 | KLF3 (rs3796533) | MEGA1 | dom | 410 (0.2962) | 465 (0.2654) | G G | 930 (0.672) | 1242 (0.7089) |
| | | LETS | dom | 146 (0.3296) | 122 (0.2693) | G G | 280 (0.6321) | 316 (0.6976) |
| | | LETS | Gen | 146 (0.3296) | 122 (0.2693) | G G | 280 (0.6321) | 316 (0.6976) |
| | | | Gen | 146 (0.3296) | 122 (0.2693) | G G | 280 (0.6321) | 316 (0.6976) |
| | | MEGA1 | Gen | 410 (0.2962) | 465 (0.2654) | G G | 930 (0.672) | 1242 (0.7089) |
| | | | Gen | 410 (0.2962) | 465 (0.2654) | G G | 930 (0.672) | 1242 (0.7089) |
| hCV11786258 | KLKB1 (rs4253303) | LETS | Gen | 226 (0.5136) | 208 (0.4622) | G G | 131 (0.2977) | 159 (0.3533) |
| | | MEGA1 | Gen | 686 (0.4932) | 815 (0.4649) | G G | 434 (0.312) | 656 (0.3742) |
| | | LETS | Gen | 226 (0.5136) | 208 (0.4622) | G G | 131 (0.2977) | 159 (0.3533) |
| | | | Gen | 226 (0.5136) | 208 (0.4622) | G G | 131 (0.2977) | 159 (0.3533) |
| | | MEGA1 | Gen | 686 (0.4932) | 815 (0.4649) | G G | 434 (0.312) | 656 (0.3742) |
| | | | Gen | 686 (0.4932) | 815 (0.4649) | G G | 434 (0.312) | 656 (0.3742) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| hCV540410 | LASP1 (rs609529) | LETS | Gen | 59 (0.1335) | 42 (0.0927) | T T | 381 (0.862) | 407 (0.8985) |
| | | MEGA1 | Gen | 178 (0.1276) | 216 (0.123) | T T | 1202 (0.8616) | 1535 (0.8741) |
| | | LETS | Gen | 59 (0.1335) | 42 (0.0927) | T T | 381 (0.862) | 407 (0.8985) |
| | | | Gen | 59 (0.1335) | 42 (0.0927) | T T | 381 (0.862) | 407 (0.8985) |
| | | MEGA1 | Gen | 178 (0.1276) | 216 (0.123) | T T | 1202 (0.8616) | 1535 (0.8741) |
| | | | Gen | 178 (0.1276) | 216 (0.123) | T T | 1202 (0.8616) | 1535 (0.8741) |
| hDV70662128 | LOC129656 | LETS | add | 35 (0.0792) | 22 (0.0486) | G G | 407 (0.9208) | 431 (0.9514) |
| | | MEGA1 | add | 105 (0.0758) | 83 (0.0473) | G G | 1275 (0.9206) | 1667 (0.9504) |
| | (rs17043082) | LETS | Gen | 35 (0.0792) | 22 (0.0486) | G G | 407 (0.9208) | 431 (0.9514) |
| | | MEGA1 | Gen | 105 (0.0758) | 83 (0.0473) | G G | 1275 (0.9206) | 1667 (0.9504) |
| | | | Gen | 105 (0.0758) | 83 (0.0473) | G G | 1275 (0.9206) | 1667 (0.9504) |
| hCV11541681 | LOC200420 | MEGA1 | add | 662 (0.4756) | 815 (0.4644) | G G | 502 (0.3606) | 697 (0.3972) |
| | (rs2001490) | LETS | add | 220 (0.4966) | 228 (0.5033) | G G | 142 (0.3205) | 165 (0.3642) |
| | | LETS | Gen | 220 (0.4966) | 228 (0.5033) | G G | 142 (0.3205) | 165 (0.3642) |
| | | | Gen | 220 (0.4966) | 228 (0.5033) | G G | 142 (0.3205) | 165 (0.3642) |
| | | MEGA1 | Gen | 662 (0.4756) | 815 (0.4644) | G G | 502 (0.3606) | 697 (0.3972) |
| | | | Gen | 662 (0.4756) | 815 (0.4644) | G G | 502 (0.3606) | 697 (0.3972) |
| hCV2706410 | LOC387646 | LETS | Gen | 175 (0.3959) | 146 (0.323) | T T | 234 (0.5294) | 276 (0.6106) |
| | (rs7896532) | MEGA1 | Gen | 535 (0.3914) | 622 (0.354) | T T | 746 (0.5457) | 1014 (0.5771) |
| | | LETS | Gen | 175 (0.3959) | 146 (0.323) | T T | 234 (0.5294) | 276 (0.6106) |
| | | | Gen | 175 (0.3959) | 146 (0.323) | T T | 234 (0.5294) | 276 (0.6106) |
| | | MEGA1 | Gen | 535 (0.3914) | 622 (0.354) | T T | 746 (0.5457) | 1014 (0.5771) |
| | | | Gen | 535 (0.3914) | 622 (0.354) | T T | 746 (0.5457) | 1014 (0.5771) |
| hCV1547677 | LOC646030 | LETS | add | 20 (0.0452) | 8 (0.0179) | A A | 422 (0.9548) | 439 (0.9821) |
| | (rs6505228) | MEGA1 | add | 39 (0.0286) | 47 (0.0268) | A A | 1312 (0.9605) | 1702 (0.9698) |
| | | LETS | Gen | 20 (0.0452) | 8 (0.0179) | A A | 422 (0.9548) | 439 (0.9821) |
| | | MEGA1 | Gen | 39 (0.0286) | 47 (0.0268) | A A | 1312 (0.9605) | 1702 (0.9698) |
| | | | Gen | 39 (0.0286) | 47 (0.0268) | A A | 1312 (0.9605) | 1702 (0.9698) |
| hCV8827309 | LOC728221 | LETS | add | 107 (0.2437) | 83 (0.1836) | C C | 321 (0.7312) | 364 (0.8053) |
| | (rs1110796) | MEGA1 | add | 339 (0.2453) | 368 (0.2131) | C C | 1022 (0.7395) | 1335 (0.773) |
| | | LETS | Gen | 107 (0.2437) | 83 (0.1836) | C C | 321 (0.7312) | 364 (0.8053) |
| | | | Gen | 107 (0.2437) | 83 (0.1836) | C C | 321 (0.7312) | 364 (0.8053) |
| | | MEGA1 | Gen | 339 (0.2453) | 368 (0.2131) | C C | 1022 (0.7395) | 1335 (0.773) |
| | | | Gen | 339 (0.2453) | 368 (0.2131) | C C | 1022 (0.7395) | 1335 (0.773) |
| hCV2103392 | LOC728284 | LETS | dom | 197 (0.4457) | 192 (0.4248) | C C | 196 (0.4434) | 193 (0.427) |
| | (rs12500826) | MEGA1 | dom | 622 (0.4625) | 827 (0.4718) | C C | 570 (0.4238) | 674 (0.3845) |
| | | LETS | Gen | 197 (0.4457) | 192 (0.4248) | C C | 196 (0.4434) | 193 (0.427) |
| | | | Gen | 197 (0.4457) | 192 (0.4248) | C C | 196 (0.4434) | 193 (0.427) |
| | | MEGA1 | Gen | 622 (0.4625) | 827 (0.4718) | C C | 570 (0.4238) | 674 (0.3845) |
| | | | Gen | 622 (0.4625) | 827 (0.4718) | C C | 570 (0.4238) | 674 (0.3845) |
| hCV3230136 | LOC728284 | MEGA1 | rec | 530 (0.3813) | 716 (0.4091) | G G | 785 (0.5647) | 904 (0.5166) |
| | (rs13116273) | LETS | rec | 146 (0.3311) | 183 (0.4049) | G G | 264 (0.5986) | 238 (0.5265) |
| | | LETS | Gen | 146 (0.3311) | 183 (0.4049) | G G | 264 (0.5986) | 238 (0.5265) |
| | | | Gen | 146 (0.3311) | 183 (0.4049) | G G | 264 (0.5986) | 238 (0.5265) |
| | | MEGA1 | Gen | 530 (0.3813) | 716 (0.4091) | G G | 785 (0.5647) | 904 (0.5166) |
| | | | Gen | 530 (0.3813) | 716 (0.4091) | G G | 785 (0.5647) | 904 (0.5166) |
| hCV3230131 | LOC728284 | LETS | rec | 149 (0.3371) | 182 (0.4035) | T T | 262 (0.5928) | 238 (0.5277) |
| | (rs13136269) | MEGA1 | rec | 528 (0.3799) | 719 (0.4104) | T T | 788 (0.5669) | 899 (0.5131) |
| | | LETS | Gen | 149 (0.3371) | 182 (0.4035) | T T | 262 (0.5928) | 238 (0.5277) |
| | | | Gen | 149 (0.3371) | 182 (0.4035) | T T | 262 (0.5928) | 238 (0.5277) |
| | | MEGA1 | Gen | 528 (0.3799) | 719 (0.4104) | T T | 788 (0.5669) | 899 (0.5131) |
| | | | Gen | 528 (0.3799) | 719 (0.4104) | T T | 788 (0.5669) | 899 (0.5131) |
| hCV29821005 | LOC728284 | LETS | Gen | 170 (0.3864) | 147 (0.3267) | C C | 250 (0.5682) | 284 (0.6311) |
| | (rs65522970) | MEGA1 | Gen | 463 (0.3442) | 528 (0.3009) | C C | 820 (0.6097) | 1150 (0.6553) |
| | | LETS | Gen | 170 (0.3864) | 147 (0.3267) | C C | 250 (0.5682) | 284 (0.6311) |
| | | | Gen | 170 (0.3864) | 147 (0.3267) | C C | 250 (0.5682) | 284 (0.6311) |
| | | MEGA1 | Gen | 463 (0.3442) | 528 (0.3009) | C C | 820 (0.6097) | 1150 (0.6553) |
| | | | Gen | 463 (0.3442) | 528 (0.3009) | C C | 820 (0.6097) | 1150 (0.6553) |
| hCV32209621 | LOC728284 | LETS | Gen | 226 (0.5125) | 202 (0.4499) | A A | 124 (0.2812) | 134 (0.2984) |
| | (rs6552971) | MEGA1 | Gen | 669 (0.4959) | 854 (0.4866) | A A | 375 (0.278) | 451 (0.257) |
| | | LETS | Gen | 226 (0.5125) | 202 (0.4499) | A A | 124 (0.2812) | 134 (0.2984) |
| | | | Gen | 226 (0.5125) | 202 (0.4499) | A A | 124 (0.2812) | 134 (0.2984) |
| | | MEGA1 | Gen | 669 (0.4959) | 854 (0.4866) | A A | 375 (0.278) | 451 (0.257) |
| | | | Gen | 669 (0.4959) | 854 (0.4866) | A A | 375 (0.278) | 451 (0.257) |
| hCV32209620 | LOC728284 | LETS | dom | 166 (0.3773) | 145 (0.3215) | T T | 251 (0.5705) | 285 (0.6319) |
| | (rs6552972) | MEGA1 | dom | 461 (0.344) | 527 (0.3022) | T T | 817 (0.6097) | 1141 (0.6542) |
| | | LETS | Gen | 166 (0.3773) | 145 (0.3215) | T T | 251 (0.5705) | 285 (0.6319) |
| | | | Gen | 166 (0.3773) | 145 (0.3215) | T T | 251 (0.5705) | 285 (0.6319) |
| | | MEGA1 | Gen | 461 (0.344) | 527 (0.3022) | T T | 817 (0.6097) | 1141 (0.6542) |
| | | | Gen | 461 (0.344) | 527 (0.3022) | T T | 817 (0.6097) | 1141 (0.6542) |
| hCV916107 | LOC729138 | LETS | add | 185 (0.4186) | 200 (0.4415) | C C | 216 (0.4887) | 192 (0.4238) |
| | (rs670659) | MEGA1 | add | 620 (0.4457) | 773 (0.442) | C C | 622 (0.4472) | 738 (0.422) |
| | | LETS | Gen | 185 (0.4186) | 200 (0.4415) | C C | 216 (0.4887) | 192 (0.4238) |
| | | | Gen | 185 (0.4186) | 200 (0.4415) | C C | 216 (0.4887) | 192 (0.4238) |
| | | MEGA1 | Gen | 620 (0.4457) | 773 (0.442) | C C | 622 (0.4472) | 738 (0.422) |
| | | | Gen | 620 (0.4457) | 773 (0.442) | C C | 622 (0.4472) | 738 (0.422) |
| hCV30922162 | LOC729672 | LETS | add | 201 (0.4548) | 202 (0.4459) | C C | 191 (0.4321) | 222 (0.4901) |
| | (rs4334028) | MEGA1 | add | 601 (0.433) | 748 (0.4262) | C C | 655 (0.4719) | 874 (0.498) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 201 (0.4548 | 202 (0.4459) | C C | 191 (0.4321 | 222 (0.4901) |
| | | | Gen | 201 (0.4548 | 202 (0.4459) | C C | 191 (0.4321 | 222 (0.4901) |
| | | MEGA1 | Gen | 601 (0.433 | 748 (0.4262) | C C | 655 (0.4719 | 874 (0.498) |
| | | | Gen | 601 (0.433 | 748 (0.4262) | C C | 655 (0.4719 | 874 (0.498) |
| hCV7504118 | LOC729672 (rs967257) | MEGA1 | add | 595 (0.4293 | 734 (0.418) | A A | 668 (0.482 | 902 (0.5137) |
| | | LETS | add | 200 (0.4525 | 195 (0.4305) | A A | 198 (0.448 | 229 (0.5055) |
| | | LETS | Gen | 200 (0.4525 | 195 (0.4305) | A A | 198 (0.448 | 229 (0.5055) |
| | | | Gen | 200 (0.4525 | 195 (0.4305) | A A | 198 (0.448 | 229 (0.5055) |
| | | MEGA1 | Gen | 595 (0.4293 | 734 (0.418) | A A | 668 (0.482 | 902 (0.5137) |
| | | | Gen | 595 (0.4293 | 734 (0.418) | A A | 668 (0.482 | 902 (0.5137) |
| hCV11633415 | LOC730144 (rs4262503) | MEGA1 | add | 156 (0.1124 | 258 (0.147) | T T | 1226 (0.8833 | 1486 (0.8467) |
| | | LETS | add | 51 (0.1151 | 67 (0.1482) | T T | 392 (0.8849 | 381 (0.8429) |
| | | LETS | Gen | 51 (0.1151 | 67 (0.1482) | T T | 392 (0.8849 | 381 (0.8429) |
| | | | Gen | 51 (0.1151 | 67 (0.1482) | T T | 392 (0.8849 | 381 (0.8429) |
| | | MEGA1 | Gen | 156 (0.1124 | 258 (0.147) | T T | 1226 (0.8833 | 1486 (0.8467) |
| | | | Gen | 156 (0.1124 | 258 (0.147) | T T | 1226 (0.8833 | 1486 (0.8467) |
| hCV2494846 | LUZP1 (rs3765407) | MEGA1 | rec | 386 (0.2775 | 491 (0.2801) | T T | 950 (0.683 | 1217 (0.6942) |
| | | LETS | rec | 119 (0.2692 | 108 (0.2389) | T T | 302 (0.6833 | 334 (0.7389) |
| | | LETS | Gen | 119 (0.2692 | 108 (0.2389) | T T | 302 (0.6833 | 334 (0.7389) |
| | | | Gen | 119 (0.2692 | 108 (0.2389) | T T | 302 (0.6833 | 334 (0.7389) |
| | | MEGA1 | Gen | 386 (0.2775 | 491 (0.2801) | T T | 950 (0.683 | 1217 (0.6942) |
| | | | Gen | 386 (0.2775 | 491 (0.2801) | T T | 950 (0.683 | 1217 (0.6942) |
| hCV25752810 | MDN1 (rs4707557) | MEGA1 | add | 67 (0.049 | 59 (0.0336) | A A | 1294 (0.9459 | 1693 (0.9641) |
| | | LETS | add | 22 (0.0498 | 11 (0.0244) | A A | 417 (0.9434 | 439 (0.9734) |
| | | LETS | Gen | 22 (0.0498 | 11 (0.0244) | A A | 417 (0.9434 | 439 (0.9734) |
| | | | Gen | 22 (0.0498 | 11 (0.0244) | A A | 417 (0.9434 | 439 (0.9734) |
| | | MEGA1 | Gen | 67 (0.049 | 59 (0.0336) | A A | 1294 (0.9459 | 1693 (0.9641) |
| | | | Gen | 67 (0.049 | 59 (0.0336) | A A | 1294 (0.9459 | 1693 (0.9641) |
| hCV16170613 | MET (rs2237712) | MEGA1 | add | 113 (0.081 | 108 (0.0615) | A A | 1279 (0.9168 | 1647 (0.9379) |
| | | LETS | add | 37 (0.0837 | 27 (0.0597) | A A | 401 (0.9072 | 425 (0.9403) |
| | | LETS | Gen | 37 (0.0837 | 27 (0.0597) | A A | 401 (0.9072 | 425 (0.9403) |
| | | | Gen | 37 (0.0837 | 27 (0.0597) | A A | 401 (0.9072 | 425 (0.9403) |
| | | MEGA1 | Gen | 113 (0.081 | 108 (0.0615) | A A | 1279 (0.9168 | 1647 (0.9379) |
| | | | Gen | 113 (0.081 | 108 (0.0615) | A A | 1279 (0.9168 | 1647 (0.9379) |
| hCV11726971 | NFIA (rs2065841) | LETS | Gen | 126 (0.2844 | 117 (0.2583) | A A | 294 (0.6637 | 326 (0.7196) |
| | | MEGA1 | Gen | 465 (0.3362 | 526 (0.2999) | A A | 867 (0.6269 | 1153 (0.6574) |
| | | LETS | Gen | 126 (0.2844 | 117 (0.2583) | A A | 294 (0.6637 | 326 (0.7196) |
| | | | Gen | 126 (0.2844 | 117 (0.2583) | A A | 294 (0.6637 | 326 (0.7196) |
| | | MEGA1 | Gen | 465 (0.3362 | 526 (0.2999) | A A | 867 (0.6269 | 1153 (0.6574) |
| | | | Gen | 465 (0.3362 | 526 (0.2999) | A A | 867 (0.6269 | 1153 (0.6574) |
| hCV30747430 | NR1I2 (rs11712211) | MEGA1 | add | 424 (0.3141 | 520 (0.2963) | C C | 850 (0.6296 | 1170 (0.6667) |
| | | LETS | add | 122 (0.2773 | 115 (0.255) | C C | 292 (0.6636 | 325 (0.7206) |
| | | LETS | Gen | 122 (0.2773 | 115 (0.255) | C C | 292 (0.6636 | 325 (0.7206) |
| | | | Gen | 122 (0.2773 | 115 (0.255) | C C | 292 (0.6636 | 325 (0.7206) |
| | | MEGA1 | Gen | 424 (0.3141 | 520 (0.2963) | C C | 850 (0.6296 | 1170 (0.6667) |
| | | | Gen | 424 (0.3141 | 520 (0.2963) | C C | 850 (0.6296 | 1170 (0.6667) |
| hCV263841 | NR1I2 (rs1523127) | LETS | add | 190 (0.4358 | 194 (0.4379) | A A | 158 (0.3624 | 200 (0.4515) |
| | | MEGA1 | add | 685 (0.49 | 851 (0.4843) | A A | 463 (0.3312 | 645 (0.3671) |
| | | LETS | Gen | 190 (0.4358 | 194 (0.4379) | A A | 158 (0.3624 | 200 (0.4515) |
| | | | Gen | 190 (0.4358 | 194 (0.4379) | A A | 158 (0.3624 | 200 (0.4515) |
| | | MEGA1 | Gen | 685 (0.49 | 851 (0.4843) | A A | 463 (0.3312 | 645 (0.3671) |
| | | | Gen | 685 (0.49 | 851 (0.4843) | A A | 463 (0.3312 | 645 (0.3671) |
| hCV4041 | NR3C1 (rs6190) | MEGA1 | dom | 96 (0.0701 | 92 (0.0524) | C C | 1269 (0.927 | 1662 (0.947) |
| | | LETS | dom | 41 (0.0928 | 26 (0.0575) | C C | 400 (0.905 | 425(0.9403) |
| | | LETS | Gen | 41 (0.0928 | 26 (0.0575) | C C | 400 (0.905 | 425 (0.9403) |
| | | | Gen | 41 (0.0928 | 26 (0.0575) | C C | 400 (0.905 | 425 (0.9403) |
| | | MEGA1 | Gen | 96 (0.0701 | 92 (0.0524) | C C | 1269 (0.927 | 1662 (0.947) |
| | | | Gen | 96 (0.0701 | 92 (0.0524) | C C | 1269 (0.927 | 1662 (0.947) |
| hCV2915511 | OBSL1 (rs627530) | LETS | Gen | 40 (0.0905 | 22 (0.0487) | T T | 399 (0.9027 | 429 (0.9491) |
| | | MEGA1 | Gen | 92 (0.0661 | 126 (0.0718) | T T | 1287 (0.9246 | 1624 (0.9254) |
| | | LETS | Gen | 40 (0.0905 | 22 (0.0487) | T T | 399 (0.9027 | 429 (0.9491) |
| | | | Gen | 40 (0.0905 | 22 (0.0487) | T T | 399 (0.9027 | 429 (0.9491) |
| | | MEGA1 | Gen | 92 (0.0661 | 126 (0.0718) | T T | 1287 (0.9246 | 1624 (0.9254) |
| | | | Gen | 92 (0.0661 | 126 (0.0718) | T T | 1287 (0.9246 | 1624 (0.9254) |
| hCV16177220 | ODZ1 (rs2266911) | MEGA1 | add | 212 (0.1524 | 308 (0.1756) | C C | 1054 (0.7577 | 1232 (0.7024) |
| | | LETS | add | 72 (0.1625 | 85 (0.1876) | C C | 336 (0.7585 | 314 (0.6932) |
| | | LETS | Gen | 72 (0.1625 | 85 (0.1876) | C C | 336 (0.7585 | 314 (0.6932) |
| | | | Gen | 72 (0.1625 | 85 (0.1876) | C C | 336 (0.7585 | 314 (0.6932) |
| | | MEGA1 | Gen | 212 (0.1524 | 308 (0.1756) | C C | 1054 (0.7577 | 1232 (0.7024) |
| | | | Gen | 212 (0.1524 | 308 (0.1756) | C C | 1054 (0.7577 | 1232 (0.7024) |
| hCV7584272 | OR1B1 (rs1536929) | LETS | Gen | 187 (0.424 | 166 (0.3673) | G G | 228 (0.517 | 262 (0.5796) |
| | | MEGA1 | dom | 545 (0.3987 | 645 (0.3675) | G G | 739 (0.5406 | 1012 (0.5766) |
| | | LETS | Gen | 187 (0.424 | 166 (0.3673) | G G | 228 (0.517 | 262 (0.5796) |
| | | | Gen | 187 (0.424 | 166 (0.3673) | G G | 228 (0.517 | 262 (0.5796) |
| | | MEGA1 | Gen | 545 (0.3987 | 645 (0.3675) | G G | 739 (0.5406 | 1012 (0.5766) |
| | | | Gen | 545 (0.3987 | 645 (0.3675) | G G | 739 (0.5406 | 1012 (0.5766) |
| hCV9327878 | OR7G1 (rs2217657) | MEGA1 | add | 600 (0.4386 | 733 (0.4174) | C C | 588 (0.4298 | 833 (0.4744) |
| | | LETS | add | 191 (0.4341 | 185 (0.4129) | C C | 188 (0.4273 | 218 (0.4866) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 191 (0.4341) | 185 (0.4129) | C C | 188 (0.4273) | 218 (0.4866) |
| | | | Gen | 191 (0.4341) | 185 (0.4129) | C C | 188 (0.4273) | 218 (0.4866) |
| | | MEGA1 | Gen | 600 (0.4386) | 733 (0.4174) | C C | 588 (0.4298) | 833 (0.4744) |
| | | | Gen | 600 (0.4386) | 733 (0.4174) | C C | 588 (0.4298) | 833 (0.4744) |
| hCV15990789 | OTOG (rs2355466) | MEGA1 | rec | 600 (0.4402) | 857 (0.4889) | G G | 543 (0.3984) | 617 (0.352) |
| | | LETS | rec | 205 (0.4638) | 241 (0.5344) | G G | 162 (0.3665) | 130 (0.2882) |
| | | LETS | Gen | 205 (0.4638) | 241 (0.5344) | G G | 162 (0.3665) | 130 (0.2882) |
| | | | Gen | 205 (0.4638) | 241 (0.5344) | G G | 162 (0.3665) | 130 (0.2882) |
| | | MEGA1 | Gen | 600 (0.4402) | 857 (0.4889) | G G | 543 (0.3984) | 617 (0.352) |
| | | | Gen | 600 (0.4402) | 857 (0.4889) | G G | 543 (0.3984) | 617 (0.352) |
| hCV8361354 | PANX1 (rs1138800) | LETS | Gen | 203 (0.4582) | 223 (0.4923) | C C | 192 (0.4334) | 160 (0.3532) |
| | | MEGA1 | Gen | 636 (0.4582) | 875 (0.4994) | C C | 545 (0.3927) | 650 (0.371) |
| | | LETS | Gen | 203 (0.4582) | 223 (0.4923) | C C | 192 (0.4334) | 160 (0.3532) |
| | | | Gen | 203 (0.4582) | 223 (0.4923) | C C | 192 (0.4334) | 160 (0.3532) |
| | | MEGA1 | Gen | 636 (0.4582) | 875 (0.4994) | C C | 545 (0.3927) | 650 (0.371) |
| | | | Gen | 636 (0.4582) | 875 (0.4994) | C C | 545 (0.3927) | 650 (0.371) |
| hCV30500334 | PHACTR3 (rs6128674) | LETS | add | 195 (0.4402) | 230 (0.5077) | G G | 189 (0.4266) | 149 (0.3289) |
| | | MEGA1 | add | 630 (0.4626) | 823 (0.4689) | G G | 547 (0.4016) | 647 (0.3687) |
| | | LETS | Gen | 195 (0.4402) | 230 (0.5077) | G G | 189 (0.4266) | 149 (0.3289) |
| | | | Gen | 195 (0.4402) | 230 (0.5077) | G G | 189 (0.4266) | 149 (0.3289) |
| | | MEGA1 | Gen | 630 (0.4626) | 823 (0.4689) | G G | 547 (0.4016) | 647 (0.3687) |
| | | | Gen | 630 (0.4626) | 823 (0.4689) | G G | 547 (0.4016) | 647 (0.3687) |
| hCV27474984 | PIK3R1 (rs3756668) | MEGA1 | add | 730 (0.5252) | 821 (0.4689) | G G | 367 (0.264) | 568 (0.3244) |
| | | LETS | add | 223 (0.5045) | 231 (0.5122) | G G | 109 (0.2466) | 133 (0.2949) |
| | | LETS | Gen | 223 (0.5045) | 231 (0.5122) | G G | 109 (0.2466) | 133 (0.2949) |
| | | | Gen | 223 (0.5045) | 231 (0.5122) | G G | 109 (0.2466) | 133 (0.2949) |
| | | MEGA1 | Gen | 730 (0.5252) | 821 (0.4689) | G G | 367 (0.264) | 568 (0.3244) |
| | | | Gen | 730 (0.5252) | 821 (0.4689) | G G | 367 (0.264) | 568 (0.3244) |
| hCV7625318 | PLEKHG4 (rs3868142) | LETS | Gen | 79 (0.1787) | 49 (0.1082) | G G | 361 (0.8167) | 400 (0.883) |
| | | MEGA1 | Gen | 224 (0.1614) | 236 (0.1346) | G G | 1151 (0.8293) | 1501 (0.8562) |
| | | LETS | Gen | 79 (0.1787) | 49 (0.1082) | G G | 361 (0.8167) | 400 (0.883) |
| | | | Gen | 79 (0.1787) | 49 (0.1082) | G G | 361 (0.8167) | 400 (0.883) |
| | | MEGA1 | Gen | 224 (0.1614) | 236 (0.1346) | G G | 1151 (0.8293) | 1501 (0.8562) |
| | | | Gen | 224 (0.1614) | 236 (0.1346) | G G | 1151 (0.8293) | 1501 (0.8562) |
| hCV8598986 | POLR1A (rs4832233) | LETS | rec | 176 (0.3982) | 198 (0.4381) | C C | 238 (0.5385) | 209 (0.4624) |
| | | MEGA1 | rec | 507 (0.3655) | 696 (0.3984) | C C | 761 (0.5487) | 897 (0.5135) |
| | | LETS | Gen | 176 (0.3982) | 198 (0.4381) | C C | 238 (0.5385) | 209 (0.4624) |
| | | | Gen | 176 (0.3982) | 198 (0.4381) | C C | 238 (0.5385) | 209 (0.4624) |
| | | MEGA1 | Gen | 507 (0.3655) | 696 (0.3984) | C C | 761 (0.5487) | 897 (0.5135) |
| | | | Gen | 507 (0.3655) | 696 (0.3984) | C C | 761 (0.5487) | 897 (0.5135) |
| hCV926518 | PPP2R5C (rs7467981) | LETS | Gen | 94 (0.2127) | 71 (0.1571) | T T | 344 (0.7783) | 376 (0.8319) |
| | | MEGA1 | Gen | 269 (0.1971) | 297 (0.1692) | T T | 1080 (0.7912) | 1432 (0.816) |
| | | LETS | Gen | 94 (0.2127) | 71 (0.1571) | T T | 344 (0.7783) | 376 (0.8319) |
| | | | Gen | 94 (0.2127) | 71 (0.1571) | T T | 344 (0.7783) | 376 (0.8319) |
| | | MEGA1 | Gen | 269 (0.1971) | 297 (0.1692) | T T | 1080 (0.7912) | 1432 (0.816) |
| | | | Gen | 269 (0.1971) | 297 (0.1692) | T T | 1080 (0.7912) | 1432 (0.816) |
| hCV1841975 | PROC (rs1799810) | LETS | Gen | 215 (0.4864) | 224 (0.4956) | A A | 127 (0.2873) | 147 (0.3252) |
| | | MEGA1 | Gen | 655 (0.4719) | 864 (0.4946) | A A | 410 (0.2954) | 554 (0.3171) |
| | | LETS | Gen | 215 (0.4864) | 224 (0.4956) | A A | 127 (0.2873) | 147 (0.3252) |
| | | | Gen | 215 (0.4864) | 224 (0.4956) | A A | 127 (0.2873) | 147 (0.3252) |
| | | MEGA1 | Gen | 655 (0.4719) | 864 (0.4946) | A A | 410 (0.2954) | 554 (0.3171) |
| | | | Gen | 655 (0.4719) | 864 (0.4946) | A A | 410 (0.2954) | 554 (0.3171) |
| hCV8957432 | RAC2 (rs6572) | MEGA1 | rec | 676 (0.4867) | 862 (0.4917) | G G | 405 (0.2916) | 557 (0.3177) |
| | | LETS | rec | 225 (0.5102) | 249 (0.5509) | G G | 117 (0.2653) | 126 (0.2788) |
| | | LETS | Gen | 225 (0.5102) | 249 (0.5509) | G G | 117 (0.2653) | 126 (0.2788) |
| | | | Gen | 225 (0.5102) | 249 (0.5509) | G G | 117 (0.2653) | 126 (0.2788) |
| | | MEGA1 | Gen | 676 (0.4867) | 862 (0.4917) | G G | 405 (0.2916) | 557 (0.3177) |
| | | | Gen | 676 (0.4867) | 862 (0.4917) | G G | 405 (0.2916) | 557 (0.3177) |
| hCV29271569 | RDH13 (rs1626971) | LETS | add | 116 (0.2624) | 143 (0.3157) | T T | 317 (0.7172) | 293 (0.6468) |
| | | MEGA1 | add | 374 (0.2695) | 535 (0.305) | T T | 971 (0.6996) | 1159 (0.6608) |
| | | LETS | Gen | 116 (0.2624) | 143 (0.3157) | T T | 317 (0.7172) | 293 (0.6468) |
| | | | Gen | 116 (0.2624) | 143 (0.3157) | T T | 317 (0.7172) | 293 (0.6468) |
| | | MEGA1 | Gen | 374 (0.2695) | 535 (0.305) | T T | 971 (0.6996) | 1159 (0.6608) |
| | | | Gen | 374 (0.2695) | 535 (0.305) | T T | 971 (0.6996) | 1159 (0.6608) |
| hCV8703249 | RDH13 (rs1654444) | LETS | add | 117 (0.2647) | 138 (0.3046) | G G | 315 (0.7127) | 298 (0.6578) |
| | | MEGA1 | add | 376 (0.2711) | 532 (0.303) | G G | 970 (0.6994) | 1160 (0.6606) |
| | | LETS | Gen | 117 (0.2647) | 138 (0.3046) | G G | 315 (0.7127) | 298 (0.6578) |
| | | | Gen | 117 (0.2647) | 38 (0.3046) | G G | 315 (0.7127) | 298 (0.6578) |
| | | MEGA1 | Gen | 376 (0.2711) | 532 (0.303) | G G | 970 (0.6994) | 1160 (0.6606) |
| | | | Gen | 376 (0.2711) | 532 (0.303) | G G | 970 (0.6994) | 1160 (0.6606) |
| hCV8717752 | RDH13 (rs1671217) | LETS | add | 118 (0.267) | 137 (0.3031) | G G | 317 (0.7172) | 298 (0.6593) |
| | | MEGA1 | rec | 369 (0.2662) | 518 (0.2955) | G G | 981 (0.7078) | 1183 (0.6748) |
| | | LETS | Gen | 118 (0.267) | 137 (0.3031) | G G | 317 (0.7172) | 298 (0.6593) |
| | | | Gen | 118 (0.267) | 137 (0.3031) | G G | 317 (0.7172) | 298 (0.6593) |
| | | MEGA1 | Gen | 369 (0.2662) | 518 (0.2955) | G G | 981 (0.7078) | 1183 (0.6748) |
| | | | Gen | 369 (0.2662) | 518 (0.2955) | G G | 981 (0.7078) | 1183 (0.6748) |
| hCV11975296 | SELP (rs6131) | MEGA1 | add | 463 (0.3329) | 504 (0.2882) | C C | 865 (0.6219) | 1179 (0.6741) |
| | | LETS | add | 142 (0.3213) | 121 (0.2671) | C C | 273 (0.6176) | 312 (0.6887) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 142 (0.3213 | 121 (0.2671) | C C | 273 (0.6176 | 312 (0.6887) |
| | | | Gen | 142 (0.3213 | 121 (0.2671) | C C | 273 (0.6176 | 312 (0.6887) |
| | | MEGA1 | Gen | 463 (0.3329 | 504 (0.2882) | C C | 865 (0.6219 | 1179 (0.6741) |
| | | | Gen | 463 (0.3329 | 504 (0.2882) | C C | 865 (0.6219 | 1179 (0.6741) |
| hCV9596963 | SERPINA5 (rs6115) | LETS | dom | 225 (0.5172 | 224 (0.4989) | A A | 172 (0.3954 | 165 (0.3675) |
| | | MEGA1 | dom | 632 (0.456 | 775 (0.4434) | A A | 617 (0.4452 | 759 (0.4342) |
| | | LETS | Gen | 225 (0.5172 | 224 (0.4989) | A A | 172 (0.3954 | 165 (0.3675) |
| | | | Gen | 225 (0.5172 | 224 (0.4989) | A A | 172 (0.3954 | 165 (0.3675) |
| | | MEGA1 | Gen | 632 (0.456 | 775 (0.4434) | A A | 617 (0.4452 | 759 (0.4342) |
| | | | Gen | 632 (0.456 | 775 (0.4434) | A A | 617 (0.4452 | 759 (0.4342) |
| hCV16180170 | SERPINC1 (rs2227589) | MEGA1 | add | 259 (0.1863 | 283 (0.1613) | C C | 1109 (0.7978 | 1457 (0.8302) |
| | | LETS | add | 93 (0.2099 | 70 (0.1549) | C C | 344 (0.7765 | 378 (0.8363) |
| | | LETS | Gen | 93 (0.2099 | 70 (0.1549) | C C | 344 (0.7765 | 378 (0.8363) |
| | | | Gen | 93 (0.2099 | 70 (0.1549) | C C | 344 (0.7765 | 378 (0.8363) |
| | | MEGA1 | Gen | 259 (0.1863 | 283 (0.1613) | C C | 1109 (0.7978 | 1457 (0.8302) |
| | | | Gen | 259 (0.1863 | 283 (0.1613) | C C | 1109 (0.7978 | 1457 (0.8302) |
| hCV1650632 | SERPINC1 (rs5878) | MEGA1 | Gen | 615 (0.4593 | 792 (0.4528) | T T | 533 (0.3981 | 760 (0.4345) |
| | | LETS | Gen | 205 (0.468 | 174 (0.391) | T T | 184 (0.4201 | 215 (0.4831) |
| | | LETS | Gen | 205 (0.468 | 174 (0.391) | T T | 184 (0.4201 | 215 (0.4831) |
| | | | Gen | 205 (0.468 | 174 (0.391) | T T | 184 (0.4201 | 215 (0.4831) |
| | | MEGA1 | Gen | 615 (0.4593 | 792 (0.4528) | T T | 533 (0.3981 | 760 (0.4345) |
| | | | Gen | 615 (0.4593 | 792 (0.4528) | T T | 533 (0.3981 | 760 (0.4345) |
| hCV3216426 | SFRS2IP (rs7315731) | LETS | dom | 218 (0.4955 | 211 (0.472) | A A | 135 (0.3068 | 117 (0.2617) |
| | | MEGA1 | dom | 707 (0.5061 | 843 (0.4798) | A A | 389 (0.2785 | 473 (0.2692) |
| | | LETS | Gen | 218 (0.4955 | 211 (0.472) | A A | 135 (0.3068 | 117 (0.2617) |
| | | | Gen | 218 (0.4955 | 211 (0.472) | A A | 135 (0.3068 | 117 (0.2617) |
| | | MEGA1 | Gen | 707 (0.5061 | 843 (0.4798) | A A | 389 (0.2785 | 473 (0.2692) |
| | | | Gen | 707 (0.5061 | 843 (0.4798) | A A | 389 (0.2785 | 473 (0.2692) |
| hCV25602230 | SIRT6 (rs7246235) | MEGA1 | add | 46 (0.0332 | 36 (0.0205) | T T | 1336 (0.9639 | 1716 (0.9789) |
| | | LETS | add | 15 (0.0339 | 5 (0.0111) | T T | 425 (0.9615 | 447 (0.9889) |
| | | LETS | Gen | 15 (0.0339 | 5 (0.0111) | T T | 425 (0.9615 | 447 (0.9889) |
| | | | Gen | 15 (0.0339 | 5 (0.0111) | T T | 425 (0.9615 | 447 (0.9889) |
| | | MEGA1 | Gen | 46 (0.0332 | 36 (0.0205) | T T | 1336 (0.9639 | 1716 (0.9789) |
| | | | Gen | 46 (0.0332 | 36 (0.0205) | T T | 1336 (0.9639 | 1716 (0.9789) |
| hCV2086329 | SPARC (rs4958487) | MEGA1 | rec | 631 (0.4556 | 888 (0.5063) | A A | 456 (0.3292 | 570 (0.325) |
| | | LETS | rec | 205 (0.4628 | 227 (0.5011) | A A | 134 (0.3025 | 150 (0.3311) |
| | | LETS | Gen | 205 (0.4628 | 227 (0.5011) | A A | 134 (0.3025 | 150 (0.3311) |
| | | | Gen | 205 (0.4628 | 227 (0.5011) | A A | 134 (0.3025 | 150 (0.3311) |
| | | MEGA1 | Gen | 631 (0.4556 | 888 (0.5063) | A A | 456 (0.3292 | 570 (0.325) |
| | | | Gen | 631 (0.4556 | 888 (0.5063) | A A | 456 (0.3292 | 570 (0.325) |
| hCV11466393 | TACR1 (rs881) | LETS | add | 111 (0.2534 | 139 (0.3138) | C C | 317 (0.7237 | 287 (0.6479) |
| | | MEGA1 | add | 368 (0.264 | 508 (0.2898) | C C | 994 (0.7131 | 1193 (0.6805) |
| | | LETS | Gen | 111 (0.2534 | 139 (0.3138) | C C | 317 (0.7237 | 287 (0.6479) |
| | | | Gen | 111 (0.2534 | 139 (0.3138) | C C | 317 (0.7237 | 287 (0.6479) |
| | | MEGA1 | Gen | 368 (0.264 | 508 (0.2898) | C C | 994 (0.7131 | 1193 (0.6805) |
| | | | Gen | 368 (0.264 | 508 (0.2898) | C C | 994 (0.7131 | 1193 (0.6805) |
| hCV3216649 | TAF1B (rs1054565) | LETS | dom | 194 (0.4399 | 174 (0.3858) | G G | 197 (0.4467 | 230 (0.51) |
| | | MEGA1 | dom | 623 (0.4479 | 732 (0.4178) | G G | 608 (0.4371 | 829 (0.4732) |
| | | LETS | Gen | 194 (0.4399 | 174 (0.3858) | G G | 197 (0.4467 | 230 (0.51) |
| | | | Gen | 194 (0.4399 | 174 (0.3858) | G G | 197 (0.4467 | 230 (0.51) |
| | | MEGA1 | Gen | 623 (0.4479 | 732 (0.4178) | G G | 608 (0.4371 | 829 (0.4732) |
| | | | Gen | 623 (0.4479 | 732 (0.4178) | G G | 608 (0.4371 | 829 (0.4732) |
| hCV470708 | THBS2 (rs10945406) | LETS | add | 193 (0.4367 | 180 (0.3991) | G G | 199 (0.4502 | 233 (0.5166) |
| | | MEGA1 | Gen | 588 (0.4215 | 747 (0.4264) | G G | 655 (0.4695 | 852 (0.4863) |
| | | LETS | Gen | 193 (0.4367 | 180 (0.3991) | G G | 199 (0.4502 | 233 (0.5166) |
| | | | Gen | 193 (0.4367 | 180 (0.3991) | G G | 199 (0.4502 | 233 (0.5166) |
| | | MEGA1 | Gen | 588 (0.4215 | 747 (0.4264) | G G | 655 (0.4695 | 852 (0.4863) |
| | | | Gen | 588 (0.4215 | 747 (0.4264) | G G | 655 (0.4695 | 852 (0.4863) |
| hCV3272537 | TIAM1 (rs497689) | LETS | dom | 214 (0.4853 | 207 (0.458) | T T | 127 (0.288 | 155 (0.3429) |
| | | MEGA1 | dom | 702 (0.5076 | 802 (0.4596) | T T | 404 (0.2921 | 596 (0.3415) |
| | | LETS | Gen | 214 (0.4853 | 207 (0.458) | T T | 127 (0.288 | 155 (0.3429) |
| | | | Gen | 214 (0.4853 | 207 (0.458) | T T | 127 (0.288 | 155 (0.3429) |
| | | MEGA1 | Gen | 702 (0.5076 | 802 (0.4596) | T T | 404 (0.2921 | 596 (0.3415) |
| | | | Gen | 702 (0.5076 | 802 (0.4596) | T T | 404 (0.2921 | 596 (0.3415) |
| hCV27833944 | TNFSF4 (rs6702339) | LETS | add | 89 (0.2014 | 71 (0.1578) | T T | 348 (0.7873 | 376 (0.8356) |
| | | MEGA1 | add | 256 (0.1847 | 284 (0.1619) | T T | 1105 (0.7973 | 1454 (0.829) |
| | | LETS | Gen | 89 (0.2014 | 71 (0.1578) | T T | 348 (0.7873 | 376 (0.8356) |
| | | | Gen | 89 (0.2014 | 71 (0.1578) | T T | 348 (0.7873 | 376 (0.8356) |
| | | MEGA1 | Gen | 256 (0.1847 | 284 (0.1619) | T T | 1105 (0.7973 | 1454 (0.829) |
| | | | Gen | 256 (0.1847 | 284 (0.1619) | T T | 1105 (0.7973 | 1454 (0.829) |
| hCV1723643 | UMODL1 (rs220130) | LETS | rec | 144 (0.3265 | 173 (0.3836) | A A | 278 (0.6304 | 256 (0.5676) |
| | | MEGA1 | rec | 431 (0.3114 | 597 (0.3408) | A A | 894 (0.646 | 1060 (0.605) |
| | | LETS | Gen | 144 (0.3265 | 173 (0.3836) | A A | 278 (0.6304 | 256 (0.5676) |
| | | | Gen | 144 (0.3265 | 173 (0.3836) | A A | 278 (0.6304 | 256 (0.5676) |
| | | MEGA1 | Gen | 431 (0.3114 | 597 (0.3408) | A A | 894 (0.646 | 1060 (0.605) |
| | | | Gen | 431 (0.3114 | 597 (0.3408) | A A | 894 (0.646 | 1060 (0.605) |
| hCV7581501 | USP45 (rs1323717) | LETS | Gen | 99 (0.2235 | 73 (0.1611) | G G | 335 (0.7562 | 373 (0.8234) |
| | | MEGA1 | Gen | 287 (0.2062 | 367 (0.209) | G G | 1079 (0.7751 | 1372 (0.7813) |

TABLE 20-continued

Unadjusted additive and genotypic association of 149 SNPs with DVT in LETS (p <= 0.1) and MEGA-1 (p <= 0.05)

| | | | | | | | | |
|---|---|---|---|---|---|---|---|---|
| | | LETS | Gen | 99 (0.2235) | 73 (0.1611) | G G | 335 (0.7562) | 373 (0.8234) |
| | | | Gen | 99 (0.2235) | 73 (0.1611) | G G | 335 (0.7562) | 373 (0.8234) |
| | | MEGA1 | Gen | 287 (0.2062) | 367 (0.209) | G G | 1079 (0.7751) | 1372 (0.7813) |
| | | | Gen | 287 (0.2062) | 367 (0.209) | G G | 1079 (0.7751) | 1372 (0.7813) |
| hCV15949414 | XYLB (rs2234628) | MEGA1 | rec | 89 (0.0653) | 172 (0.0981) | G G | 1269 (0.931) | 1581 (0.9014) |
| | | LETS | rec | 31 (0.0703) | 51 (0.1138) | G G | 409 (0.9274) | 397 (0.8862) |
| | | LETS | Gen | 31 (0.0703) | 51 (0.1138) | G G | 409 (0.9274) | 397 (0.8862) |
| | | | Gen | 31 (0.0703) | 51 (0.1138) | G G | 409 (0.9274) | 397 (0.8862) |
| | | MEGA1 | Gen | 89 (0.0653) | 172 (0.0981) | G G | 1269 (0.931) | 1581 (0.9014) |
| | | | Gen | 89 (0.0653) | 172 (0.0981) | G G | 1269 (0.931) | 1581 (0.9014) |
| hCV356522 | ZBTB41 (rs10732295) | LETS | dom | 81 (0.1828) | 63 (0.1391) | C C | 356 (0.8036) | 386 (0.8521) |
| | | MEGA1 | dom | 274 (0.1975) | 289 (0.1646) | C C | 1091 (0.7866) | 1448 (0.8246) |
| | | LETS | Gen | 81 (0.1828) | 63 (0.1391) | C C | 356 (0.8036) | 386 (0.8521) |
| | | | Gen | 81 (0.1828) | 63 (0.1391) | C C | 356 (0.8036) | 386 (0.8521) |
| | | MEGA1 | Gen | 274 (0.1975) | 289 (0.1646) | C C | 1091 (0.7866) | 1448 (0.8246) |
| | | | Gen | 274 (0.1975) | 289 (0.1646) | C C | 1091 (0.7866) | 1448 (0.8246) |
| hCV25596789 | JF544 (rs651013) | LETS | add | 29 (0.0658) | 13 (0.0288) | C C | 410 (0.9297) | 438 (0.9712) |
| | | MEGA1 | add | 76 (0.0544) | 64 (0.0364) | C C | 1320 (0.9449) | 1693 (0.9636) |
| | | LETS | Gen | 29 (0.0658) | 13 (0.0288) | C C | 410 (0.9297) | 438 (0.9712) |
| | | | Gen | 29 (0.0658) | 13 (0.0288) | C C | 410 (0.9297) | 438 (0.9712) |
| | | MEGA1 | Gen | 76 (0.0544) | 64 (0.0364) | C C | 1320 (0.9449) | 1693 (0.9636) |
| | | | Gen | 76 (0.0544) | 64 (0.0364) | C C | 1320 (0.9449) | 1693 (0.9636) |
| hCV25951992 | ZWINT (rs11005328) | MEGA1 | dom | 46 (0.033) | 30 (0.0171) | C C | 1345 (0.9635) | 1725 (0.9823) |
| | | LETS | dom | 22 (0.0499) | 9 (0.0199) | C C | 419 (0.9501) | 442 (0.9779) |
| | | LETS | Gen | 22 (0.0499) | 9 (0.0199) | C C | 419 (0.9501) | 442 (0.9779) |
| | | | Gen | 22 (0.0499) | 9 (0.0199) | C C | 419 (0.9501) | 442 (0.9779) |
| | | MEGA1 | Gen | 46 (0.033) | 30 (0.0171) | C C | 1345 (0.9635) | 1725 (0.9823) |
| | | | Gen | 46 (0.033) | 30 (0.0171) | C C | 1345 (0.9635) | 1725 (0.9823) |

TABLE 21

Unadjusted association of 92 SNPs with DVT in LETS (p <= 0.05) that have not been tested in MEGA-1

| marker | annotation | P-value | parameter | Model | OR (95% CI) | Risk Allele | Non Risk Allele | Allele (CONTROL frq | Genot |
|---|---|---|---|---|---|---|---|---|---|
| hCV10008773 | ANK1 (rs750625) | 0.04327 | CC_vs_CT + TT | rec | 1.31 (1.00828819022294-1.71) | C | T | T (0.2732) | T T |
| hCV11342584 | (rs6696864) | 0.03793 | AT_vs_TT | Gen | 1.36 (1.02-1.81) | A | T | A (0.3825) | A A |
| hCV11503431 | FGG (rs2066861) | 4.6E-05 | TT_vs_CC | Gen | 3.01 (1.77-5.11) | T | C | T (0.2622) | T T |
| | | 9.5E-05 | TT_vs_TC + CC | rec | 2.78 (1.66280836758397-4.64) | T | C | T (0.2622) | T T |
| | | 0.00035 | T_vs_C | add | 1.46 (1.18656074071138-1.8) | T | C | T (0.2622) | T T |
| | | 0.01879 | TT+ TC_vs_CC | dom | 1.37 (1.05370601437504-1.78) | T | C | T (0.2622) | T T |
| hCV11559107 | UNC5C (rs2626053) | 0.00338 | AG_vs_GG | Gen | 1.54 (1.15-2.06) | A | G | A (0.1837) | A A |
| | | 0.00999 | AA + AG_vs_GG | dom | 1.44 (1.09-1.89) | A | G | A (0.1837) | A A |
| hCV11853483 | FGG (rs12644950) | 5.5E-05 | AA_vs_GG | Gen | 2.98 (1.753373778484-5.07) | A | G | A (0.2605) | A A |
| | | 0.00014 | AA_vs_AG + GG | rec | 2.72 (1.62669691396322-4.55) | A | G | A (0.2605) | A A |
| | | 0.00028 | A_vs_G | add | 1.47 (1.19493352233274-1.81) | A | G | A (0.2605) | A A |
| | | 0.01296 | AA + AG_vs_GG | dom | 1.4 (1.07313147656834-1.82) | A | G | A (0.2605) | A A |
| hCV11853496 | FGG (rs7654093) | 6.8E-05 | TT_vs_AA | Gen | 2.89 (1.71409632424687-4.87) | T | A | T (0.2622) | T T |
| | | 0.00016 | TT_vs_TA + AA | rec | 2.65 (1.59864873064354-4.4) | T | A | T (0.2622) | T T |
| | | 0.00036 | T_vs_A | add | 1.46 (1.18479576515509-1.79) | T | A | T (0.2622) | T T |
| | | 0.01572 | TT + TA_vs_AA | dom | 1.38 (1.06306565580364-1.8) | T | A | T (0.2622) | T T |
| hCV11942562 | ACE (rs4343) | 0.04168 | AA + AG_vs_GG | dom | 1.39 (1.01235519054438-1.9) | A | G | G (0.5088) | G G |
| hCV11962159 | (rs2000745) | 0.03396 | TT_vs_CC | Gen | 9.4 (1.1848774278982-74.54) | T | C | T (0.082) | T T |
| | | 0.03409 | TT_vs_TC + CC | rec | 9.37 (1.1829594063581-74.3) | T | C | T (0.082) | T T |
| hCV11975250 | F5 (rs6025) | 6.6E-12 | TT + TC_vs_CC | dom | 7.67 (4.29-13.71) | T | C | T (0.0155) | T T |
| | | 8.6E-12 | AA + AG_vs_GG | dom | 7.17 (4.07-12.62) | A | G | T (0.0155) | T T |
| | | 1.6E-11 | T_vs_C | add | 7.19 (4.05-12.77) | T | C | T (0.0155) | T T |
| | | 1.9E-11 | A_vs_G | add | 6.74 (3.86-11.77) | A | G | T (0.0155) | T T |

TABLE 21-continued

Unadjusted association of 92 SNPs with DVT in LETS (p <= 0.05) that have not been tested in MEGA-1

| | | | | | | | | | |
|---|---|---|---|---|---|---|---|---|---|
| | | 8.2E−11 | TC_vs_CC | Gen | 6.96 (3.88-12.5) | T | C | T (0.0155) | T T |
| | | 1.1E−10 | AG_vs_GG | Gen | 6.51 (3.68-11.5) | A | G | T (0.0155) | T T |
| hCV11975651 | SERPINC1 (rs677) | 0.04802 | GG_vs_GC + CC | rec | 0.27 (0.0759132784778174-0.99) | G | C | G (0.1098) | G G |
| hCV11975658 | (rs1951626) | 0.03516 | AG_vs_GG | Gen | 1.35 (1.02-1.78) | A | G | A (0.3) | A A |
| | | 0.03523 | AA + AG_vs_GG | dom | 1.33 (1.02-1.73) | A | G | A (0.3) | A A |
| hCV1198623 | KRT8 (rs2638504) | 0.00813 | GG_vs_CC | Gen | 1.76 (1.16-2.68) | G | C | C (0.3595) | C C |
| | | 0.01655 | G_vs_C | add | 1.26 (1.04-1.52) | G | C | C (0.3595) | C C |
| | | 0.03471 | GC_vs_CC | Gen | 1.58 (1.03-2.42) | G | C | C (0.3595) | C C |
| hCV12098639 | RIC8A (rs3216) | 0.01529 | CG_vs_GG | Gen | 2.72 (1.21159130646804-6.1) | C | G | G (0.1887) | G G |
| | | 0.01785 | CC + CG_vs_GG | dom | 2.57 (1.17720092620202-5.63) | C | G | G (0.1887) | G G |
| | | 0.02169 | CC_vs_GG | Gen | 2.51 (1.14432781614601-5.52) | C | G | G (0.1887) | G G |
| hCV1376206 | NLRP2 (rs10412915) | 0.04509 | CT_vs_TT | Gen | 1.33 (1.00618961419825-1.75) | C | T | C (0.2777) | C C |
| hCV1376246 | NLRP2 (rs12768) | 0.04168 | AA_vs_AC + CC | rec | 1.37 (1.01192726345419-1.85) | A | C | C (0.5121) | C C |
| hCV1420741 | (rs444124) | 0.01513 | CC_vs_GG | Gen | 1.8 (1.11978427423371-2.88) | C | G | C (0.2739) | C C |
| | | 0.02069 | CC_vs_CG + GG | rec | 1.71 (1.0857630416532-2.7) | C | G | C (0.2739) | C C |
| | | 0.03078 | C_vs_G | add | 1.25 (1.02065803823507-1.52) | C | G | C (0.2739) | C C |
| hCV1455329 | (rs16018) | 0.0104 | GA_vs_AA | Gen | 1.44 (1.08866000283568-1.89) | G | A | G (0.2942) | G G |
| | | 0.03679 | GG + GA_vs_AA | dom | 1.32 (1.01735211455419-1.72) | G | A | G (0.2942) | G G |
| hCV15864094 | DARS2 (rs2068871) | 0.02341 | GG + GA_vs_AA | dom | 1.54 (1.05976036974367-2.23) | G | A | G (0.0668) | G G |
| | | 0.02708 | G_vs_A | add | 1.46 (1.04392416525319-2.05) | G | A | G (0.0668) | G G |
| | | 0.03009 | GA_vs_AA | Gen | 1.53 (1.04171464630086-2.24) | G | A | G (0.0668) | G G |
| hCV15947925 | TNFRSF14 (rs2234163) | 0.0278 | TT + TC_vs_CC | dom | 4.17 (1.16858968730866-14.86) | T | C | T (0.0033) | T T |
| | | 0.02805 | T_vs_C | add | 4.02 (1.16184582447559-13.94) | T | C | T (0.0033) | T T |
| | | 0.04069 | TC_vs_CC | Gen | 3.82 (1.05841588676064-13.79) | T | C | T (0.0033) | T T |
| hCV15953063 | (rs2953331) | 0.01795 | AA + AG_vs_GG | dom | 1.38 (1.05693553923995-1.8) | A | G | A (0.3308) | A A |
| | | 0.02267 | AG_vs_GG | Gen | 1.39 (1.0470340893344-1.84) | A | G | A (0.3308) | A A |
| | | 0.04192 | A_vs_G | add | 1.22 (1.00735955225147-1.48) | A | G | A (0.3308) | A A |
| hCV15956054 | SERPINC1 (rs2227594) | 0.04188 | TC_vs_CC | Gen | 1.42 (1.01288299286844-1.98) | T | C | T (0.1087) | T T |
| hCV15956055 | SERPINC1 (rs2227593) | 0.04439 | TG_vs_GG | Gen | 1.41 (1.01-1.98) | T | G | T (0.1084) | T T |
| hCV15956059 | SERPINC1 (rs2227592) | 0.02277 | T_vs_C | add | 1.44 (1.05163705309124-1.96) | T | C | T (0.0865) | T T |
| | | 0.02759 | TT + TC_vs_CC | dom | 1.46 (1.04229099896258-2.03) | T | C | T (0.0865) | T T |
| | | 0.04197 | TC_vs_CC | Gen | 1.42 (1.01292745754821-2) | T | C | T (0.0865) | T T |
| hCV15977624 | RDH13 (rs2305543) | 0.04128 | AA_vs_AG + GG | rec | 1.73 (1.02-2.93) | A | G | A (0.2461) | A A |
| hCV16000557 | LOC390988 (rs2377041) | 0.00253 | TT_vs_CC | Gen | 1.81 (1.23100609226457-2.65) | T | C | T (0.4302) | T T |
| | | 0.00283 | T_vs_C | add | 1.34 (1.10500557605069-1.62) | T | C | T (0.4302) | T T |
| | | 0.0076 | TT_vs_TC + CC | rec | 1.56 (1.13-2.16) | T | C | T (0.4302) | T T |
| | | 0.02713 | TT + TC_vs_CC | dom | 1.39 (1.03825477779782-1.87) | T | C | T (0.4302) | T T |
| hCV1605386 | PKNOX1 (rs234736) | 0.00313 | GA_vs_AA | Gen | 2.14 (1.29136514770623-3.54) | G | A | A (0.311) | A A |
| | | 0.0126 | GG + GA_vs_AA | dom | 1.85 (1.14079578150342-3) | G | A | A (0.311) | A A |
| hCV16135173 | (rs2146372) | 0.02501 | CC + CG_vs_GG | dom | 1.47 (1.04923410893692-2.05) | C | G | C (0.0878) | C C |
| | | 0.02618 | CG_vs_GG | Gen | 1.48 (1.04735910608363-2.08) | C | G | C (0.0878) | C C |
| | | 0.03375 | C_vs_G | add | 1.39 (1.02581539781861-1.89) | C | G | C (0.0878) | C C |

TABLE 21-continued

Unadjusted association of 92 SNPs with DVT in LETS (p <= 0.05) that have not been tested in MEGA-1

| | | | | | | | | | |
|---|---|---|---|---|---|---|---|---|---|
| hCV18996 | ANKS1B (rs638177) | 0.04369 | TT_vs_CC | Gen | 1.99 (1.01964405681199-3.88) | T | C | C (0.2434 | C C |
| | | 0.04845 | TT + TC_vs_CC | dom | 1.94 (1.00452097379001-3.76) | T | C | C (0.2434 | C C |
| hCV1900162 | PTPN22 (rs11102685) | 0.01558 | TC_vs_CC | Gen | 0.07 (0.01-0.61) | T | C | C (0.1221 | C C |
| | | 0.03279 | TT + TC_vs_CC | dom | 0.1 (0.01-0.83) | T | C | C (0.1221 | C C |
| | | 0.04005 | TT_vs_CC | Gen | 0.11 (0.01-0.91) | T | C | C (0.1221 | C C |
| hCV1937195 | CCDC8 (rs34186470) | 0.01441 | G_vs_A | add | 1.43 (1.07317264786011-1.89) | G | A | A (0.1358 | A A |
| | | 0.01494 | GG_vs_GA + AA | rec | 1.5 (1.0815208090679-2.07) | G | A | A (0.1358 | A A |
| hCV1974936 | (rs4648648) | 0.01009 | CC_vs_CT + TT | rec | 1.48 (1.09857002225632-2) | C | T | T (0.5088 | T T |
| | | 0.0232 | C_vs_T | add | 1.25 (1.03042165019262-1.5) | C | T | T (0.5088 | T T |
| | | 0.02746 | CC_vs_TT | Gen | 1.53 (1.04851513911575-2.24) | C | T | T (0.5088 | T T |
| hCV1974951 | TNFRSF14 (rs2234161) | 0.01935 | GG_vs_GA + AA | rec | 1.42 (1.05893671316625-1.92) | G | A | A (0.4945 | A A |
| hCV1974967 | (rs2147905) | 0.01956 | AA_vs_AG + GG | rec | 1.43 (1.0586829787411-1.92) | A | G | G (0.5066 | G G |
| | | 0.0449 | A_vs_G | add | 1.21 (1.0043557390248-1.46) | A | G | G (0.5066 | G G |
| hCV22272816 | GLOD4 (rs2249542) | 0.0413 | GG_vs_GA + AA | rec | 1.32 (1.01088520538692-1.71) | G | A | A (0.2969 | A A |
| | | 0.04909 | G_vs_A | add | 1.23 (1.00081269894164-1.5) | G | A | A (0.2969 | A A |
| hCV25611352 | RAF1 (rs3729926) | 0.00089 | TC_vs_CC | Gen | 3.3 (1.63135248280203-6.66) | T | C | C (0.2113 | C C |
| | | 0.00364 | TT + TC_vs_CC | dom | 2.73 (1.38738506813726-5.37) | T | C | C (0.2113 | C C |
| | | 0.00907 | TT_vs_CC | Gen | 2.48 (1.25420196929067-4.92) | T | C | C (0.2113 | C C |
| hCV25649928 | DEGS1 ( ) | 0.00685 | G_vs_A | add | 2.58 (1.3-5.12) | G | A | G (0.0135 | G G |
| | | | GA_vs_AA | Gen | 2.58 (1.3-5.12) | G | A | G (0.0135 | G G |
| | | | GG + GA_vs_AA | dom | 2.58 (1.3-5.12) | G | A | G (0.0135 | G G |
| hCV25767872 | KIAA1546 (rs6843141) | 0.04821 | A_vs_G | add | 2.1 (1.00587211662689-4.38) | A | G | A (0.0121 | A A |
| | | | AA + AG_vs_GG | dom | 2.1 (1.00587211662689-4.38) | A | G | A (0.0121 | A A |
| | | | AG_vs_GG | Gen | 2.1 (1.00587211662689-4.38) | A | G | A (0.0121 | A A |
| hCV2605707 | CDK6 (rs42041) | 0.04581 | CC_vs_GG | Gen | 1.8 (1.01098902434728-3.2) | C | G | G (0.2655 | G G |
| hCV26338456 | SDCCAG8 (rs10927011) | 0.04489 | GG + GA_vs_AA | dom | 1.38 (1.00743666566744-1.9) | G | A | A (0.5 | A A |
| hCV26338482 | SDCCAG8 (rs10803143) | 0.02994 | TT_vs_CC | Gen | 1.74 (1.05555612599845-2.88) | T | C | T (0.2711 | T T |
| | | 0.04165 | TT_vs_TC + CC | rec | 1.66 (1.0193099474508-2.7) | T | C | T (0.2711 | T T |
| hCV26887434 | RGS7 (rs12723522) | 0.04698 | CC_vs_AA | Gen | 1.47 (1.0051583138784-2.15) | C | A | C (0.4248 | C C |
| hCV26895255 | GP6 (rs11669150) | 0.04243 | CC_vs_CT + TT | rec | 2.03 (1.0244638955455-4.02) | C | T | C (0.2174 | C C |
| hCV27020269 | (rs7659613) | 0.02343 | CC_vs_GG | Gen | 1.56 (1.06156384252267-2.28) | C | G | C (0.4047 | C C |
| | | 0.02703 | C_vs_G | add | 1.24 (1.02429403887418-1.49) | C | G | C (0.4047 | C C |
| | | 0.04138 | CC_vs_CG + GG | rec | 1.42 (1.01385341422313-1.99) | C | G | C (0.4047 | C C |
| hCV27102953 | LOC647718 (rs4648360) | 0.00713 | TT_vs_CC | Gen | 1.7 (1.15505198766522-2.5) | T | C | T (0.4519 | T T |
| | | 0.00775 | T_vs_C | add | 1.3 (1.07164121464812-1.58) | T | C | T (0.4519 | T T |
| | | 0.01291 | TT_vs_TC + CC | rec | 1.5 (1.08992095886976-2.07) | T | C | T (0.4519 | T T |
| hCV27102978 | LOC647718 (rs7537581) | 0.00037 | C_vs_A | add | 1.43 (1.17286039578863-1.73) | C | A | A (0.5344 | A A |
| | | 0.00039 | CC_vs_AA | Gen | 2.03 (1.37196942703233-2.99) | C | A | A (0.5344 | A A |
| | | 0.00101 | CC_vs_CA + AA | rec | 1.69 (1.23512192592463-2.3) | C | A | A (0.5344 | A A |
| | | 0.01374 | CC + CA_vs_AA | dom | 1.49 (1.08473599302907-2.04) | C | A | A (0.5344 | A A |
| hCV27103080 | (rs4648459) | 0.00385 | TT_vs_GG | Gen | 1.76 (1.19923635734498-2.58) | T | G | T (0.4305 | T T |
| | | 0.00458 | T_vs_G | add | 1.32 (1.08862166155631-1.59) | T | G | T (0.4305 | T T |

TABLE 21-continued

Unadjusted association of 92 SNPs with DVT in LETS (p <= 0.05) that have not been tested in MEGA-1

| | | | | | | | | | | |
|---|---|---|---|---|---|---|---|---|---|---|
| | | 0.00807 | TT_vs_TG + GG | rec | 1.55 (1.12162097064999-2.15) | T | G | T (0.4305) | T T |
| | | 0.04586 | TT + TG_vs_GG | dom | 1.35 (1.00549674456945-1.81) | T | G | T (0.4305) | T T |
| hCV27103182 | (rs4609377) | 0.00077 | C_vs_T | add | 1.39 (1.14837160766132-1.69) | C | T | T (0.5133) | T T |
| | | 0.00082 | CC_vs_TT | Gen | 1.94 (1.31528974268535-2.86) | C | T | T (0.5133) | T T |
| | | 0.00467 | CC_vs_CT + TT | rec | 1.54 (1.14249698884992-2.08) | C | T | T (0.5133) | T T |
| | | 0.00898 | CC + CT_vs_TT | dom | 1.54 (1.11419540235736-2.13) | C | T | T (0.5133) | T T |
| hCV27103188 | (rs7511879) | 0.00386 | GG_vs_GA + AA | rec | 1.59 (1.16090265496612-2.18) | G | A | G (0.4636) | G G |
| | | 0.00463 | GG_vs_AA | Gen | 1.75 (1.18753475086407-2.57) | G | A | G (0.4636) | G G |
| | | 0.00485 | G_vs_A | add | 1.32 (1.08809986054585-1.6) | G | A | G (0.4636) | G G |
| hCV27103189 | (rs12031493) | 0.00933 | G_vs_A | add | 1.29 (1.06498516575119-1.57) | G | A | A (0.5133) | A A |
| | | 0.0103 | GG_vs_AA | Gen | 1.66 (1.12671323564467-2.44) | G | A | A (0.5133) | A A |
| | | 0.01303 | GG_vs_GA + AA | rec | 1.47 (1.08458487392409-1.99) | G | A | A (0.5133) | A A |
| hCV27103207 | (rs6424062) | 0.00385 | AA_vs_GG | Gen | 1.76 (1.19923635734499-2.58) | A | G | A (0.4305) | A A |
| | | 0.00453 | A_vs_G | add | 1.32 (1.08899212231946-1.59) | A | G | A (0.4305) | A A |
| | | 0.0085 | AA_vs_AG + GG | rec | 1.55 (1.11833165727631-2.15) | A | G | A (0.4305) | A A |
| | | 0.04367 | AA + AG_vs_GG | dom | 1.35 (1.00859469798602-1.81) | A | G | A (0.4305) | A A |
| hCV2716314 | CTSB (rs8005) | 0.04236 | A_vs_C | add | 1.24 (1.00756185015975-1.54) | A | C | A (0.2522) | A A |
| hCV2734332 | 39783 | 0.00283 | GA_vs_AA | Gen | 2.07 (1.28-3.33) | G | A | A (0.323) | A A |
| | (rs10759757) | 0.01256 | GG_vs_AA | Gen | 1.82 (1.14-2.91) | G | A | A (0.323) | A A |
| hCV27476043 | RDH13 | 0.03332 | AA_vs_AG + GG | rec | 2.8 (1.08474967907152-7.22) | A | G | A (0.1512) | A A |
| | (rs3745912) | 0.04 | AA_vs_GG | Gen | 2.71 (1.04653998737852-7.01) | A | G | A (0.1512) | A A |
| hCV27937396 | (rs4634201) | 0.04871 | CC_vs_TT | Gen | 1.97 (1.00383697586705-3.87) | C | T | C (0.1858) | C C |
| hCV2811695 | FTO | 0.00707 | C_vs_A | add | 1.46 (1.11-1.93) | C | A | C (0.1056) | C C |
| | (rs940214) | 0.01189 | CC + CA_vs_AA | dom | 1.49 (1.09-2.04) | C | A | C (0.1056) | C C |
| | | 0.03143 | CA_vs_AA | Gen | 1.43 (1.03-1.97) | C | A | C (0.1056) | C C |
| hCV2852784 | CYP17A1 | 0.01777 | A_vs_G | add | 1.27 (1.04-1.54) | A | G | G (0.412) | G G |
| | (rs743572) | 0.0271 | AA_vs_GG | Gen | 1.59 (1.05-2.41) | A | G | G (0.412) | G G |
| | | 0.03431 | AA_vs_AG + GG | rec | 1.34 (1.02-1.77) | A | G | G (0.412) | G G |
| hCV2892855 | FGG | 0.00076 | CC_vs_CT + TT | rec | 1.62 (1.22305766829666-2.14) | C | T | T (0.4546) | T T |
| | (rs6536024) | 0.0009 | C_vs_T | add | 1.39 (1.14291480827487-1.68) | C | T | T (0.4546) | T T |
| | | 0.00284 | CC_vs_TT | Gen | 1.83 (1.22982199650641-2.71) | C | T | T (0.4546) | T T |
| hCV2892869 | (rs13109457) | 0.00029 | AA_vs_GG | Gen | 2.5 (1.52334238718455-4.1) | A | G | A (0.2772) | A A |
| | | 0.00037 | AA_vs_AG + GG | rec | 2.38 (1.47584712337765-3.83) | A | G | A (0.2772) | A A |
| | | 0.00249 | A_vs_G | add | 1.37 (1.11676316556903-1.68) | A | G | A (0.2772) | A A |
| hCV2892893 | (rs12648258) | 0.01399 | A_vs_T | add | 1.32 (1.05814542701223-1.65) | A | T | A (0.1947) | A A |
| | | 0.01963 | AA_vs_TT | Gen | 2.08 (1.12423038179963-3.84) | A | T | A (0.1947) | A A |
| | | 0.033 | AA_vs_AT + TT | rec | 1.93 (1.05470532431105-3.55) | A | T | A (0.1947) | A A |
| | | 0.04454 | AA + AT_vs_TT | dom | 1.32 (1.00678919794171-1.73) | A | T | A (0.1947) | A A |
| hCV2892905 | PLRG1 | 0.03327 | C_vs_T | add | 1.27 (1.01895685789595-1.58) | C | T | C (0.2103) | C C |
| | (rs12642770) | 0.04994 | CC_vs_TT | Gen | 1.77 (1.00015868058748-3.15) | C | T | C (0.2103) | C C |
| hCV2892918 | (rs12511469) | 0.02229 | A_vs_T | add | 1.3 (1.03749332929128-1.62) | A | T | A (0.1973) | A A |
| | | 0.03037 | AA_vs_TT | Gen | 1.95 (1.06535995989442-3.57) | A | T | A (0.1973) | A A |
| | | 0.04836 | AA_vs_AT + TT | rec | 1.82 (1.00432829446122-3.31) | A | T | A (0.1973) | A A |

TABLE 21-continued

Unadjusted association of 92 SNPs with DVT in LETS (p <= 0.05) that have not been tested in MEGA-1

| | | | | | | | | | |
|---|---|---|---|---|---|---|---|---|---|
| hCV2892926 | (rs7662567) | 0.00586 | C_vs_T | add | 1.36 (1.09357836651693-1.7) | C | T | C (0.1984 | C C |
| | | 0.00915 | CC_vs_TT | Gen | 2.21 (1.21714661169315-4.01) | C | T | C (0.1984 | C C |
| | | 0.01776 | CC_vs_CT + TT | rec | 2.03 (1.13094724249255-3.66) | C | T | C (0.1984 | C C |
| | | 0.02387 | CC + CT_vs_TT | dom | 1.37 (1.04211330687034-1.79) | C | T | C (0.1984 | C C |
| hCV2892927 | (rs13123551) | 0.01436 | AA_vs_AT + TT | rec | 1.42 (1.07291037992945-1.89) | A | T | T (0.4524 | T T |
| | | 0.02592 | A_vs_T | add | 1.24 (1.02650891219607-1.51) | A | T | T (0.4524 | T T |
| hCV29521317 | LIMD1 (rs7648441) | 0.02272 | G_vs_A | add | 1.62 (1.07-2.45) | G | A | G (0.0454 | G G |
| | | 0.02712 | GG + GA_vs_AA | dom | 1.6 (1.05-2.44) | G | A | G (0.0454 | G G |
| | | 0.03349 | GA_vs_AA | Gen | 1.58 (1.04-2.4) | G | A | G (0.0454 | G G |
| hCV29983641 | (rs10008078) | 0.00588 | AA_vs_GG | Gen | 2.34 (1.27718823993844-4.27) | A | G | A (0.1993 | A A |
| | | 0.00921 | A_vs_G | add | 1.34 (1.08-1.67) | A | G | A (0.1993 | A A |
| | | 0.00957 | AA_vs_AG + GG | rec | 2.2 (1.21-3.98) | A | G | A (0.1993 | A A |
| hCV30002208 | (rs9402927) | 0.04695 | AA + AG_vs_GG | dom | 1.46 (1.01-2.12) | A | G | G (0.4069 | G G |
| hCV30040828 | TNFSF4 (rs6700269) | 0.03454 | TT + TC_vs_CC | dom | 1.45 (1.03-2.04) | T | C | T (0.0824 | T T |
| | | 0.03713 | TC_vs_CC | Gen | 1.45 (1.02251331249644-2.06) | T | C | T (0.0824 | T T |
| | | 0.04223 | T_vs_C | add | 1.39 (1.01-1.91) | T | C | T (0.0824 | T T |
| hCV30548253 | (rs9425773) | 0.02996 | AC_vs_CC | Gen | 2.77 (1.10401013563533-6.96) | A | C | C (0.1478 | C C |
| hCV305844 | LOC728077 (rs4823562) | 0.0275 | CC_vs_CG + GG | rec | 1.49 (1.05-2.13) | C | G | C (0.383 | C C |
| hCV30711231 | (rs12642469) | 0.02106 | A_vs_G | add | 1.3 (1.04-1.62) | A | G | A (0.198 | A A |
| | | 0.02334 | AA_vs_GG | Gen | 2.01 (1.09904034857764-3.66) | A | G | A (0.198 | A A |
| | | 0.03665 | AA_vs_AG + GG | rec | 1.88 (1.04000430618758-3.41) | A | G | A (0.198 | A A |
| hCV31475431 | MMEL1 (rs12133956) | 0.0372 | GG_vs_GT + TT | rec | 1.42 (1.02106867570514-1.98) | G | T | T (0.117 | T T |
| hCV31863982 | (rs7659024) | 2.2E−05 | AA_vs_GG | Gen | 3.13 (1.84942397608161-5.31) | A | G | A (0.2622 | A A |
| | | 4.6E−05 | AA_vs_AG + GG | rec | 2.89 (1.73628966491938-4.82) | A | G | A (0.2622 | A A |
| | | 0.0002 | A_vs_G | add | 1.48 (1.2-1.82) | A | G | A (0.2622 | A A |
| | | 0.01564 | AA + AG_vs_GG | dom | 1.38 (1.06-1.8) | A | G | A (0.2622 | A A |
| hCV31965333 | (rs10797390) | 0.00973 | CC_vs_TT | Gen | 1.67 (1.13170137567537-2.46) | C | T | T (0.4934 | T T |
| | | 0.01032 | C_vs_T | add | 1.29 (1.06-1.56) | C | T | T (0.4934 | T T |
| | | 0.02629 | CC + CT_vs_TT | dom | 1.45 (1.05-2.02) | C | T | T (0.4934 | T T |
| hCV31997958 | CHMP7 (rs12544038) | 0.00266 | GG_vs_GA + AA | rec | 1.79 (1.22451031007049-2.62) | G | A | G (0.3516 | G G |
| | | 0.00301 | GG_vs_AA | Gen | 1.86 (1.23542884303164-2.81) | G | A | G (0.3516 | G G |
| | | 0.00969 | G_vs_A | add | 1.29 (1.06-1.56) | G | A | G (0.3516 | G G |
| hCV3205858 | PXDNL (rs2979122) | 0.04375 | CC_vs_CT + TT | rec | 1.47 (1.01081147987946-2.13) | C | T | C (0.3565 | C C |
| hCV3210786 | C1orf164 (rs11582970) | 0.00202 | CC_vs_CT + TT | rec | 2.02 (1.29239242014763-3.15) | C | T | C (0.2962 | C C |
| | | 0.00463 | CC_vs_TT | Gen | 1.96 (1.22969863581067-3.12) | C | T | C (0.2962 | C C |
| hCV32212664 | (rs12642646) | 0.00716 | AA_vs_AG + GG | rec | 1.5 (1.11615682413902-2.01) | A | G | G (0.4878 | G G |
| hCV7429782 | FGG (rs1118823) | 0.01428 | T_vs_A | add | 1.3 (1.05-1.6) | T | A | A (0.3131 | A A |
| | | 0.0193 | TT_vs_TA + AA | rec | 1.37 (1.05227516552433-1.78) | T | A | A (0.3131 | A A |
| hCV7429793 | (rs1025154) | 0.01309 | C_vs_T | add | 1.32 (1.06-1.65) | C | T | C (0.198 | C C |
| | | 0.02761 | CC_vs_TT | Gen | 1.97 (1.07778558946615-3.61) | C | T | C (0.198 | C C |
| | | 0.03429 | CC + CT_vs_TT | dom | 1.34 (1.02-1.75) | C | T | C (0.198 | C C |
| | | 0.04931 | CC_vs_CT + TT | rec | 1.82 (1.00180479357554-3.3) | C | T | C (0.198 | C C |
| hCV788647 | (rs729045) | 0.01217 | AA_vs_GG | Gen | 1.69 (1.12-2.54) | A | G | G (0.4393 | G G |
| | | 0.01497 | A_vs_G | add | 1.28 (1.05-1.55) | A | G | G (0.4393 | G G |
| hCV813581 | OR4C11 (rs491160) | 0.01556 | T_vs_G | add | 1.47 (1.08-2) | T | G | T (0.0583 | T T |
| | | 0.02979 | TT + TG_vs_GG | dom | 1.61 (1.05-2.47) | T | G | T (0.0583 | T T |
| | | 0.03083 | TT_vs_GG | Gen | 2.33 (1.08-5.01) | T | G | T (0.0583 | T T |
| | | 0.03607 | TT_vs_TG + GG | rec | 2.27 (1.05-4.88) | T | G | T (0.0583 | T T |
| hCV8727391 | C17orf81 (rs414206) | 0.01705 | AG_vs_GG | Gen | 1.71 (1.1-2.66) | A | G | G (0.3595 | G G |
| hCV8857351 | RGS7 (rs2341021) | 0.03561 | TT_vs_TC + CC | rec | 1.42 (1.02-1.98) | T | C | T (0.4248 | T T |

TABLE 21-continued

Unadjusted association of 92 SNPs with DVT in LETS (p <= 0.05) that have not been tested in MEGA-1

| | | | | | | | | | | |
|---|---|---|---|---|---|---|---|---|---|---|
| hCV8911768 | SERPINC1 (rs941988) | 0.01702 | T_vs_C | add | 1.46 (1.07-1.98) | T | C | T (0.0856 | T T | |
| | | 0.02739 | TC_vs_CC | Gen | 1.47 (1.04-2.08) | T | C | T (0.0856 | T T | |
| hCV8919450 | F5 (rs6017) | 0.00317 | AA_vs_AG + GG | rec | 1.5 (1.15-1.97) | A | G | G (0.2567 | G G | |
| | | 0.00978 | A_vs_G | add | 1.33 (1.07-1.65) | A | G | G (0.2567 | G G | |
| hCV8941510 | CDSN (rs1042127) | 0.04988 | CC_vs_AA | Gen | 2.46 (1-6.07) | C | A | C (0.1411 | C C | |
| hCV9114656 | CFHR5 (rs9427662) | 0.04258 | C_vs_T | add | 1.42 (1.01-1.99) | C | T | C (0.0706 | C C | |
| hCV9680592 | MIPEP (rs17079372) | 0.03902 | GA_vs_AA | Gen | 0.55 (0.31-0.97) | G | A | A (0.2539 | A A | |
| hDV70683187 | (rs16846561) | 0.02204 | G_vs_C | add | 1.43 (1.05-1.93) | G | C | G (0.09 | G G | |
| | | 0.03622 | GC_vs_CC | Gen | 1.44 (1.02-2.02) | G | C | G (0.09 | G G | |
| hDV70683212 | RC3H1 (rs16846593) | 0.04442 | G_vs_C | add | 1.45 (1.01-2.07) | G | C | G (0.0633 | G G | |
| hDV70683382 | RABGAP1L (rs16846815) | 0.04002 | C_vs_G | add | 1.49 (1.02-2.18) | C | G | C (0.0515 | C C | |
| hDV70965621 | (rs17534243) | 0.0283 | GA_vs_AA | Gen | 1.37 (1.03-1.81) | G | A | G (0.2157 | G G | |

| marker | annotation | P-value | CASE cnt (CASE frq) | CONTROL cnt (CONTROL frq) | Genot2 | CASE cnt (CASE frq2 | CONTROL cnt (CONTROL frq)2 | Genot3 | CASE cnt (CASE frq3 | CONTROL cnt (CONTROL frq)3 |
|---|---|---|---|---|---|---|---|---|---|---|
| hCV10008773 | ANK1 (rs750625) | 0.04327 | 32 (0.0722) | 33 (0.073) | T C | 148 (0.3341) | 181 (0.4004) | C C | 263 (0.5937) | 238 (0.5265) |
| hCV11342584 | (rs6696864) | 0.03793 | 66 (0.15) | 73 (0.1619) | A T | 225 (0.5114) | 199 (0.4412) | T T | 149 (0.3386) | 179 (0.3969) |
| hCV11503431 | FGG (rs2066861) | 4.6E−05 | 55 (0.1244) | 22 (0.0487) | T C | 190 (0.4299) | 193 (0.427) | C C | 197 (0.4457) | 237 (0.5243) |
| | | 9.5E−05 | 55 (0.1244) | 22 (0.0487) | T C | 190 (0.4299) | 193 (0.427) | C C | 197 (0.4457) | 237 (0.5243) |
| | | 0.00035 | 55 (0.1244) | 22 (0.0487) | T C | 190 (0.4299) | 193 (0.427) | C C | 197 (0.4457) | 237 (0.5243) |
| | | 0.01879 | 55 (0.1244) | 22 (0.0487) | T C | 190 (0.4299) | 193 (0.427) | C C | 197 (0.4457) | 237 (0.5243) |
| hCV11559107 | UNC5C (rs2626053) | 0.00338 | 19 (0.0431) | 24 (0.0535) | A G | 156 (0.3537) | 117 (0.2606) | G G | 266 (0.6032) | 308 (0.686) |
| | | 0.00999 | 19 (0.0431) | 24 (0.0535) | A G | 156 (0.3537) | 117 (0.2606) | G G | 266 (0.6032) | 308 (0.686) |
| hCV11853483 | FGG (rs12644950) | 5.5E−05 | 54 (0.1224) | 22 (0.0488) | A G | 191 (0.4331) | 191 (0.4235) | G G | 196 (0.4444) | 238 (0.5277) |
| | | 0.00014 | 54 (0.1224) | 22 (0.0488) | A G | 191 (0.4331) | 191 (0.4235) | G G | 196 (0.4444) | 238 (0.5277) |
| | | 0.00028 | 54 (0.1224) | 22 (0.0488) | A G | 191 (0.4331) | 191 (0.4235) | G G | 196 (0.4444) | 238 (0.5277) |
| | | 0.01296 | 54 (0.1224) | 22 (0.0488) | A G | 191 (0.4331) | 191 (0.4235) | G G | 196 (0.4444) | 238 (0.5277) |
| hCV11853496 | FGG (rs7654093) | 6.8E−05 | 55 (0.1244) | 23 (0.0509) | T A | 190 (0.4299) | 191 (0.4226) | A A | 197 (0.4457) | 238 (0.5265) |
| | | 0.00016 | 55 (0.1244) | 23 (0.0509) | T A | 190 (0.4299) | 191 (0.4226) | A A | 197 (0.4457) | 238 (0.5265) |
| | | 0.00036 | 55 (0.1244) | 23 (0.0509) | T A | 190 (0.4299) | 191 (0.4226) | A A | 197 (0.4457) | 238 (0.5265) |
| | | 0.01572 | 55 (0.1244) | 23 (0.0509) | T A | 190 (0.4299) | 191 (0.4226) | A A | 197 (0.4457) | 238 (0.5265) |
| hCV11942562 | ACE (rs4343) | 0.04168 | 89 (0.2014) | 117 (0.2588) | G A | 232 (0.5249) | 226 (0.5) | A A | 121 (0.2738) | 109 (0.2412) |
| hCV11962159 | (rs2000745) | 0.03396 | 9 (0.0204) | 1 (0.0022) | T C | 70 (0.1587) | 72 (0.1596) | C C | 362 (0.8209) | 378 (0.8381) |
| | | 0.03409 | 9 (0.0204) | 1 (0.0022) | T C | 70 (0.1587) | 72 (0.1596) | C C | 362 (0.8209) | 378 (0.8381) |
| hCV11975250 | F5 (rs6025) | 6.6E−12 | 8 (0.0181) | 0 (0) | T C | 79 (0.1787) | 14 (0.031) | C C | 355 (0.8032) | 438 (0.969) |
| | | 8.6E−12 | 8 (0.0181) | 0 (0) | T C | 79 (0.1787) | 14 (0.031) | C C | 355 (0.8032) | 438 (0.969) |
| | | 1.6E−11 | 8 (0.0181) | 0 (0) | T C | 79 (0.1787) | 14 (0.031) | C C | 355 (0.8032) | 438 (0.969) |
| | | 1.9E−11 | 8 (0.0181) | 0 (0) | T C | 79 (0.1787) | 14 (0.031) | C C | 355 (0.8032) | 438 (0.969) |
| | | 8.2E−11 | 8 (0.0181) | 0 (0) | T C | 79 (0.1787) | 14 (0.031) | C C | 355 (0.8032) | 438 (0.969) |
| | | 1.1E−10 | 8 (0.0181) | 0 (0) | T C | 79 (0.1787) | 14 (0.031) | C C | 355 (0.8032) | 438 (0.969) |
| hCV11975651 | SERPINC1 (rs677) | 0.04802 | 3 (0.0068) | 11 (0.0244) | G C | 96 (0.2177) | 77 (0.1707) | C C | 342 (0.7755) | 363 (0.8049) |
| hCV11975658 | (rs1951626) | 0.03516 | 43 (0.0973) | 41 (0.0911) | A G | 213 (0.4819) | 188 (0.4178) | G G | 186 (0.4208) | 221 (0.4911) |
| | | 0.03523 | 43 (0.0973) | 41 (0.0911) | A G | 213 (0.4819) | 188 (0.4178) | G G | 186 (0.4208) | 221 (0.4911) |
| hCV1198623 | KRT8 (rs2638504) | 0.00813 | 45 (0.1016) | 72 (0.1593) | C G | 179 (0.4041) | 181 (0.4004) | G G | 219 (0.4944) | 199 (0.4403) |
| | | 0.01655 | 45 (0.1016) | 72 (0.1593) | C G | 179 (0.4041) | 181 (0.4004) | G G | 219 (0.4944) | 199 (0.4403) |
| | | 0.03471 | 45 (0.1016) | 72 (0.1593) | C G | 179 (0.4041) | 181 (0.4004) | G G | 219 (0.4944) | 199 (0.4403) |
| hCV12098639 | RIC8A (rs3216) | 0.01529 | 9 (0.0204) | 23 (0.0508) | G C | 133 (0.3009) | 125 (0.2759) | C C | 300 (0.6787) | 305 (0.6733) |
| | | 0.01785 | 9 (0.0204) | 23 (0.0508) | G C | 133 (0.3009) | 125 (0.2759) | C C | 300 (0.6787) | 305 (0.6733) |
| | | 0.02169 | 9 (0.0204) | 23 (0.0508) | G C | 133 (0.3009) | 125 (0.2759) | C C | 300 (0.6787) | 305 (0.6733) |
| hCV1376206 | NLRP2 (rs10412915) | 0.04509 | 38 (0.086) | 38 (0.0841) | C T | 199 (0.4502) | 175 (0.3872) | T T | 205 (0.4638) | 239 (0.5288) |
| hCV1376246 | NLRP2 (rs12768) | 0.04168 | 107 (0.2415) | 112 (0.2472) | C A | 211 (0.4763) | 240 (0.5298) | A A | 125 (0.2822) | 101 (0.223) |
| hCV1420741 | (rs444124) | 0.01513 | 53 (0.1196) | 33 (0.0735) | C G | 179 (0.4041) | 180 (0.4009) | G G | 211 (0.4763) | 236 (0.5256) |
| | | 0.02069 | 53 (0.1196) | 33 (0.0735) | C G | 179 (0.4041) | 180 (0.4009) | G G | 211 (0.4763) | 236 (0.5256) |
| | | 0.03078 | 53 (0.1196) | 33 (0.0735) | C G | 179 (0.4041) | 180 (0.4009) | G G | 211 (0.4763) | 236 (0.5256) |
| hCV1455329 | (rs16018) | 0.0104 | 35 (0.0792) | 46 (0.1018) | G A | 211 (0.4774) | 174 (0.385) | A A | 196 (0.4434) | 232 (0.5133) |
| | | 0.03679 | 35 (0.0792) | 46 (0.1018) | G A | 211 (0.4774) | 174 (0.385) | A A | 196 (0.4434) | 232 (0.5133) |
| hCV15864094 | DARS2 (rs2068871) | 0.02341 | 6 (0.0136) | 4 (0.0089) | G A | 73 (0.1659) | 52 (0.1158) | A A | 361 (0.8205) | 393 (0.8753) |
| | | 0.02708 | 6 (0.0136) | 4 (0.0089) | G A | 73 (0.1659) | 52 (0.1158) | A A | 361 (0.8205) | 393 (0.8753) |
| | | 0.03009 | 6 (0.0136) | 4 (0.0089) | G A | 73 (0.1659) | 52 (0.1158) | A A | 361 (0.8205) | 393 (0.8753) |
| hCV15947925 | TNFRSF14 (rs2234163) | 0.0278 | 1 (0.0023) | 0 (0) | T C | 11 (0.0248) | 3 (0.0066) | C C | 431 (0.9729) | 449 (0.9934) |

TABLE 21-continued

Unadjusted association of 92 SNPs with DVT in LETS (p <= 0.05) that have not been tested in MEGA-1

| | | | | | | | | | | |
|---|---|---|---|---|---|---|---|---|---|---|
| | | 0.02805 | 1 (0.0023) | 0 (0) | T C | 11 (0.0248) | 3 (0.0066) | C C | 431 (0.9729) | 449 (0.9934) |
| | | 0.04069 | 1 (0.0023) | 0 (0) | T C | 11 (0.0248) | 3 (0.0066) | C C | 431 (0.9729) | 449 (0.9934) |
| hCV15953063 | (rs2953331) | 0.01795 | 60 (0.1364) | 55 (0.1217) | A G | 212 (0.4818) | 189 (0.4181) | G G | 168 (0.3818) | 208 (0.4602) |
| | | 0.02267 | 60 (0.1364) | 55 (0.1217) | A G | 212 (0.4818) | 189 (0.4181) | G G | 168 (0.3818) | 208 (0.4602) |
| | | 0.04192 | 60 (0.1364) | 55 (0.1217) | A G | 212 (0.4818) | 189 (0.4181) | G G | 168 (0.3818) | 208 (0.4602) |
| hCV15956054 | SERPINC1 (rs2227594) | 0.04188 | 4 (0.0092) | 11 (0.0247) | T C | 98 (0.2258) | 75 (0.1682) | C C | 332 (0.765) | 360 (0.8072) |
| hCV15956055 | SERPINC1 (rs2227593) | 0.04439 | 4 (0.0092) | 11 (0.0248) | T G | 97 (0.224) | 74 (0.167) | G G | 332 (0.7667) | 358 (0.8081) |
| hCV15956059 | SERPINC1 (rs2227592) | 0.02277 | 6 (0.0136) | 3 (0.0067) | T C | 93 (0.2114) | 72 (0.1596) | C C | 341 (0.775) | 376 (0.8337) |
| | | 0.02759 | 6 (0.0136) | 3 (0.0067) | T C | 93 (0.2114) | 72 (0.1596) | C C | 341 (0.775) | 376 (0.8337) |
| | | 0.04197 | 6 (0.0136) | 3 (0.0067) | T C | 93 (0.2114) | 72 (0.1596) | C C | 341 (0.775) | 376 (0.8337) |
| hCV15977624 | RDH13 (rs2305543) | 0.04128 | 39 (0.0882) | 24 (0.053) | A G | 147 (0.3326) | 175 (0.3863) | G G | 256 (0.5792) | 254 (0.5607) |
| hCV16000557 | LOC390988 (rs2377041) | 0.00253 | 108 (0.246) | 78 (0.1729) | T C | 223 (0.508) | 232 (0.5144) | C C | 108 (0.246) | 141 (0.3126) |
| | | 0.00283 | 108 (0.246) | 78 (0.1729) | T C | 223 (0.508) | 232 (0.5144) | C C | 108 (0.246) | 141 (0.3126) |
| | | 0.0076 | 108 (0.246) | 78 (0.1729) | T C | 223 (0.508) | 232 (0.5144) | C C | 108 (0.246) | 141 (0.3126) |
| | | 0.02713 | 108 (0.246) | 78 (0.1729) | T C | 223 (0.508) | 232 (0.5144) | C C | 108 (0.246) | 141 (0.3126) |
| hCV1605386 | PKNOX1 (rs234736) | 0.00313 | 28 (0.0638) | 50 (0.1119) | A G | 213 (0.4852) | 178 (0.3982) | G G | 198 (0.451) | 219 (0.4899) |
| | | 0.0126 | 28 (0.0638) | 50 (0.1119) | A G | 213 (0.4852) | 178 (0.3982) | G G | 198 (0.451) | 219 (0.4899) |
| hCV16135173 | (rs2146372) | 0.02501 | 6 (0.0136) | 5 (0.0111) | C G | 93 (0.2104) | 69 (0.1533) | G G | 343 (0.776) | 376 (0.8356) |
| | | 0.02618 | 6 (0.0136) | 5 (0.0111) | C G | 93 (0.2104) | 69 (0.1533) | G G | 343 (0.776) | 376 (0.8356) |
| | | 0.03375 | 6 (0.0136) | 5 (0.0111) | C G | 93 (0.2104) | 69 (0.1533) | G G | 343 (0.776) | 376 (0.8356) |
| hCV18996 | ANKS1B (rs638177) | 0.04369 | 14 (0.0317) | 27 (0.0597) | C T | 161 (0.3643) | 166 (0.3673) | T T | 267 (0.6041) | 259 (0.573) |
| | | 0.04845 | 14 (0.0317) | 27 (0.0597) | C T | 161 (0.3643) | 166 (0.3673) | T T | 267 (0.6041) | 259 (0.573) |
| hCV1900162 | PTPN22 (rs11102685) | 0.01558 | 8 (0.0278) | 1 (0.0029) | C T | 48 (0.1667) | 81 (0.2382) | T T | 232 (0.8056) | 258 (0.7588) |
| | | 0.03279 | 8 (0.0278) | 1 (0.0029) | C T | 48 (0.1667) | 81 (0.2382) | T T | 232 (0.8056) | 258 (0.7588) |
| | | 0.04005 | 8 (0.0278) | 1 (0.0029) | C T | 48 (0.1667) | 81 (0.2382) | T T | 232 (0.8056) | 258 (0.7588) |
| hCV1937195 | CCDC8 (rs34186470) | 0.01441 | 7 (0.0158) | 12 (0.0265) | A G | 72 (0.1625) | 99 (0.2185) | G G | 364 (0.8217) | 342 (0.755) |
| | | 0.01494 | 7 (0.0158) | 12 (0.0265) | A G | 72 (0.1625) | 99 (0.2185) | G G | 364 (0.8217) | 342 (0.755) |
| hCV1974936 | (rs4648648) | 0.01009 | 93 (0.2104) | 109 (0.2406) | T C | 217 (0.491) | 243 (0.5364) | C C | 132 (0.2986) | 101 (0.223) |
| | | 0.0232 | 93 (0.2104) | 109 (0.2406) | T C | 217 (0.491) | 243 (0.5364) | C C | 132 (0.2986) | 101 (0.223) |
| | | 0.02746 | 93 (0.2104) | 109 (0.2406) | T C | 217 (0.491) | 243 (0.5364) | C C | 132 (0.2986) | 101 (0.223) |
| hCV1974951 | TNFRSF14 (rs2234161) | 0.01935 | 93 (0.2099) | 102 (0.2262) | A G | 214 (0.4831) | 242 (0.5366) | G G | 136 (0.307) | 107 (0.2373) |
| hCV1974967 | (rs2147905) | 0.01956 | 97 (0.2195) | 111 (0.245) | G A | 212 (0.4796) | 237 (0.5232) | A A | 133 (0.3009) | 105 (0.2318) |
| | | 0.0449 | 97 (0.2195) | 111 (0.245) | G A | 212 (0.4796) | 237 (0.5232) | A A | 133 (0.3009) | 105 (0.2318) |
| hCV22272816 | GLOD4 (rs2249542) | 0.0413 | 35 (0.0794) | 44 (0.0971) | A G | 154 (0.3492) | 181 (0.3996) | G G | 252 (0.5714) | 228 (0.5033) |
| | | 0.04909 | 35 (0.0794) | 44 (0.0971) | A G | 154 (0.3492) | 181 (0.3996) | G G | 252 (0.5714) | 228 (0.5033) |
| hCV25611352 | RAF1 (rs3729926) | 0.00089 | 12 (0.0271) | 32 (0.0708) | C T | 157 (0.3552) | 127 (0.281) | T T | 273 (0.6176) | 293 (0.6482) |
| | | 0.00364 | 12 (0.0271) | 32 (0.0708) | C T | 157 (0.3552) | 127 (0.281) | T T | 273 (0.6176) | 293 (0.6482) |
| | | 0.00907 | 12 (0.0271) | 32 (0.0708) | C T | 157 (0.3552) | 127 (0.281) | T T | 273 (0.6176) | 293 (0.6482) |
| hCV25649928 | DEGS1 ( ) | 0.00685 | 0 (0) | 0 (0) | G A | 29 (0.0667) | 12 (0.027) | A A | 406 (0.9333) | 433 (0.973) |
| | | | 0 (0) | 0 (0) | G A | 29 (0.0667) | 12 (0.027) | A A | 406 (0.9333) | 433 (0.973) |
| | | | 0 (0) | 0 (0) | G A | 29 (0.0667) | 12 (0.027) | A A | 406 (0.9333) | 433 (0.973) |
| hCV25767872 | KIAA1546 (rs6843141) | 0.04821 | 0 (0) | 0 (0) | A G | 22 (0.0497) | 11 (0.0243) | G G | 421 (0.9503) | 442 (0.9757) |
| | | | 0 (0) | 0 (0) | A G | 22 (0.0497) | 11 (0.0243) | G G | 421 (0.9503) | 442 (0.9757) |
| | | | 0 (0) | 0 (0) | A G | 22 (0.0497) | 11 (0.0243) | G G | 421 (0.9503) | 442 (0.9757) |
| hCV2605707 | CDK6 (rs42041) | 0.04581 | 20 (0.0456) | 35 (0.0774) | G C | 165 (0.3759) | 170 (0.3761) | C C | 254 (0.5786) | 247 (0.5465) |
| hCV26338456 | SDCCAG8 (rs10927011) | 0.04489 | 86 (0.1946) | 113 (0.2506) | A G | 238 (0.5385) | 225 (0.4989) | G G | 118 (0.267) | 113 (0.2506) |
| hCV26338482 | SDCCAG8 (rs10803143) | 0.02994 | 45 (0.1025) | 29 (0.0644) | T C | 185 (0.4214) | 186 (0.4133) | C C | 209 (0.4761) | 235 (0.5222) |
| | | 0.04165 | 45 (0.1025) | 29 (0.0644) | T C | 185 (0.4214) | 186 (0.4133) | C C | 209 (0.4761) | 235 (0.5222) |
| hCV26887434 | RGS7 (rs12723522) | 0.04698 | 99 (0.224) | 78 (0.1726) | C A | 217 (0.491) | 228 (0.5044) | A A | 126 (0.2851) | 146 (0.323) |
| hCV26895255 | GP6 (rs11669150) | 0.04243 | 25 (0.0566) | 13 (0.0287) | C T | 148 (0.3348) | 171 (0.3775) | T T | 269 (0.6086) | 269 (0.5938) |
| hCV27020269 | (rs7659613) | 0.02343 | 95 (0.2154) | 73 (0.1619) | C G | 213 (0.483) | 219 (0.4856) | G G | 133 (0.3016) | 159 (0.3525) |
| | | 0.02703 | 95 (0.2154) | 73 (0.1619) | C G | 213 (0.483) | 219 (0.4856) | G G | 133 (0.3016) | 159 (0.3525) |
| | | 0.04138 | 95 (0.2154) | 73 (0.1619) | C G | 213 (0.483) | 219 (0.4856) | G G | 133 (0.3016) | 159 (0.3525) |
| hCV27102953 | LOC647718 (rs4648360) | 0.00713 | 112 (0.2551) | 83 (0.1857) | T C | 227 (0.5171) | 238 (0.5324) | C C | 100 (0.2278) | 126 (0.2819) |
| | | 0.00775 | 112 (0.2551) | 83 (0.1857) | T C | 227 (0.5171) | 238 (0.5324) | C C | 100 (0.2278) | 126 (0.2819) |
| | | 0.01291 | 112 (0.2551) | 83 (0.1857) | T C | 227 (0.5171) | 238 (0.5324) | C C | 100 (0.2278) | 126 (0.2819) |
| hCV27102978 | LOC647718 (rs7537581) | 0.00037 | 85 (0.1923) | 118 (0.2616) | A C | 230 (0.5204) | 246 (0.5455) | C C | 127 (0.2873) | 87 (0.1929) |

TABLE 21-continued

Unadjusted association of 92 SNPs with DVT in LETS (p <= 0.05) that have not been tested in MEGA-1

| | | | | | | | | | | | |
|---|---|---|---|---|---|---|---|---|---|---|---|
| | | 0.00039 | 85 (0.1923) | 118 (0.2616) | A C | 230 (0.5204) | 246 (0.5455) | C C | 127 (0.2873) | 87 (0.1929) |
| | | 0.00101 | 85 (0.1923) | 118 (0.2616) | A C | 230 (0.5204) | 246 (0.5455) | C C | 127 (0.2873) | 87 (0.1929) |
| | | 0.01374 | 85 (0.1923) | 118 (0.2616) | A C | 230 (0.5204) | 246 (0.5455) | C C | 127 (0.2873) | 87 (0.1929) |
| hCV27103080 | (rs4648459) | 0.00385 | 108 (0.2443) | 78 (0.1722) | T G | 223 (0.5045) | 234 (0.5166) | G G | 111 (0.2511) | 141 (0.3113) |
| | | 0.00458 | 108 (0.2443) | 78 (0.1722) | T G | 223 (0.5045) | 234 (0.5166) | G G | 111 (0.2511) | 141 (0.3113) |
| | | 0.00807 | 108 (0.2443) | 78 (0.1722) | T G | 223 (0.5045) | 234 (0.5166) | G G | 111 (0.2511) | 141 (0.3113) |
| | | 0.04586 | 108 (0.2443) | 78(0.1722) | T G | 223 (0.5045) | 234 (0.5166) | G G | 111 (0.2511) | 141 (0.3113) |
| hCV27103182 | (rs4609377) | 0.00077 | 78(0.1761) | 112 (0.2478) | T C | 230 (0.5192) | 240 (0.531) | C C | 135 (0.3047) | 100 (0.2212) |
| | | 0.00082 | 78 (0.1761) | 112 (0.2478) | T C | 230 (0.5192) | 240 (0.531) | C C | 135 (0.3047) | 100 (0.2212) |
| | | 0.00467 | 78 (0.1761) | 112(0.2478) | T C | 230 (0.5192) | 240 (0.531) | C C | 135 (0.3047) | 100 (0.2212) |
| | | 0.00898 | 78 (0.1761) | 112 (0.2478) | T C | 230 (0.5192) | 240 (0.531) | C C | 135 (0.3047) | 100 (0.2212) |
| hCV27103188 | (rs7511879) | 0.00386 | 120 (0.2715) | 86 (0.1898) | G A | 227 (0.5136) | 248 (0.5475) | A A | 95 (0.2149) | 119 (0.2627) |
| | | 0.00463 | 120 (0.2715) | 86 (0.1898) | G A | 227 (0.5136) | 248 (0.5475) | A A | 95 (0.2149) | 119 (0.2627) |
| | | 0.00485 | 120 (0.2715) | 86 (0.1898) | G A | 227 (0.5136) | 248 (0.5475) | A A | 95 (0.2149) | 119 (0.2627) |
| hCV27103189 | (rs12031493) | 0.00933 | 86 (0.1959) | 110 (0.2434) | A G | 226 (0.5148) | 244 (0.5398) | G G | 127 (0.2893) | 98 (0.2168) |
| | | 0.0103 | 86 (0.1959) | 110 (0.2434) | A G | 226 (0.5148) | 244 (0.5398) | G G | 127 (0.2893) | 98 (0.2168) |
| | | 0.01303 | 86 (0.1959) | 110 (0.2434) | A G | 226 (0.5148) | 244 (0.5398) | G G | 127 (0.2893) | 98 (0.2168) |
| hCV27103207 | (rs6424062) | 0.00385 | 108 (0.2438) | 78 (0.1722) | A G | 224 (0.5056) | 234 (0.5166) | G G | 111 (0.2506) | 141 (0.3113) |
| | | 0.00453 | 108 (0.2438) | 78 (0.1722) | A G | 224 (0.5056) | 234 (0.5166) | G G | 111 (0.2506) | 141 (0.3113) |
| | | 0.0085 | 108 (0.2438) | 78 (0.1722) | A G | 224 (0.5056) | 234 (0.5166) | G G | 111 (0.2506) | 141 (0.3113) |
| | | 0.04367 | 108 (0.2438) | 78 (0.1722) | A G | 224 (0.5056) | 234 (0.5166) | G G | 111 (0.2506) | 141 (0.3113) |
| hCV2716314 | CTSB (rs8005) | 0.04236 | 36 (0.0816) | 28 (0.0619) | A C | 188 (0.4263) | 172 (0.3805) | C C | 217 (0.4921) | 252 (0.5575) |
| hCV2734332 | 39783 | 0.00283 | 32 (0.0722) | 59 (0.1305) | A G | 195 (0.4402) | 174 (0.385) | G G | 216 (0.4876) | 219 (0.4845) |
| | (rs10759757) | 0.01256 | 32 (0.0722) | 59 (0.135) | A G | 195 (0.4402) | 174 (0.385) | G G | 216 (0.4876) | 219 (0.4845) |
| hCV27476043 | RDH13 | 0.03332 | 16 (0.0362) | 6 (0.0132) | A G | 109 (0.2466) | 125 (0.2759) | G G | 317 (0.7172) | 322 (0.7108) |
| | (rs3745912) | | | | | | | | | |
| | | 0.04 | 16 (0.0362) | 6 (0.0132) | A G | 109 (0.2466) | 125 (0.2759) | G G | 317 (0.7172) | 322 (0.7108) |
| hCV27937396 | (rs4634201) | 0.04871 | 25 (0.0567) | 14 (0.031) | C T | 146 (0.3311) | 140 (0.3097) | T T | 270 (0.6122) | 298 (0.6593) |
| hCV2811695 | FTO | 0.00707 | 13 (0.0294) | 6 (0.0133) | C A | 106 (0.2398) | 83 (0.1844) | A A | 323 (0.7308) | 361 (0.8022) |
| | (rs940214) | 0.01189 | 13 (0.0294) | 6 (0.0133) | C A | 106 (0.2398) | 83 (0.1844) | A A | 323 (0.7308) | 361 (0.8022) |
| | | 0.03143 | 13 (0.0294) | 6 (0.0133) | C A | 106 (0.2398) | 83 (0.1844) | A A | 323 (0.7308) | 361 (0.8022) |
| hCV2852784 | CYP17A1 | 0.01777 | 54 (0.1244) | 73 (0.1648) | G A | 202 (0.4654) | 219 (0.4944) | A A | 178 (0.4101) | 151 (0.3409) |
| | (rs743572) | 0.0271 | 54 (0.1244) | 73 (0.1648) | G A | 202 (0.4654) | 219 (0.4944) | A A | 178 (0.4101) | 151 (0.3409) |
| | | 0.03431 | 54 (0.1244) | 73 (0.1648) | G A | 202 (0.4654) | 219 (0.4944) | A A | 178 (0.4101) | 151 (0.3409) |
| hCV2892855 | FGG | 0.00076 | 64 (0.1451) | 87 (0.1925) | T C | 205 (0.4649) | 237 (0.5243) | C C | 172 (0.39 | 128 (0.2832) |
| | (rs6536024) | | | | | | | | | |
| | | 0.0009 | 64 (0.1451) | 87 (0.1925) | T C | 205 (0.4649) | 237 (0.5243) | C C | 172 (0.39 | 128 (0.2832) |
| | | 0.00284 | 64 (0.1451) | 87 (0.1925) | T C | 205 (0.4649) | 237 (0.5243) | C C | 172 (0.39 | 128 (0.2832) |
| hCV2892869 | (rs13109457) | 0.00029 | 58 (0.1315) | 27 (0.0599) | A G | 187 (0.424) | 196 (0.4346) | G G | 196 (0.4444) | 228 (0.5055) |
| | | 0.00037 | 58 (0.1315) | 27 (0.0599) | A G | 187 (0.424) | 196 (0.4346) | G G | 196 (0.4444) | 228 (0.5055) |
| | | 0.00249 | 58 (0.1315) | 27 (0.0599) | A G | 187 (0.424) | 196 (0.4346) | G G | 196 (0.4444) | 228 (0.5055) |
| hCV2892893 | (rs12648258) | 0.01399 | 31 (0.0703) | 17 (0.0376) | A T | 153 (0.3469) | 142 (0.3142) | T T | 257 (0.5828) | 293 (0.6482) |
| | | 0.01963 | 31 (0.0703) | 17 (0.0376) | A T | 153 (0.3469) | 142 (0.3142) | T T | 257 (0.5828) | 293 (0.6482) |
| | | 0.033 | 31 (0.0703) | 17 (0.0376) | A T | 153 (0.3469) | 142 (0.3142) | T T | 257 (0.5828) | 293 (0.6482) |
| | | 0.04454 | 31 (0.0703) | 17 (0.0376) | A T | 153 (0.3469) | 142 (0.3142) | T T | 257 (0.5828) | 293 (0.6482) |
| hCV2892905 | PLRG1 | 0.03327 | 33 (0.0755) | 21 (0.047) | C T | 156 (0.357) | 146 (0.3266) | T T | 248 (0.5675) | 280 (0.6264) |
| | (rs12642770) | | | | | | | | | |
| | | 0.04994 | 33 (0.0755) | 21 (0.047) | C T | 156 (0.357) | 146 (0.3266) | T T | 248 (0.5675) | 280 (0.6264) |
| hCV2892918 | (rs12511469) | 0.02229 | 31 (0.0705) | 18 (0.0399) | A T | 152 (0.3455) | 142 (0.3149) | T T | 257 (0.5841) | 291 (0.6452) |
| | | 0.03037 | 31 (0.0705) | 18 (0.0399) | A T | 152 (0.3455) | 142 (0.3149) | T T | 257 (0.5841) | 291 (0.6452) |
| | | 0.04836 | 31 (0.0705) | 18 (0.0399) | A T | 152 (0.3455) | 142 (0.3149) | T T | 257 (0.5841) | 291 (0.6452) |
| hCV2892926 | (rs7662567) | 0.00586 | 34(0.078) | 18 (0.0399) | C T | 154 (0.3532) | 143 (0.3171) | T T | 248 (0.5688) | 290 (0.643) |
| | | 0.00915 | 34 (0.078) | 18 (0.0399) | C T | 154 (0.3532) | 143 (0.3171) | T T | 248 (0.5688) | 290 (0.643) |
| | | 0.01776 | 34 (0.078) | 18 (0.0399) | C T | 154 (0.3532) | 143 (0.3171) | T T | 248 (0.5688) | 290 (0.643) |
| | | 0.02387 | 34 (0.078) | 18 (0.0399) | C T | 154 (0.3532) | 143 (0.3171) | T T | 248 (0.5688) | 290 (0.643) |
| hCV2892927 | (rs13123551) | 0.01436 | 71 (0.1617) | 85 (0.1881) | T A | 210 (0.4784) | 239 (0.5288) | A A | 158 (0.3599) | 128 (0.2832) |
| | | 0.02592 | 71 (0.1617) | 85 (0.1881) | T A | 210 (0.4784) | 239 (0.5288) | A A | 158 (0.3599) | 128 (0.2832) |
| hCV29521317 | LIMD1 | 0.02272 | 1 (0.0023) | 0 (0) | G A | 60 (0.1357) | 41 (0.0907) | A A | 381 (0.862) | 411 (0.9093) |
| | (rs7648441) | 0.02712 | 1 (0.0023) | 0 (0) | G A | 60 (0.1357) | 41 (0.0907) | A A | 381 (0.862) | 411 (0.9093) |
| | | 0.03349 | 1 (0.0023) | 0 (0) | G A | 60 (0.1357) | 41 (0.0907) | A A | 381 (0.862) | 411 (0.9093) |
| hCV29983641 | (rs10008078) | 0.00588 | 35 (0.0795) | 17 (0.0379) | A G | 152 (0.3455) | 145 (0.3229) | G G | 253 (0.575) | 287 (0.6392) |
| | | 0.00921 | 35 (0.0795) | 17 (0.0379) | A G | 152 (0.3455) | 145 (0.3229) | G G | 253 (0.575) | 287 (0.6392) |
| | | 0.00957 | 35 (0.0795) | 17 (0.0379) | A G | 152 (0.3455) | 145 (0.3229) | G G | 253 (0.575) | 287(0.6392) |
| hCV30002208 | (rs9402927) | 0.04695 | 55 (0.1253) | 78 (0.1729) | G A | 219 (0.4989) | 211 (0.4678) | A A | 165 (0.3759) | 162 (0.3592) |
| hCV30040828 | TNFSF4 | 0.03454 | 5 (0.0113) | 4 (0.0089) | T C | 88 (0.1995) | 66 (0.147) | C C | 348 (0.7891) | 379 (0.8441) |
| | (rs6700269) | | | | | | | | | |
| | | 0.03713 | 5 (0.0113) | 4 (0.0089) | T C | 88 (0.1995) | 66 (0.147) | C C | 348 (0.7891) | 379 (0.8441) |
| | | 0.04223 | 5 (0.0113) | 4 (0.0089) | T C | 88 (0.1995) | 66 (0.147) | C C | 348 (0.7891) | 379 (0.8441) |
| hCV30548253 | (rs9425773) | 0.02996 | 7 (0.0159) | 17 (0.0378) | C A | 113 (0.2568) | 99 (0.22) | A A | 320 (0.7273) | 334 (0.7422) |
| hCV305844 | LOC728077 | 0.0275 | 86 (0.1941) | 63 (0.1391) | C G | 186 (0.4199) | 221 (0.4879) | G G | 171 (0.386) | 169 (0.3731) |
| | (rs4823562) | | | | | | | | | |
| hCV30711231 | (rs12642469) | 0.02106 | 32 (0.0724) | 18 (0.0398) | A G | 152 (0.3439) | 143 (0.3164) | G G | 258 (0.5837) | 291 (0.6438) |
| | | 0.02334 | 32 (0.0724) | 18 (0.0398) | A G | 152 (0.3439) | 143 (0.3164) | G G | 258 (0.5837) | 291 (0.6438) |
| | | 0.03665 | 32 (0.0724) | 18 (0.0398) | A G | 152 (0.3439) | 143 (0.3164) | G G | 258 (0.5837) | 291 (0.6438) |
| hCV31475431 | MMEL1 | 0.0372 | 6 (0.0135) | 3 (0.0066) | T G | 70 (0.158) | 100 (0.2208) | G G | 367 (0.8284) | 350 (0.7726) |
| | (rs12133956) | | | | | | | | | |
| hCV31863982 | (rs7659024) | 2.2E-05 | 57 (0.129) | 22 (0.0487) | A G | 189 (0.4276) | 193 (0.427) | G G | 196 (0.4434) | 237 (0.5243) |
| | | 4.6E-05 | 57 (0.129) | 22 (0.0487) | A G | 189 (0.4276) | 193 (0.427) | G G | 196 (0.4434) | 237 (0.5243) |

TABLE 21-continued

Unadjusted association of 92 SNPs with DVT in LETS (p <= 0.05) that have not been tested in MEGA-1

| | | | | | | | | | | | |
|---|---|---|---|---|---|---|---|---|---|---|---|
| | | 0.0002 | 57 (0.129) | 22 (0.0487) | A G | 189 (0.4276) | 193 (0.427) | G G | 196 (0.4434) | 237 (0.5243) | |
| | | 0.01564 | 57 (0.129) | 22 (0.0487) | A G | 189 (0.4276) | 193 (0.427) | G G | 196 (0.4434) | 237 (0.5243) | |
| hCV31965333 | (rs10797390) | 0.00973 | 76 (0.1723) | 105 (0.2323) | T C | 231 (0.5238) | 236 (0.5221) | C C | 134 (0.3039) | 111 (0.2456) | |
| | | 0.01032 | 76 (0.1723) | 105 (0.2323) | T C | 231 (0.5238) | 236 (0.5221) | C C | 134 (0.3039) | 111 (0.2456) | |
| | | 0.02629 | 76 (0.1723) | 105 (0.2323) | T C | 231 (0.5238) | 236 (0.5221) | C C | 134 (0.3039) | 111 (0.2456) | |
| hCV31997958 | CHMP7 (rs12544038) | 0.00266 | 81 (0.1837) | 50 (0.1116) | G A | 201 (0.4558) | 215 (0.4799) | A A | 159 (0.3605) | 183 (0.4085) | |
| | | 0.00301 | 81 (0.1837) | 50 (0.1116) | G A | 201 (0.4558) | 215 (0.4799) | A A | 159 (0.3605) | 183 (0.4085) | |
| | | 0.00969 | 81 (0.1837) | 50 (0.1116) | G A | 201 (0.4558) | 215 (0.4799) | A A | 159 (0.3605) | 183 (0.4085) | |
| hCV3205858 | PXDNL (rs2979122) | 0.04375 | 76 (0.1716) | 56 (0.1236) | C T | 196 (0.4424) | 211 (0.4658) | T T | 171 (0.386) | 186 (0.4106) | |
| hCV3210786 | C1orf164 (rs11582970) | 0.00202 | 61 (0.138) | 33 (0.0735) | C T | 177 (0.4005) | 200 (0.4454) | T T | 204 (0.4615) | 216 (0.4811) | |
| | | 0.00463 | 61 (0.138) | 33 (0.0735) | C T | 177 (0.4005) | 200 (0.4454) | T T | 204 (0.4615) | 216 (0.4811) | |
| hCV32212664 | (rs12642646) | 0.00716 | 90 (0.2041) | 96 (0.2124) | G A | 211 (0.4785) | 249 (0.5509) | A A | 140 (0.3175) | 107 (0.2367) | |
| hCV7429782 | FGG (rs1118823) | 0.01428 | 28 (0.0633) | 40 (0.0885) | A T | 175 (0.3959) | 203 (0.4491) | T T | 239 (0.5407) | 209 (0.4624) | |
| | | 0.0193 | 28 (0.0633) | 40 (0.0885) | A T | 175 (0.3959) | 203 (0.4491) | T T | 239 (0.5407) | 209 (0.4624) | |
| hCV7429793 | (rs1025154) | 0.01309 | 31 (0.0701) | 18 (0.0398) | C T | 157 (0.3552) | 143 (0.3164) | T T | 254 (0.5747) | 291 (0.6438) | |
| | | 0.02761 | 31 (0.0701) | 18 (0.0398) | C T | 157 (0.3552) | 143 (0.3164) | T T | 254 (0.5747) | 291 (0.6438) | |
| | | 0.03429 | 31 (0.0701) | 18 (0.0398) | C T | 157 (0.3552) | 143 (0.3164) | T T | 254 (0.5747) | 291 (0.6438) | |
| | | 0.04931 | 31 (0.0701) | 18 (0.0398) | C T | 157 (0.3552) | 143 (0.3164) | T T | 254 (0.5747) | 291 (0.6438) | |
| hCV788647 | (rs729045) | 0.01217 | 56 (0.127) | 82 (0.181) | G A | 227 (0.5147) | 234 (0.5166) | A A | 158 (0.3583) | 137 (0.3024) | |
| | | 0.01497 | 56 (0.127) | 82 (0.181) | G A | 227 (0.5147) | 234 (0.5166) | A A | 158 (0.3583) | 137 (0.3024) | |
| hCV813581 | OR4C11 (rs491160) | 0.01556 | 21 (0.0513) | 10 (0.0233) | T G | 37 (0.0905) | 30 (0.0699) | G G | 351 (0.8582) | 389 (0.9068) | |
| | | 0.02979 | 21 (0.0513) | 10 (0.0233) | T G | 37 (0.0905) | 30 (0.0699) | G G | 351 (0.8582) | 389 (0.9068) | |
| | | 0.03083 | 21 (0.0513) | 10 (0.0233) | T G | 37 (0.0905) | 30 (0.0699) | G G | 351 (0.8582) | 389 (0.9068) | |
| | | 0.03607 | 21 (0.0513) | 10 (0.0233) | T G | 37 (0.0905) | 30 (0.0699) | G G | 351 (0.8582) | 389 (0.9068) | |
| hCV8727391 | C17orf81 (rs414206) | 0.01705 | 40 (0.0903) | 63 (0.1394) | G A | 216 (0.4876) | 199 (0.4403) | A A | 187 (0.4221) | 190 (0.4204) | |
| hCV8857351 | RGS7 (rs2341021) | 0.03561 | 101 (0.229) | 78 (0.1726) | T C | 210 (0.4762) | 228 (0.5044) | C C | 130 (0.2948) | 146 (0.323) | |
| hCV8911768 | SERPINC1 (rs941988) | 0.01702 | 7 (0.0159) | 4 (0.0089) | T C | 92 (0.2091) | 69 (0.1533) | C C | 341 (0.775) | 377 (0.8378) | |
| | | 0.02739 | 7 (0.0159) | 4 (0.0089) | T C | 92 (0.2091) | 69 (0.1533) | C C | 341 (0.775) | 377 (0.8378) | |
| hCV8919450 | F5 (rs6017) | 0.00317 | 26 (0.0594) | 31 (0.0692) | G A | 126 (0.2877) | 168 (0.375) | A A | 286 (0.653) | 249 (0.5558) | |
| | | 0.00978 | 26 (0.0594) | 31 (0.0692) | G A | 126 (0.2877) | 168 (0.375) | A A | 286 (0.653) | 249 (0.5558) | |
| hCV8941510 | CDSN (rs1042127) | 0.04988 | 16 (0.0364) | 7 (0.0156) | C A | 118 (0.2682) | 113 (0.2511) | A A | 306 (0.6955) | 330 (0.7333) | |
| hCV9114656 | CFHR5 (rs9427662) | 0.04258 | 5 (0.0113) | 2 (0.0044) | C T | 76 (0.1723) | 60 (0.1325) | T T | 360 (0.8163) | 391 (08631) | |
| hCV9680592 | MIPEP (rs17079372) | 0.03902 | 34 (0.0769) | 23 (0.0508) | A G | 149 (0.3371) | 184 (0.4062) | G G | 259 (0.586) | 246 (0.543) | |
| hDV70683187 | (rs16846561) | 0.02204 | 7 (0.0159) | 4 (0.0089) | G C | 95 (0.2159) | 73 (0.1622) | C C | 338 (0.7682) | 373 (0.8289) | |
| | | 0.03622 | 7 (0.0159) | 4 (0.0089) | G C | 95 (0.2159) | 73 (0.1622) | C C | 338 (0.7682) | 373 (0.8289) | |
| hDV70683212 | RC3H1 (rs16846593) | 0.04442 | 3 (0.0068) | 1 (0.0022) | G C | 72 (0.1633) | 55 (0.1222) | C C | 366 (0.8299) | 394 (0.8756) | |
| hDV70683382 | RABGAP1L (rs16846815) | 0.04002 | 4 (0.0091) | 2 (0.0045) | C G | 59 (0.1338) | 42 (0.094) | G G | 378 (0.8571) | 403 (0.9016) | |
| hDV70965621 | (rs17534243) | 0.0283 | 26 (0.059) | 24 (0.0531) | G A | 173 (0.3923) | 147 (0.3252) | A A | 242 (0.5488) | 281 (0.6217) | |

TABLE 22

Table 22. Unadjusted association of 9 SNPs with DVT in MEGA-1 (p <= 0.05) that have not been tested in LETS

| marker | annot | P-value | parameter | Model | OR (95% CI) | Risk-Allele | NonRisk-Allele |
|---|---|---|---|---|---|---|---|
| hCV11629656 | (rs17284) | 0.000279 | GG + GT_vs_TT | dom | 4.05 (1.9-8.61) | G | T |
| | | 0.000997 | GT_vs_TT | Gen | 5.21 (1.95-13.91) | G | T |
| | | 0.001553 | G_vs_T | add | 2.44 (1.4-4.23) | G | T |
| hCV11629657 | (rs17286) | 0.000274 | AA + AG_vs_GG | dom | 4.06 (1.91-8.63) | A | G |
| | | 0.000984 | AG_vs_GG | Gen | 5.22 (1.95-13.94) | A | G |
| | | 0.001529 | A_vs_G | add | 2.44 (1.41-4.24) | A | G |
| hCV11922386 | MDM2 (rs1846401) | 0.006966 | CT_vs_TT | Gen | 3.34 (1.39-8.02) | C | T |
| | | 0.009319 | CC + CT_vs_TT | dom | 2.73 (1.28-5.81) | C | T |
| | | 0.03014 | C_vs_T | add | 1.96 (1.07-3.59) | C | T |
| hCV1825046 | PROCR (rs2069952) | 0.000399 | T_vs_C | add | 1.21 (1.09-1.34) | T | C |
| | | 0.000746 | TT_vs_CC | Gen | 1.46 (1.17-1.82) | T | C |
| | | 0.00224 | TT_vs_TC + CC | rec | 1.26 (1.08-1.45) | T | C |
| | | 0.006881 | TT + TC_vs_CC | dom | 1.32 (1.08-1.62) | T | C |
| hCV1841974 | (rs1799809) | 0.001032 | GG_vs_GA + AA | rec | 1.34 (1.12-1.59) | G | A |
| | | 0.001263 | GG_vs_AA | Gen | 1.39 (1.14-1.7) | G | A |
| | | 0.002126 | G_vs_A | add | 1.17 (1.06-1.29) | G | A |
| hCV2532034 | F13B (rs6003) | 0.010904 | CT_vs_TT | Gen | 1.28 (1.06-1.55) | C | T |
| | | 0.01363 | CC + CT_vs_TT | dom | 1.26 (1.05-1.52) | C | T |
| | | 0.025493 | C_vs_T | add | 1.21 (1.02-1.44) | C | T |

TABLE 22-continued

Table 22. Unadjusted association of 9 SNPs with DVT in MEGA-1 (p <= 0.05) that have not been tested in LETS

| marker | annot | P-value | Allele (CONTROL frq) | Genot | CASE cnt (CASE frq) | CONTROL cnt (CONTROL frq) | Genot2 |
|---|---|---|---|---|---|---|---|
| hCV25597241 | AQP2 (rs3782320) | 0.046904 | A_vs_G | add | 1.19 (1-1.42) | A | G |
| hCV3170967 | PLEKHA4 (rs556052) | 0.038558 | CC_vs_CG + GG | rec | 1.27 (1.01-1.59) | C | G |
| hDV71075942 | (rs8176719) | 3.47E−31 | G_vs_T | add | 1.9 (1.71-2.12) | G | T |
| | | 3.29E−30 | GG + GT_vs_TT | dom | 2.48 (2.12-2.89) | G | T |
| | | 1.26E−25 | GG_vs_TT | Gen | 3.32 (2.65-4.15) | G | T |
| | | 8.35E−23 | GT_vs_TT | Gen | 2.27 (1.93-2.67) | G | T |
| | | 3.19E−12 | GG_vs_GT + TT | rec | 2.04 (1.67-2.49) | G | T |

| marker | annot | P-value | Allele (CONTROL frq) | Genot | CASE cnt (CASE frq) | CONTROL cnt (CONTROL frq) | Genot2 |
|---|---|---|---|---|---|---|---|
| hCV11629656 | (rs17284) | 0.000279 | G (0.0037) | G G | 8 (0.0059) | 4 (0.0023) | G T |
| | | 0.000997 | G (0.0037) | G G | 8 (0.0059) | 4 (0.0023) | G T |
| | | 0.001553 | G (0.0037) | G G | 8 (0.0059) | 4 (0.0023) | G T |
| hCV11629657 | (rs17286) | 0.000274 | A (0.0037) | A A | 8 (0.0059) | 4 (0.0023) | A G |
| | | 0.000984 | A (0.0037) | A A | 8 (0.0059) | 4 (0.0023) | A G |
| | | 0.001529 | A (0.0037) | A A | 8 (0.0059) | 4 (0.0023) | A G |
| hCV11922386 | MDM2 (rs1846401) | 0.006966 | C (0.0037) | C C | 3 (0.0022) | 3 (0.0017) | C T |
| | | 0.009319 | C (0.0037) | C C | 3 (0.0022) | 3 (0.0017) | C T |
| | | 0.03014 | C (0.0037) | C C | 3 (0.0022) | 3 (0.0017) | C T |
| hCV1825046 | PROCR (rs2069952) | 0.000399 | C (0.4011) | C C | 174 (0.1292) | 288 (0.1641) | C T |
| | | 0.000746 | C (0.4011) | C C | 174 (0.1292) | 288 (0.1641) | C T |
| | | 0.00224 | C (0.4011) | C C | 174 (0.1292) | 288 (0.1641) | C T |
| | | 0.006881 | C (0.4011) | C C | 174 (0.1292) | 288 (0.1641) | C T |
| hCV1841974 | (rs1799809) | 0.001032 | G (0.4338) | G G | 317 (0.2348) | 327 (0.1865) | G A |
| | | 0.001263 | G (0.4338) | G G | 317 (0.2348) | 327 (0.1865) | G A |
| | | 0.002126 | G (0.4338) | G G | 317 (0.2348) | 327 (0.1865) | G A |
| hCV2532034 | F13B (rs6003) | 0.010904 | C (0.0896) | C C | 15 (0.0116) | 20 (0.0118) | C T |
| | | 0.01363 | C (0.0896) | C C | 15 (0.0116) | 20 (0.0118) | C T |
| | | 0.025493 | C (0.0896) | C C | 15 (0.0116) | 20 (0.0118) | C T |
| hCV25597241 | AQP2 (rs3782320) | 0.046904 | A (0.083) | A A | 14 (0.0104) | 13 (0.0074) | A G |
| hCV3170967 | PLEKHA4 (rs556052) | 0.038558 | C (0.3233) | C C | 169 (0.1224) | 173 (0.0991) | C G |
| hDV71075942 | (rs8176719) | 3.47E−31 | G (0.3313) | G G | 272 (0.2022) | 194 (0.1107) | G T |
| | | 3.29E−30 | G (0.3313) | G G | 272 (0.2022) | 194 (0.1107) | G T |
| | | 1.26E−25 | G (0.3313) | G G | 272 (0.2022) | 194 (0.1107) | G T |
| | | 8.35E−23 | G (0.3313) | G G | 272 (0.2022) | 194 (0.1107) | G T |
| | | 3.19E−12 | G (0.3313) | G G | 272 (0.2022) | 194 (0.1107) | G T |

| marker | annot | P-value | CASE cnt (CASE frq)2 | CONTROL cnt (CONTROL frq)2 | Genot3 | CASE cnt (CASE frq3 | CONTROL cnt (CONTROL frq)3 |
|---|---|---|---|---|---|---|---|
| hCV11629656 | (rs17284) | 0.000279 | 20 (0.0146) | 5 (0.0029) | T T | 1339 (0.9795) | 1743 (0.9949) |
| | | 0.000997 | 20 (0.0146) | 5 (0.0029) | T T | 1339 (0.9795) | 1743 (0.9949) |
| | | 0.001553 | 20 (0.0146) | 5 (0.0029) | T T | 1339 (0.9795) | 1743 (0.9949) |
| hCV11629657 | (rs17286) | 0.000274 | 20 (0.0146) | 5 (0.0029) | G G | 1338 (0.9795) | 1745 (0.9949) |
| | | 0.000984 | 20 (0.0146) | 5 (0.0029) | G G | 1338 (0.9795) | 1745 (0.9949) |
| | | 0.001529 | 20 (0.0146) | 5 (0.0029) | G G | 1338 (0.9795) | 1745 (0.9949) |
| hCV11922386 | MDM2 (rs1846401) | 0.006966 | 18 (0.0132) | 7 (0.004) | T T | 1345 (0.9846) | 1747 (0.9943) |
| | | 0.009319 | 18 (0.0132) | 7 (0.004) | T T | 1345 (0.9846) | 1747 (0.9943) |
| | | 0.03014 | 18 (0.0132) | 7 (0.004) | T T | 1345 (0.9846) | 1747 (0.9943) |
| hCV1825046 | PROCR (rs2069952) | 0.000399 | 613 (0.4551) | 832 (0.4741) | T T | 560 (0.4157) | 635 (0.3618) |
| | | 0.000746 | 613 (0.4551) | 832 (0.4741) | T T | 560 (0.4157) | 635 (0.3618) |
| | | 0.00224 | 613 (0.4551) | 832 (0.4741) | T T | 560 (0.4157) | 635 (0.3618) |
| | | 0.006881 | 613 (0.4551) | 832 (0.4741) | T T | 560 (0.4157) | 635 (0.3618) |
| hCV1841974 | (rs1799809) | 0.001032 | 644 (0.477) | 867 (0.4946) | A A | 389 (0.2881) | 559 (0.3189) |
| | | 0.001263 | 644 (0.477) | 867 (0.4946) | A A | 389 (0.2881) | 559 (0.3189) |
| | | 0.002126 | 644 (0.477) | 867 (0.4946) | A A | 389 (0.2881) | 559 (0.3189) |
| hCV2532034 | F13B (rs6003) | 0.010904 | 248 (0.1911) | 265 (0.1557) | T T | 1035 (0.7974) | 1417 (0.8325) |
| | | 0.01363 | 248 (0.1911) | 265 (0.1557) | T T | 1035 (0.7974) | 1417 (0.8325) |
| | | 0.025493 | 248 (0.1911) | 265 (0.1557) | T T | 1035 (0.7974) | 1417 (0.8325) |
| hCV25597241 | AQP2 (rs3782320) | 0.046904 | 235 (0.1743) | 265 (0.1511) | G G | 1099 (0.8153) | 1476 (0.8415) |
| hCV3170967 | PLEKHA4 (rs556052) | 0.038558 | 579 (0.4193) | 783 (0.4485) | G G | 633 (0.4584) | 790 (0.4525) |
| hDV71075942 | (rs8176719) | 3.47E−31 | 741 (0.5509) | 773 (0.4412) | T T | 332 (0.2468) | 785 (0.4481) |
| | | 3.29E−30 | 741 (0.5509) | 773 (0.4412) | T T | 332 (0.2468) | 785 (0.4481) |
| | | 1.26E−25 | 741 (0.5509) | 773 (0.4412) | T T | 332 (0.2468) | 785 (0.4481) |
| | | 8.35E−23 | 741 (0.5509) | 773 (0.4412) | T T | 332 (0.2468) | 785 (0.4481) |
| | | 3.19E−12 | 741 (0.5509) | 773 (0.4412) | T T | 332 (0.2468) | 785 (0.4481) |

TABLE 23

Table 23. Age- and sex-adjusted association of 41 SNPs with DVT in LETS, MEGA-1, and MEGA-2

| Marker | Gene Symbol | RS number | Ref-Allele | NonRef-Allele | Risk Allele | Stratum | Control RAF | Model | Parameter | P-value | OddsRatio | OR95l | OR95u | Genot | Case Count3 | Case Freq3 |
|---|---|---|---|---|---|---|---|---|---|---|---|---|---|---|---|---|
| hCV11503414 | FGG | rs2066865 | G | A | A | LETS | 0.263982 | additive | hCV11503414.AA.AG.adtv | 5E-04 | 1.448 | 1.17734 | 1.780951 | GG | 195 | 0.45 |
| | | | | | | MEGA-1 | 0.274644 | additive | hCV11503414.AA.AG.adtv | 9E-10 | 1.4046 | 1.25977 | 1.566181 | GG | 574 | 0.43 |
| | | | | | | MEGA-2 | 0.260379 | additive | hCV11503414.AA.AG.adtv | 1E-08 | 1.352 | 1.21875 | 1.499831 | GG | 577 | 0.46 |
| hCV11503469 | FGG | rs2066854 | T | A | A | LETS | 0.259382 | additive | hCV11503469.AA.AT.adtv | 2E-04 | 1.4852 | 1.20554 | 1.829853 | TT | 196 | 0.44 |
| | | | | | | MEGA-1 | 0.275242 | additive | hCV11503469.AA.AT.adtv | 7E-10 | 1.402 | 1.25909 | 1.561084 | TT | 593 | 0.43 |
| | | | | | | MEGA-2 | 0.261723 | additive | hCV11503469.AA.AT.adtv | 2E-08 | 1.3459 | 1.21349 | 1.492657 | TT | 577 | 0.46 |
| hCV11503470 | | rs1800788 | C | T | T | LETS | 0.196903 | additive | hCV11503470.TT.TC.adtv | 0.014 | 1.3226 | 1.0586 | 1.652468 | CC | 256 | 0.58 |
| | | | | | | MEGA-1 | 0.216448 | additive | hCV11503470.TT.TC.adtv | 0.008 | 1.1694 | 1.04176 | 1.312675 | CC | 790 | 0.57 |
| | | | | | | MEGA-2 | 0.202849 | additive | hCV11503470.TT.TC.adtv | 2E-04 | 1.236 | 1.10482 | 1.382765 | CC | 731 | 0.58 |
| hCV11975250 | F5 | rs6025 | C | T | T | LETS | 0.015487 | additive | hCV11975250.TT.TC.adtv | 2E-11 | 7.1787 | 4.04207 | 12.7492 | CC | 354 | 0.8 |
| | | | | | | MEGA-1 | 0.027335 | additive | hCV11975250.TT.TC.adtv | 1E-30 | 4.0963 | 3.22255 | 5.207016 | CC | 1120 | 0.8 |
| | | | | | | MEGA-2 | 0.025825 | additive | hCV11975250.TT.TC.adtv | 1E-39 | 4.273 | 3.44263 | 5.30362 | CC | 1029 | 0.81 |
| hCV12066124 | F11 | rs2036914 | C | T | C | LETS | 0.543046 | additive | hCV12066124.TT.TC.adtv | 0.013 | 0.7892 | 0.65464 | 0.951525 | CC | 159 | 0.36 |
| | | | | | | MEGA-1 | 0.521677 | additive | hCV12066124.TT.TC.adtv | 2E-07 | 0.7657 | 0.69212 | 0.846995 | CC | 476 | 0.34 |
| | | | | | | MEGA-2 | 0.51645 | additive | hCV12066124.TT.TC.adtv | 7E-12 | 0.7138 | 0.64823 | 0.786089 | CC | 445 | 0.36 |
| hCV15860433 | | rs2070006 | C | T | T | LETS | 0.401111 | additive | hCV15860433.TT.TC.adtv | 0.024 | 1.241 | 1.02908 | 1.496544 | CC | 135 | 0.31 |
| | | | | | | MEGA-1 | 0.406963 | additive | hCV15860433.TT.TC.adtv | 4E-05 | 1.2352 | 1.11709 | 1.365809 | CC | 405 | 0.29 |
| | | | | | | MEGA-2 | 0.388687 | additive | hCV15860433.TT.TC.adtv | 2E-06 | 1.2603 | 1.14598 | 1.386016 | CC | 390 | 0.31 |
| hCV16180170 | SERPINC1 | rs2227589 | C | T | T | LETS | 0.086283 | additive | hCV16180170.TT.TC.adtv | 0.026 | 1.421 | 1.04306 | 1.935767 | CC | 344 | 0.78 |
| | | | | | | MEGA-1 | 0.089174 | additive | hCV16180170.TT.TC.adtv | 0.009 | 1.2448 | 1.05553 | 1.4679 | CC | 1109 | 0.8 |
| | | | | | | MEGA-2 | 0.095028 | additive | hCV16180170.TT.TC.adtv | 9E-04 | 1.2863 | 1.10835 | 1.49275 | CC | 1001 | 0.77 |
| hCV233148 | KIT3/SDCCAG | rs1417121 | G | C | C | LETS | 0.262693 | additive | hCV233148.CC.CG.adtv | 3E-04 | 1.4537 | 1.18416 | 1.78458 | GG | 191 | 0.43 |
| | | | | | | MEGA-1 | 0.285592 | additive | hCV233148.CC.CG.adtv | 0.001 | 1.1955 | 1.07302 | 1.332 | GG | 652 | 0.47 |
| | | | | | | MEGA-2 | 0.273489 | additive | hCV233148.CC.CG.adtv | 0.018 | 1.1326 | 1.02189 | 1.255409 | GG | 626 | 0.5 |
| hCV25990131 | CYP4V2 | rs13146272 | A | C | A | LETS | 0.649007 | additive | hCV25990131.CC.CA.adtv | 0.048 | 0.8182 | 0.67063 | 0.998308 | AA | 202 | 0.46 |
| | | | | | | MEGA-1 | 0.640046 | additive | hCV25990131.CC.CA.adtv | 0.001 | 0.8434 | 0.75935 | 0.936754 | AA | 648 | 0.46 |
| | | | | | | MEGA-2 | 0.641387 | additive | hCV25990131.CC.CA.adtv | 6E-05 | 0.8101 | 0.73057 | 0.898278 | AA | 561 | 0.48 |
| hCV27474895 | F11 | rs3756011 | C | A | A | LETS | 0.424779 | additive | hCV27474895.AA.AC.adtv | 0.035 | 1.2135 | 1.01344 | 1.452968 | CC | 128 | 0.29 |
| | | | | | | MEGA-1 | 0.418432 | additive | hCV27474895.AA.AC.adtv | 4E-08 | 1.3273 | 1.19988 | 1.468181 | CC | 361 | 0.26 |
| | | | | | | MEGA-2 | 0.396894 | additive | hCV27474895.AA.AC.adtv | 2E-12 | 1.4043 | 1.27743 | 1.543811 | CC | 342 | 0.27 |
| hCV27477533 | F11 | rs3756008 | A | T | T | LETS | 0.415929 | additive | hCV27477533.TT.TA.adtv | 0.031 | 1.2211 | 1.01816 | 1.464466 | AA | 129 | 0.29 |
| | | | | | | MEGA-1 | 0.406625 | additive | hCV27477533.TT.TA.adtv | 9E-07 | 1.286 | 1.16309 | 1.42186 | AA | 397 | 0.28 |
| | | | | | | MEGA-2 | 0.388969 | additive | hCV27477533.TT.TA.adtv | 2E-12 | 1.4088 | 1.28095 | 1.549479 | AA | 346 | 0.28 |
| hCV8241630 | F11 | rs925451 | G | A | A | LETS | 0.40708 | additive | hCV8241630.AA.AG.adtv | 0.046 | 1.2036 | 1.00372 | 1.443218 | GG | 134 | 0.3 |
| | | | | | | MEGA-1 | 0.388794 | additive | hCV8241630.AA.AG.adtv | 4E-08 | 1.3296 | 1.20124 | 1.471753 | GG | 403 | 0.3 |
| | | | | | | MEGA-2 | 0.373285 | additive | hCV8241630.AA.AG.adtv | 1E-11 | 1.3879 | 1.26191 | 1.526573 | GG | 374 | 0.3 |
| hCV8717873 | GP6/RDH13 | rs1613662 | A | G | A | LETS | 0.800221 | additive | hCV8717873.GG.GA.adtv | 0.013 | 0.7329 | 0.57372 | 0.936291 | AA | 316 | 0.71 |
| | | | | | | MEGA-1 | 0.807033 | additive | hCV8717873.GG.GA.adtv | 0.004 | 0.8249 | 0.72386 | 0.940033 | AA | 975 | 0.7 |
| | | | | | | MEGA-2 | 0.822156 | additive | hCV8717873.GG.GA.adtv | 0.031 | 0.8709 | 0.76791 | 0.987716 | AA | 915 | 0.7 |
| hCV8726802 | F2 | rs1799963 | G | A | A | LETS | 0.011111 | additive | hCV8726802.AA.AG.adtv | 0.004 | 2.99 | 1.43284 | 6.239603 | GG | 414 | 0.94 |
| | | | | | | MEGA-1 | 0.010559 | additive | hCV8726802.AA.AG.adtv | 2E-07 | 2.8476 | 1.91526 | 4.233889 | GG | 1301 | 0.94 |
| | | | | | | MEGA-2 | 0.009653 | additive | hCV8726802.AA.AG.adtv | 1E-10 | 3.2096 | 2.25263 | 4.57324 | GG | 1219 | 0.94 |

TABLE 23-continued

Table 23. Age- and sex-adjusted association of 41 SNPs with DVT in LETS, MEGA-1, and MEGA-2

| | | | | | | | | | | | | | |
|---|---|---|---|---|---|---|---|---|---|---|---|---|---|
| hCV8919444 | F5 | rs4524 | T | C | T | LETS | 0.742257 | additive | hCV8919444.CC.CT.adtv | 0.006 | 0.7351 | 0.5915 | 0.913666 | TT | 289 | 0.65 |
| | | | | | | MEGA-1 | 0.744717 | additive | hCV8919444.CC.CT.adtv | 1E-04 | 0.793 | 0.70449 | 0.892524 | TT | 872 | 0.63 |
| | | | | | | MEGA-2 | 0.7332 | additive | hCV8919444.CC.CT.adtv | 6E-07 | 0.7525 | 0.67308 | 0.841315 | TT | 773 | 0.62 |
| hCV15949414 | XYLB | rs2234628 | G | A | G | LETS | 0.94308 | dominant | hCV15949414.GG.dom | 0.036 | 0.6085 | 0.38271 | 0.967377 | GG | 409 | 0.93 |
| | | | | | | MEGA-1 | 0.950371 | dominant | hCV15949414.GG.dom | 0.003 | 0.6754 | 0.51964 | 0.87772 | GG | 1269 | 0.93 |
| | | | | | | MEGA-2 | 0.946416 | dominant | hCV15949414.GG.dom | 0.025 | 0.7617 | 0.6 | 0.966871 | GG | 1152 | 0.92 |
| hCV15968043 | CYP4V2 | rs2292423 | T | A | A | LETS | 0.432671 | dominant | hCV15968043.TT.dom | 0.043 | 1.3422 | 1.00887 | 1.7856 | TT | 122 | 0.28 |
| | | | | | | MEGA-1 | 0.412794 | dominant | hCV15968043.TT.dom | 2E-04 | 1.3378 | 1.14802 | 1.559058 | TT | 395 | 0.29 |
| | | | | | | MEGA-2 | 0.406888 | dominant | hCV15968043.TT.dom | 7E-07 | 1.4572 | 1.25589 | 1.690689 | TT | 330 | 0.27 |
| hCV263841 | NR1I2 | rs1523127 | A | C | C | LETS | 0.331126 | recessive | hCV263841.CC.rec | 2E-04 | 1.9998 | 1.38179 | 2.894094 | AA | 160 | 0.36 |
| | | | | | | MEGA-1 | 0.391106 | recessive | hCV263841.CC.rec | 0.018 | 1.2569 | 1.03941 | 1.52002 | AA | 462 | 0.33 |
| | | | | | | MEGA-2 | 0.379129 | recessive | hCV263841.CC.rec | 0.027 | 1.2241 | 1.02327 | 1.464342 | AA | 480 | 0.37 |
| hCV916107 | RGS7 | rs670659 | C | T | C | LETS | 0.644592 | recessive | hCV916107.TT.rec | 0.048 | 0.6546 | 0.43 | 0.99638 | CC | 216 | 0.49 |
| | | | | | | MEGA-1 | 0.643021 | recessive | hCV916107.TT.rec | 0.012 | 0.755 | 0.60684 | 0.939319 | CC | 622 | 0.45 |
| | | | | | | MEGA-2 | 0.64079 | recessive | hCV916107.TT.rec | 0.021 | 0.778 | 0.62855 | 0.963064 | CC | 548 | 0.42 |
| hCV1841975 | PROC | rs1799810 | A | T | T | LETS | 0.426991 | additive | hCV1841975.TT.TA.adtv | 0.074 | 1.1855 | 0.98365 | 1.428736 | AA | 127 | 0.29 |
| | | | | | | MEGA-1 | 0.435604 | additive | hCV1841975.TT.TA.adtv | 0.01 | 1.1388 | 1.03113 | 1.257773 | AA | 410 | 0.3 |
| | | | | | | MEGA-2 | 0.428546 | additive | hCV1841975.TT.TA.adtv | 7E-04 | 1.1795 | 1.07246 | 1.297319 | AA | 336 | 0.27 |
| hCV25474413 | F11 | rs3822057 | C | A | C | LETS | 0.50883 | additive | hCV25474413.AA.AC.adtv | 0.066 | 0.8427 | 0.70217 | 1.011372 | CC | 138 | 0.31 |
| | | | | | | MEGA-1 | 0.490023 | additive | hCV25474413.AA.AC.adtv | 2E-06 | 0.7817 | 0.70639 | 0.865066 | CC | 406 | 0.3 |
| | | | | | | MEGA-2 | 0.479993 | additive | hCV25474413.AA.AC.adtv | 2E-10 | 0.7357 | 0.66925 | 0.808801 | CC | 391 | 0.31 |
| hCV2892877 | FGA | rs6050 | T | C | C | LETS | 0.249448 | additive | hCV2892877.CC.CT.adtv | 0.058 | 1.2897 | 0.9909 | 1.678671 | TT | 194 | 0.44 |
| | | | | | | MEGA-1 | 0.245709 | additive | hCV2892877.CC.CT.adtv | 7E-07 | 1.4325 | 1.24272 | 1.651308 | TT | 581 | 0.42 |
| | | | | | | MEGA-2 | 0.230097 | additive | hCV2892877.CC.CT.adtv | 2E-04 | 1.3033 | 1.13392 | 1.498055 | TT | 510 | 0.48 |
| hCV3230038 | F11 | rs2289252 | C | T | T | LETS | 0.427938 | additive | hCV3230038.TT.TC.adtv | 0.062 | 1.187 | 0.99174 | 1.420769 | CC | 130 | 0.29 |
| | | | | | | MEGA-1 | 0.41681 | additive | hCV3230038.TT.TC.adtv | 9E-09 | 1.3489 | 1.21786 | 1.493929 | CC | 344 | 0.26 |
| | | | | | | MEGA-2 | 0.395638 | additive | hCV3230038.TT.TC.adtv | 2E-12 | 1.4074 | 1.28018 | 1.547352 | CC | 343 | 0.27 |
| hCV596331 | F9 | rs6048 | A | G | A | LETS | 0.673289 | additive | hCV596331.GG.GA.adtv | 0.026 | 0.8222 | 0.69227 | 0.976638 | AA | 274 | 0.62 |
| | | | | | | MEGA-1 | 0.69609 | additive | hCV596331.GG.GA.adtv | 0.065 | 0.9185 | 0.83911 | 1.005393 | AA | 844 | 0.62 |
| | | | | | | MEGA-2 | 0.699614 | additive | hCV596331.GG.GA.adtv | 0.094 | 0.9302 | 0.85473 | 1.012392 | AA | 797 | 0.61 |
| hCV11786258 | KLKB1 | rs4253303 | G | A | A | LETS | 0.415929 | dominant | hCV11786258.GG.dom | 0.09 | 1.2752 | 0.96283 | 1.688914 | GG | 132 | 0.3 |
| | | | | | | MEGA-1 | 0.39555 | dominant | hCV11786258.GG.dom | 2E-04 | 1.3243 | 1.14055 | 1.537568 | GG | 434 | 0.31 |
| | | | | | | MEGA-2 | 0.392883 | dominant | hCV11786258.GG.dom | 7E-06 | 1.3922 | 1.20483 | 1.608816 | GG | 364 | 0.29 |
| hCV3230096 | CYP4V2 | rs3817184 | C | T | T | LETS | 0.436947 | dominant | hCV3230096.CC.dom | 0.056 | 1.3236 | 0.99247 | 1.765259 | CC | 120 | 0.27 |
| | | | | | | MEGA-1 | 0.416379 | dominant | hCV3230096.CC.dom | 0.002 | 1.2697 | 1.09046 | 1.478413 | CC | 409 | 0.29 |
| | | | | | | MEGA-2 | 0.414836 | dominant | hCV3230096.CC.dom | 6E-06 | 1.4043 | 1.21187 | 1.627272 | CC | 338 | 0.27 |
| hCV11541681 | NAT8B | rs2001490 | G | C | C | LETS | 0.384106 | recessive | hCV11541681.CC.rec | 0.038 | 1.4687 | 1.02118 | 2.112445 | GG | 142 | 0.32 |
| | | | | | | MEGA-1 | 0.370296 | recessive | hCV11541681.CC.rec | 0.046 | 1.2211 | 1.00323 | 1.486365 | GG | 502 | 0.36 |
| | | | | | | MEGA-2 | 0.372281 | recessive | hCV11541681.CC.rec | 0.093 | 1.17 | 0.97407 | 1.405291 | GG | 490 | 0.38 |
| hCV1859855 | GOLGA3/POL | rs2291260 | T | C | C | LETS | 0.193157 | recessive | hCV1859855.CC.rec | 0.234 | 1.4721 | 0.7791 | 2.78168 | TT | 269 | 0.61 |
| | | | | | | MEGA-1 | 0.219714 | recessive | hCV1859855.CC.rec | 2E-04 | 1.8088 | 1.32175 | 2.475445 | TT | 797 | 0.58 |
| | | | | | | MEGA-2 | 0.217825 | recessive | hCV1859855.CC.rec | 0.035 | 1.3716 | 1.0217 | 1.841426 | TT | 743 | 0.58 |
| hCV1874482 | ZDHHC6 | rs2306158 | G | A | G | LETS | 0.603563 | recessive | hCV1874482.AA.rec | 0.029 | 0.6576 | 0.45097 | 0.958845 | GG | 197 | 0.45 |
| | | | | | | MEGA-1 | 0.637435 | recessive | hCV1874482.AA.rec | 0.901 | 0.9863 | 0.79453 | 1.224375 | GG | 570 | 0.41 |
| | | | | | | MEGA-2 | 0.640047 | recessive | hCV1874482.AA.rec | 0.044 | 0.8014 | 0.64583 | 0.994348 | GG | 462 | 0.43 |
| hCV15793897 | KLKB1 | rs3087505 | G | A | G | LETS | 0.899113 | additive | 482.AA.re | 0.172 | 0.7939 | 0.56997 | 1.105919 | GG | 370 | 0.84 |
| | | | | | | MEGA-1 | 0.88683 | additive | hCV15793897.AA.AG.adtv | 0.006 | 0.7891 | 0.66696 | 0.933557 | GG | 1139 | 0.82 |
| | | | | | | MEGA-2 | 0.889009 | additive | hCV15793897.AA.AG.adtv | 9E-04 | 0.7628 | 0.65053 | 0.894335 | GG | 1050 | 0.84 |

TABLE 23-continued

Table 23. Age- and sex-adjusted association of 41 SNPs with DVT in LETS, MEGA-1, and MEGA-2

| Marker | Gene Symbol | RS number | Ref-Allele | NonRef-Allele | Risk Allele | Stratum | | | | | | Genot2 | Case Count2 | Case Freq2 | Control-Count3 | Control-Freq3 | Case Count4 | Control-Count4 | Case Freq4 | Control-Freq4 | | Genot3 | | Case-Count5 | Case Freq5 | Control-Count5 | Control-Freq5 |
|---|---|---|---|---|---|---|---|---|---|---|---|---|---|---|---|---|---|---|---|---|---|---|---|---|---|---|---|
| hCV15871021 | EBF1 | rs2072495 | G | A | A | LETS | 0.591611 | additive | hCV15871021.AA.AG.adtv | 0.142 | 0.8667 | AG | 186 | 0.426 | 235 | 0.5 | 188 | 0.42 | | 0.71601 | 1.049207 | GG | 56 | 0.13 | 181 | 0.41 |
| | | | | | | MEGA-1 | 0.607102 | additive | hCV15871021.AA.AG.adtv | 0.074 | 0.9092 | AG | 608 | 0.451 | 927 | 0.5 | 692 | 0.39 | | 0.81901 | 1.009384 | GG | 166 | 0.12 | 526 | 0.38 |
| | | | | | | MEGA-2 | 0.605159 | additive | hCV15871021.AA.AG.adtv | 0.073 | 0.9144 | AG | 536 | 0.43 | 1499 | 0.5 | 1064 | 0.39 | | 0.82917 | 1.008452 | GG | 134 | 0.11 | 490 | 0.39 |
| hCV22272267 | KLKB1 | rs3733402 | G | A | A | LETS | 0.548673 | additive | hCV22272267.GG.GA.adtv | 0.669 | 0.9604 | AT | 192 | 0.434 | 240 | 0.5 | 191 | 0.42 | | 0.79793 | 1.155992 | AA | 54 | 0.12 | 142 | 0.32 |
| | | | | | | MEGA-1 | 0.509703 | additive | hCV22272267.GG.GA.adtv | 2E-06 | 0.7815 | AT | 624 | 0.449 | 927 | 0.5 | 687 | 0.39 | | 0.70564 | 0.865522 | AA | 174 | 0.13 | 444 | 0.32 |
| | | | | | | MEGA-2 | 0.515971 | additive | hCV22272267.GG.GA.adtv | 4E-06 | 0.7975 | AT | 530 | 0.426 | 1496 | 0.5 | 1070 | 0.39 | | 0.72433 | 0.877967 | AA | 137 | 0.11 | 389 | 0.31 |
| hCV2303891 | APOH | rs1801690 | G | C | C | LETS | 0.948775 | additive | hCV2303891.GG.GC.adtv | 0.043 | 0.6069 | TC | 156 | 0.352 | 291 | 0.6 | 144 | 0.32 | | 0.37388 | 0.984984 | CC | 31 | 0.07 | 411 | 0.94 |
| | | | | | | MEGA-1 | 0.94302 | dominant | hCV2303891.CC.dom | 0.002 | 0.6822 | TC | 512 | 0.369 | 1100 | 0.6 | 544 | 0.31 | | 0.53384 | 0.871787 | CC | 85 | 0.06 | 1285 | 0.92 |
| | | | | | | MEGA-2 | 0.946824 | dominant | hCV2303891.CC.dom | 0.131 | 0.8388 | TC | 445 | 0.355 | 1764 | 0.6 | 893 | 0.32 | | 0.66754 | 1.053943 | CC | 78 | 0.06 | 1140 | 0.91 |
| hCV25620145 | PROCR | rs867186 | A | G | G | LETS | 0.124169 | additive | hCV25620145.GG.GA.adtv | 0.112 | 1.2446 | TC | 78 | 0.177 | 438 | 1 | 14 | 0.03 | | 0.9505 | 1.62976 | AA | 8 | 0.02 | 320 | 0.72 |
| | | | | | | MEGA-1 | 0.122222 | additive | hCV25620145.GG.GA.adtv | 0.012 | 1.2067 | TC | 265 | 0.19 | 1665 | 0.9 | 86 | 0.05 | | 1.04274 | 1.396475 | AA | 13 | 0.01 | 1018 | 0.73 |
| | | | | | | MEGA-2 | 0.12575 | additive | hCV25620145.GG.GA.adtv | 0.068 | 1.1355 | TC | 235 | 0.185 | 2646 | 0.9 | 140 | 0.05 | | 0.99044 | 1.301869 | AA | 8 | 0.01 | 960 | 0.74 |
| hCV8827309 | SUMF1 | rs1110796 | C | T | T | LETS | 0.102876 | additive | hCV8827309.TT.TC.adtv | 0.005 | 1.4964 | | | | | | | | | | 1.12625 | 1.988271 | CC | | | 321 | 0.73 |
| | | | | | | MEGA-1 | 0.12044 | additive | hCV8827309.TT.TC.adtv | 0.04 | 1.1711 | | | | | | | | | | 1.00737 | 1.361357 | CC | | | 1022 | 0.74 |
| | | | | | | MEGA-2 | 0.124954 | recessive | hCV8827309.TT.rec | 0.075 | 1.5107 | | | | | | | | | | 0.95904 | 2.37983 | CC | | | 947 | 0.76 |
| hCV8957432 | RAC2 | rs6572 | G | C | C | LETS | 0.445796 | recessive | hCV8957432.CC.rec | 0.043 | 1.409 | | | | | | | | | | 1.01101 | 1.963723 | GG | | | 117 | 0.27 |
| | | | | | | MEGA-1 | 0.436395 | recessive | hCV8957432.CC.rec | 0.034 | 1.207 | | | | | | | | | | 1.01423 | 1.436506 | GG | | | 405 | 0.29 |
| | | | | | | MEGA-2 | 0.448227 | dominant | hCV8957432.GG.dom | 0.093 | 1.1318 | | | | | | | | | | 0.97954 | 1.307629 | GG | | | 369 | 0.28 |
| hCV2086329 | SPARC | rs4958487 | A | G | A | LETS | 0.555135 | recessive | hCV2086329.GG.rec | 0.045 | 0.8386 | | | | | | | | | | 0.70592 | 0.996203 | AA | | | 394 | 0.31 |
| | | | | | | MEGA-1 | 0.418322 | recessive | hCV2086329.GG.rec | 0.013 | 1.5201 | | | | | | | | | | 1.09176 | 2.116484 | AA | | | 134 | 0.3 |
| | | | | | | MEGA-2 | 0.421848 | recessive | hCV2086329.GG.rec | 0.001 | 1.3419 | | | | | | | | | | 1.12173 | 1.605263 | AA | | | 456 | 0.33 |
| hCV25768636 | $$CDC36/USP1 | rs4279134 | G | A | A | LETS | 0.327051 | recessive | hCV25768636.AA.rec | 0.035 | 1.5294 | | | | | | | | | | 1.02978 | 2.271413 | GG | | | 177 | 0.4 |
| | | | | | | MEGA-1 | 0.344641 | recessive | hCV25768636.AA.rec | 0.037 | 1.256 | | | | | | | | | | 1.01355 | 1.556464 | GG | | | 559 | 0.4 |
| | | | | | | MEGA-2 | 0.644432 | recessive | hCV25768636.AA.rec | 0.042 | 0.8065 | | | | | | | | | | 0.65574 | 0.991971 | GG | | | 581 | 0.46 |
| hCV29821005 | LOC728284 | rs6552970 | C | T | T | LETS | 0.845877 | additive | hCV29821005.TT.TC.adtv | 0.003 | 0.8107 | | | | | | | | | | 0.70689 | 0.929688 | CC | | | 912 | 0.78 |
| | | | | | | MEGA-1 | 0.205556 | additive | hCV29821005.TT.TC.adtv | 0.089 | 1.2192 | | | | | | | | | | 0.97054 | 1.531643 | CC | | | 250 | 0.57 |
| | | | | | | MEGA-2 | 0.194413 | additive | hCV29821005.TT.TC.adtv | 0.025 | 1.1511 | | | | | | | | | | 1.01771 | 1.302014 | CC | | | 820 | 0.61 |
| hCV31199195 | KCTD10 | rs10850234 | A | C | A | LETS | 0.829957 | dominant | hCV31199195.AA.dom | 0.08 | 0.8767 | | | | | | | | | | 0.75671 | 1.015687 | AA | | | 896 | 0.72 |
| | | | | | | MEGA-1 | 0.153422 | dominant | hCV31199195.AA.dom | 0.019 | 1.4068 | | | | | | | | | | 1.05768 | 1.871125 | AA | | | 289 | 0.65 |
| | | | | | | MEGA-2 | 0.168379 | dominant | hCV31199195.AA.dom | 0.045 | 1.1666 | | | | | | | | | | 1.00343 | 1.356282 | AA | | | 913 | 0.66 |
| hCV11975651 | SERPINC1 | rs677 | C | G | T | LETS | 0.890244 | recessive | hCV11975651.GG.rec | 0.048 | 0.274 | | | | | | | | | | 0.07591 | 0.98926 | CC | | | 342 | 0.78 |
| | | | | | | MEGA-2 | 0.873245 | additive | hCV11975651.GG.GC.adtv | 0.041 | 0.8568 | | | | | | | | | | 0.7386 | 0.99401 | CC | | | 990 | 0.79 |
| | | | | | | LETS | 0.109756 | general | hCV11975651.GC | 0.1 | 1.324 | | | | | | | | | | 0.94755 | 1.850018 | CC | | | 342 | 0.78 |
| hCV11975250 | F5 | rs6025 | C | T | T | LETS | | | | | | | | | | | | | | | | | | | | | 0.054 |
| | | | | | | MEGA-1 | | | | | | | | | | | | | | | | | | | | | 0.077 |
| | | | | | | MEGA-2 | | | | | | | | | | | | | | | | | | | | | 0.067 |

TABLE 23-continued

Table 23. Age- and sex-adjusted association of 41 SNPs with DVT in LETS, MEGA-1, and MEGA-2

| | | | | | | | | | | | | | | |
|---|---|---|---|---|---|---|---|---|---|---|---|---|---|---|
| hCV12066124 | F11 | rs2036914 | C | T | C | LETS | 138 | 0.3 | TC | 215 | 0.485 | 216 | 0.48 | TT | 69 | 0.16 | 99 | 0.219 |
| | | | | | | MEGA-1 | 482 | 0.3 | TC | 682 | 0.49 | 865 | 0.49 | TT | 233 | 0.17 | 406 | 0.232 |
| | | | | | | MEGA-2 | 744 | 0.3 | TC | 602 | 0.484 | 1369 | 0.49 | TT | 197 | 0.16 | 653 | 0.236 |
| hCV15860433 | | rs2070006 | C | T | T | LETS | 161 | 0.4 | TC | 211 | 0.478 | 217 | 0.48 | TT | 95 | 0.22 | 72 | 0.16 |
| | | | | | | MEGA-1 | 623 | 0.4 | TC | 689 | 0.496 | 832 | 0.47 | TT | 296 | 0.21 | 297 | 0.17 |
| | | | | | | MEGA-2 | 1042 | 0.4 | TC | 603 | 0.483 | 1288 | 0.47 | TT | 255 | 0.2 | 428 | 0.155 |
| hCV16180170 | SERPINC1 | rs2227589 | C | T | T | LETS | 378 | 0.8 | TC | 93 | 0.21 | 70 | 0.15 | TT | 6 | 0.01 | 4 | 0.009 |
| | | | | | | MEGA-1 | 1457 | 0.8 | TC | 259 | 0.186 | 283 | 0.16 | TT | 22 | 0.02 | 15 | 0.009 |
| | | | | | | MEGA-2 | 2325 | 0.8 | TC | 278 | 0.215 | 483 | 0.17 | TT | 15 | 0.01 | 28 | 0.01 |
| hCV233148 | KT3/SDCCAG | rs1417121 | G | C | C | LETS | 247 | 0.5 | CG | 202 | 0.456 | 174 | 0.38 | CC | 50 | 0.11 | 32 | 0.071 |
| | | | | | | MEGA-1 | 882 | 0.5 | CG | 573 | 0.413 | 745 | 0.42 | CC | 163 | 0.12 | 129 | 0.073 |
| | | | | | | MEGA-2 | 1458 | 0.5 | CG | 494 | 0.396 | 1074 | 0.39 | CC | 126 | 0.1 | 214 | 0.078 |
| hCV25990131 | CYP4V2 | rs13146272 | A | C | A | LETS | 199 | 0.4 | CA | 207 | 0.469 | 190 | 0.42 | CC | 32 | 0.07 | 64 | 0.141 |
| | | | | | | MEGA-1 | 720 | 0.4 | CA | 600 | 0.429 | 804 | 0.46 | CC | 149 | 0.11 | 229 | 0.131 |
| | | | | | | MEGA-2 | 1094 | 0.4 | CA | 478 | 0.412 | 1178 | 0.45 | CC | 121 | 0.1 | 352 | 0.134 |
| hCV27474895 | F11 | rs3756011 | C | A | A | LETS | 160 | 0.4 | AC | 208 | 0.47 | 200 | 0.44 | AA | 107 | 0.24 | 92 | 0.204 |
| | | | | | | MEGA-1 | 597 | 0.3 | AC | 692 | 0.502 | 838 | 0.48 | AA | 326 | 0.24 | 312 | 0.179 |
| | | | | | | MEGA-2 | 1022 | 0.4 | AC | 612 | 0.489 | 1296 | 0.47 | AA | 297 | 0.24 | 451 | 0.163 |
| hCV27477533 | F11 | rs3756008 | A | T | T | LETS | 164 | 0.4 | TA | 212 | 0.48 | 200 | 0.44 | TT | 101 | 0.23 | 88 | 0.195 |
| | | | | | | MEGA-1 | 623 | 0.4 | TA | 691 | 0.495 | 832 | 0.48 | TT | 307 | 0.22 | 296 | 0.169 |
| | | | | | | MEGA-2 | 1048 | 0.4 | TA | 619 | 0.496 | 1283 | 0.46 | TT | 282 | 0.23 | 434 | 0.157 |
| hCV8241630 | F11 | rs925451 | G | A | A | LETS | 171 | 0.4 | AG | 212 | 0.481 | 194 | 0.43 | AA | 95 | 0.22 | 87 | 0.192 |
| | | | | | | MEGA-1 | 661 | 0.4 | AG | 666 | 0.49 | 816 | 0.47 | AA | 289 | 0.21 | 272 | 0.156 |
| | | | | | | MEGA-2 | 1107 | 0.4 | AG | 622 | 0.496 | 1258 | 0.45 | AA | 259 | 0.21 | 405 | 0.146 |
| hCV817873 | GP6/RDH13 | rs1613662 | A | G | A | LETS | 291 | 0.6 | GA | 117 | 0.264 | 143 | 0.32 | GG | 10 | 0.02 | 19 | 0.042 |
| | | | | | | MEGA-1 | 1135 | 0.6 | GA | 368 | 0.265 | 553 | 0.32 | GG | 45 | 0.03 | 61 | 0.035 |
| | | | | | | MEGA-2 | 1924 | 0.7 | GA | 355 | 0.273 | 835 | 0.29 | GG | 29 | 0.02 | 89 | 0.031 |
| hCV8726802 | F2 | rs1799963 | G | A | A | LETS | 440 | 1 | AG | 28 | 0.063 | 10 | 0.02 | AA | 0 | 0 | 0 | 0 |
| | | | | | | MEGA-1 | 1715 | 1 | AG | 80 | 0.058 | 37 | 0.02 | AA | 0 | 0 | 0 | 0 |
| | | | | | | MEGA-2 | 2794 | 1 | AG | 76 | 0.059 | 55 | 0.02 | AA | 0 | 0 | 0 | 0 |
| hCV8919444 | F5 | rs4524 | T | C | T | LETS | 251 | 0.6 | CT | 130 | 0.293 | 169 | 0.37 | CC | 24 | 0.05 | 32 | 0.071 |
| | | | | | | MEGA-1 | 964 | 0.6 | CT | 440 | 0.317 | 680 | 0.39 | CC | 76 | 0.05 | 107 | 0.061 |
| | | | | | | MEGA-2 | 1502 | 0.5 | CT | 415 | 0.333 | 1033 | 0.38 | CC | 59 | 0.05 | 218 | 0.079 |
| hCV15949414 | XYLB | rs2234628 | G | A | G | LETS | 397 | 0.9 | AG | 31 | 0.07 | 51 | 0.11 | AA | 1 | 0 | 0 | 0 |
| | | | | | | MEGA-1 | 1580 | 0.9 | AG | 89 | 0.065 | 172 | 0.1 | AA | 5 | 0 | 1 | 6E-04 |
| | | | | | | MEGA-2 | 2479 | 0.9 | AG | 98 | 0.078 | 270 | 0.1 | AA | 2 | 0 | 13 | 0.005 |
| hCV15968043 | CYP4V2 | rs2292423 | T | A | A | LETS | 153 | 0.3 | AT | 224 | 0.506 | 208 | 0.46 | AA | 97 | 0.22 | 92 | 0.203 |
| | | | | | | MEGA-1 | 604 | 0.3 | AT | 698 | 0.504 | 839 | 0.48 | AA | 292 | 0.21 | 300 | 0.172 |
| | | | | | | MEGA-2 | 958 | 0.3 | AT | 632 | 0.515 | 1339 | 0.49 | AA | 264 | 0.22 | 447 | 0.163 |
| hCV263841 | NR1I2 | rs1523127 | A | C | C | LETS | 205 | 0.5 | CA | 191 | 0.432 | 196 | 0.43 | CC | 91 | 0.21 | 52 | 0.115 |
| | | | | | | MEGA-1 | 643 | 0.4 | CA | 684 | 0.49 | 850 | 0.48 | CC | 250 | 0.18 | 261 | 0.149 |
| | | | | | | MEGA-2 | 1097 | 0.4 | CA | 598 | 0.461 | 1340 | 0.47 | CC | 220 | 0.17 | 409 | 0.144 |
| hCV916107 | RGS7 | rs670659 | C | T | C | LETS | 192 | 0.4 | TC | 185 | 0.419 | 200 | 0.44 | TT | 41 | 0.09 | 61 | 0.135 |
| | | | | | | MEGA-1 | 738 | 0.4 | TC | 620 | 0.446 | 772 | 0.44 | TT | 149 | 0.11 | 238 | 0.136 |
| | | | | | | MEGA-2 | 1153 | 0.3 | TC | 615 | 0.476 | 1326 | 0.47 | TT | 129 | 0.1 | 355 | 0.125 |
| hCV1841975 | PROC | rs1799810 | A | T | T | LETS | 147 | 0.3 | TA | 215 | 0.486 | 224 | 0.5 | TT | 100 | 0.23 | 81 | 0.179 |
| | | | | | | MEGA-1 | 554 | 0.3 | TA | 655 | 0.472 | 864 | 0.49 | TT | 323 | 0.23 | 329 | 0.188 |
| | | | | | | MEGA-2 | 918 | 0.3 | TA | 654 | 0.524 | 1331 | 0.48 | TT | 259 | 0.21 | 522 | 0.188 |

TABLE 23-continued

Table 23. Age- and sex-adjusted association of 41 SNPs with DVT in LETS, MEGA-1, and MEGA-2

| | | | | | | | | | | | | | | | |
|---|---|---|---|---|---|---|---|---|---|---|---|---|---|---|---|
| hCV25474413 | F11 | rs3822057 | C | A | C | LETS | 124 | 0.3 | AC | 214 | 0.483 | 213 | 0.47 | AA | 91 | 0.21 | 116 | 0.256 |
| | | | | | | MEGA-1 | 422 | 0.2 | AC | 690 | 0.505 | 875 | 0.5 | AA | 269 | 0.2 | 457 | 0.261 |
| | | | | | | MEGA-2 | 650 | 0.2 | AC | 617 | 0.492 | 1363 | 0.49 | AA | 247 | 0.2 | 761 | 0.274 |
| hCV2892877 | FGA | rs6050 | T | C | C | LETS | 227 | 0.5 | CT | 249 | 0.562 | 226 | 0.5 | CC | 0 | 0 | 0 | 0 |
| | | | | | | MEGA-1 | 889 | 0.5 | CT | 807 | 0.581 | 859 | 0.49 | CC | 0 | 0 | 0 | 0 |
| | | | | | | MEGA-2 | 1348 | 0.5 | CT | 554 | 0.517 | 1095 | 0.44 | CC | 7 | 0.01 | 19 | 0.008 |
| hCV3230038 | F11 | rs2289252 | C | T | T | LETS | 158 | 0.4 | TC | 204 | 0.463 | 200 | 0.44 | TT | 107 | 0.24 | 93 | 0.206 |
| | | | | | | MEGA-1 | 600 | 0.3 | TC | 689 | 0.512 | 840 | 0.48 | TT | 314 | 0.23 | 309 | 0.177 |
| | | | | | | MEGA-2 | 1026 | 0.4 | TC | 618 | 0.492 | 1301 | 0.47 | TT | 295 | 0.23 | 447 | 0.161 |
| hCV596331 | F9 | rs6048 | A | G | A | LETS | 244 | 0.5 | GA | 99 | 0.223 | 122 | 0.27 | GG | 70 | 0.16 | 87 | 0.192 |
| | | | | | | MEGA-1 | 1037 | 0.6 | GA | 295 | 0.215 | 347 | 0.2 | GG | 233 | 0.17 | 355 | 0.204 |
| | | | | | | MEGA-2 | 1682 | 0.6 | GA | 278 | 0.214 | 621 | 0.22 | GG | 222 | 0.17 | 545 | 0.191 |
| hCV11786258 | KLKB1 | rs4253303 | G | A | A | LETS | 159 | 0.4 | AG | 227 | 0.514 | 210 | 0.46 | AA | 83 | 0.19 | 83 | 0.184 |
| | | | | | | MEGA-1 | 655 | 0.4 | AG | 686 | 0.493 | 815 | 0.47 | AA | 271 | 0.19 | 282 | 0.161 |
| | | | | | | MEGA-2 | 1007 | 0.4 | AG | 628 | 0.503 | 1347 | 0.49 | AA | 257 | 0.21 | 414 | 0.15 |
| hCV3230096 | CYP4V2 | rs3817184 | C | T | T | LETS | 149 | 0.3 | TC | 227 | 0.514 | 211 | 0.47 | TT | 95 | 0.21 | 92 | 0.204 |
| | | | | | | MEGA-1 | 600 | 0.3 | TC | 680 | 0.489 | 831 | 0.48 | TT | 301 | 0.22 | 309 | 0.178 |
| | | | | | | MEGA-2 | 946 | 0.3 | TC | 636 | 0.506 | 1358 | 0.49 | TT | 282 | 0.22 | 473 | 0.17 |
| hCV11541681 | NAT8B | rs2001490 | G | C | C | LETS | 165 | 0.4 | CG | 220 | 0.497 | 228 | 0.5 | CC | 81 | 0.18 | 60 | 0.132 |
| | | | | | | MEGA-1 | 697 | 0.4 | CG | 662 | 0.476 | 815 | 0.46 | CC | 228 | 0.16 | 242 | 0.138 |
| | | | | | | MEGA-2 | 1122 | 0.4 | CG | 603 | 0.465 | 1334 | 0.47 | CC | 205 | 0.16 | 394 | 0.138 |
| hCV1859855 | GOLGA3/POL | rs2291260 | T | C | C | LETS | 295 | 0.7 | CT | 148 | 0.336 | 141 | 0.31 | CC | 24 | 0.05 | 17 | 0.038 |
| | | | | | | MEGA-1 | 1052 | 0.6 | CT | 485 | 0.351 | 627 | 0.36 | CC | 99 | 0.07 | 71 | 0.041 |
| | | | | | | MEGA-2 | 1705 | 0.6 | CT | 469 | 0.364 | 978 | 0.35 | CC | 76 | 0.06 | 122 | 0.043 |
| hCV174482 | ZDHHC6 | rs2306158 | G | A | G | LETS | 171 | 0.4 | AG | 187 | 0.428 | 200 | 0.45 | AA | 53 | 0.12 | 78 | 0.174 |
| | | | | | | MEGA-1 | 692 | 0.4 | AG | 641 | 0.465 | 833 | 0.48 | AA | 167 | 0.12 | 214 | 0.123 |
| | | | | | | MEGA-2 | 921 | 0.4 | AG | 485 | 0.448 | 891 | 0.42 | AA | 135 | 0.12 | 323 | 0.151 |
| hCV15793897 | KLKB1 | rs3087505 | G | A | A | LETS | 363 | 0.8 | AG | 71 | 0.161 | 85 | 0.19 | AA | 1 | 0 | 3 | 0.007 |
| | | | | | | MEGA-1 | 1379 | 0.8 | AG | 246 | 0.177 | 353 | 0.2 | AA | 5 | 0 | 22 | 0.013 |
| | | | | | | MEGA-2 | 2206 | 0.8 | AG | 193 | 0.154 | 506 | 0.18 | AA | 11 | 0.01 | 54 | 0.02 |
| hCV15871021 | EBF1 | rs2072495 | G | A | G | LETS | 149 | 0.3 | AG | 191 | 0.432 | 238 | 0.53 | AA | 70 | 0.16 | 66 | 0.146 |
| | | | | | | MEGA-1 | 643 | 0.4 | AG | 699 | 0.502 | 834 | 0.48 | AA | 168 | 0.12 | 269 | 0.154 |
| | | | | | | MEGA-2 | 1004 | 0.4 | AG | 592 | 0.471 | 1347 | 0.49 | AA | 174 | 0.14 | 421 | 0.152 |
| hCV22272267 | KLKB1 | rs3733402 | A | G | A | LETS | 135 | 0.3 | GA | 210 | 0.475 | 226 | 0.5 | GG | 90 | 0.2 | 91 | 0.201 |
| | | | | | | MEGA-1 | 437 | 0.2 | GA | 692 | 0.498 | 912 | 0.52 | GG | 254 | 0.18 | 403 | 0.23 |
| | | | | | | MEGA-2 | 741 | 0.3 | GA | 638 | 0.515 | 1361 | 0.49 | GG | 212 | 0.17 | 653 | 0.237 |
| hCV2303891 | APOH | rs1801690 | C | C | C | LETS | 404 | 0.9 | GC | 28 | 0.064 | 44 | 0.1 | GG | 0 | 0 | 1 | 0.002 |
| | | | | | | MEGA-1 | 1559 | 0.9 | GC | 106 | 0.076 | 192 | 0.11 | GG | 4 | 0 | 4 | 0.002 |
| | | | | | | MEGA-2 | 2464 | 0.9 | GC | 109 | 0.087 | 289 | 0.1 | GG | 2 | 0 | 8 | 7E-04 |
| hCV25620145 | PROCR | rs867186 | A | G | G | LETS | 347 | 0.8 | GA | 113 | 0.255 | 96 | 0.21 | GG | 10 | 0.02 | 8 | 0.018 |
| | | | | | | MEGA-1 | 1354 | 0.8 | GA | 340 | 0.245 | 373 | 0.21 | GG | 30 | 0.02 | 28 | 0.016 |
| | | | | | | MEGA-2 | 2160 | 0.8 | GA | 310 | 0.239 | 637 | 0.22 | GG | 27 | 0.02 | 38 | 0.013 |
| hCV8827309 | SUMF1 | rs1110796 | C | T | T | LETS | 364 | 0.8 | TC | 107 | 0.244 | 83 | 0.18 | TT | 11 | 0.03 | 5 | 0.011 |
| | | | | | | MEGA-1 | 1335 | 0.8 | TC | 339 | 0.245 | 368 | 0.21 | TT | 21 | 0.02 | 24 | 0.014 |
| | | | | | | MEGA-2 | 2103 | 0.8 | TC | 266 | 0.214 | 591 | 0.22 | TT | 32 | 0.03 | 47 | 0.017 |
| hCV895743 | RAC2 | rs6572 | G | C | C | LETS | 126 | 0.3 | CG | 225 | 0.51 | 249 | 0.55 | CC | 99 | 0.22 | 77 | 0.17 |
| | | | | | | MEGA-1 | 557 | 0.3 | CG | 676 | 0.487 | 862 | 0.49 | CC | 308 | 0.22 | 334 | 0.191 |
| | | | | | | MEGA-2 | 882 | 0.3 | CG | 665 | 0.512 | 1380 | 0.48 | CC | 265 | 0.2 | 587 | 0.206 |

TABLE 23-continued

Table 23. Age- and sex-adjusted association of 41 SNPs with DVT in LETS, MEGA-1, and MEGA-2

| | Gene | rs# | A1 | A2 | A3 | A4 | Study | | | | | | | | | | | |
|---|---|---|---|---|---|---|---|---|---|---|---|---|---|---|---|---|---|---|
| hCV2086329 | SPARC | rs4958487 | A | G | A | G | MEGA-2 | 870 | 0.3 | GA | 641 | 0.51 | 1341 | 0.48 | GG | 221 | 0.18 | 564 | 0.203 |
| | | | | | | | LETS | 150 | 0.3 | GA | 205 | 0.463 | 227 | 0.5 | GG | 104 | 0.23 | 76 | 0.168 |
| | | | | | | | MEGA-1 | 570 | 0.3 | GA | 631 | 0.456 | 887 | 0.51 | GG | 298 | 0.22 | 296 | 0.169 |
| hCV25768636 | S$CDC36/USP1 | rs4279134 | G | A | A | | LETS | 204 | 0.5 | AG | 197 | 0.446 | 199 | 0.44 | AA | 68 | 0.15 | 48 | 0.106 |
| | | | | | G | | MEGA-1 | 739 | 0.4 | AG | 639 | 0.461 | 821 | 0.47 | AA | 188 | 0.14 | 194 | 0.111 |
| | | | | | | | MEGA-2 | 1171 | 0.4 | AG | 535 | 0.426 | 1223 | 0.44 | AA | 140 | 0.11 | 372 | 0.134 |
| hCV29821005 | LOC728284 | rs6552970 | C | T | C | T | MEGA-2 | 1919 | 0.7 | TC | 220 | 0.188 | 635 | 0.24 | TT | 38 | 0.03 | 90 | 0.034 |
| | | | | | | | LETS | 284 | 0.6 | TC | 170 | 0.386 | 147 | 0.33 | TT | 20 | 0.05 | 19 | 0.042 |
| | | | | | | | MEGA-1 | 1149 | 0.7 | TC | 463 | 0.344 | 528 | 0.3 | TT | 62 | 0.05 | 77 | 0.044 |
| hCV31199195 | KCTD10 | rs10850234 | A | C | A | C | MEGA-2 | 1905 | 0.7 | CA | 321 | 0.257 | 778 | 0.28 | CC | 33 | 0.03 | 81 | 0.029 |
| | | | | | | | LETS | 328 | 0.7 | CA | 142 | 0.321 | 111 | 0.25 | CC | 12 | 0.03 | 14 | 0.031 |
| | | | | | | | MEGA-1 | 1214 | 0.7 | CA | 423 | 0.305 | 486 | 0.28 | CC | 52 | 0.04 | 52 | 0.03 |
| hCV11975651 | SERPINC1 | rs677 | C | G | C | | LETS | 363 | 0.8 | GC | 96 | 0.218 | 77 | 0.17 | GG | 3 | 0.01 | 11 | 0.024 |
| | | | | | C | | MEGA-2 | 2115 | 0.8 | GC | 252 | 0.201 | 620 | 0.22 | GG | 13 | 0.01 | 42 | 0.015 |
| | | | | | G | | LETS | 363 | 0.8 | GC | 96 | 0.218 | 77 | 0.17 | GG | 3 | 0.01 | 11 | 0.024 |

TABLE 25

Table 25. Age- and sex-adjusted association of 52 SNPs with isolated PE in MEGA (p <= 0.05)

| Marker | Gene Symbol | RS number | Ref-Allele | NonRef-Allele | Risk Allele | Control RAF | Model | Parameter | P-value | OddsRatio | OR95l | OR95u | Genot | Case Count3 | Case-Freq3 | Control-Count3 |
|---|---|---|---|---|---|---|---|---|---|---|---|---|---|---|---|---|
| hCV11503414 | FGG | rs2066865 | G | A | A | 0.265941 | general | hCV11503414.AA | 7.9E-07 | 1.7644 | 1.40836 | 2.21043 | GG | 548 | 0.4656 | 2426 |
| | | | | | | | recessive | hCV11503414.AA.rec | 2.65E-05 | 1.5897 | 1.28058 | 1.97356 | GG | 548 | 0.4656 | 2426 |
| | | | | | | | dominant | hCV11503414.GG.dom | 9.06E-06 | 1.3387 | 1.17692 | 1.5228 | GG | 548 | 0.4656 | 2426 |
| | | | | | | | additiive | hCV11503414.AA.AG.adtv | 1.38E-07 | 1.3027 | 1.18064 | 1.43736 | GG | 548 | 0.4656 | 2426 |
| hCV11503469 | FGG | rs2066854 | T | A | A | 0.266985 | general | hCV11503469.AG | 0.000825 | 1.2612 | 1.1008 | 1.44487 | GG | 548 | 0.4656 | 2426 |
| | | | | | | | | hCV11503469.AA | 2.7E-06 | 1.7154 | 1.36923 | 2.14908 | TT | 551 | 0.4677 | 2423 |
| | | | | | | | recessive | hCV11503469.AA.rec | 6.76E-05 | 1.5525 | 1.25045 | 1.92746 | TT | 551 | 0.4677 | 2423 |
| | | | | | | | dominant | hCV11503469.TT.dom | 2.15E-05 | 1.3219 | 1.16224 | 1.50354 | TT | 551 | 0.4677 | 2423 |
| | | | | | | | additive | hCV11503469.AA.AT.adtv | 5E-07 | 1.2867 | 1.16622 | 1.41954 | TT | 551 | 0.4677 | 2423 |
| hCV11503470 | | rs1800788 | C | T | T | 0.208112 | general | hCV11503470.AT | 0.001332 | 1.2492 | 1.09047 | 1.43109 | TT | 551 | 0.4677 | 2423 |
| | | | | | | | | hCV11503470.TC | 0.003347 | 1.2266 | 1.07016 | 1.40596 | CC | 693 | 0.5868 | 2864 |
| | | | | | | | recessive | hCV11503470.CC.dom | 0.003532 | 1.2149 | 1.06597 | 1.38472 | CC | 693 | 0.5868 | 2864 |
| | | | | | | | additive | hCV11503470.TT.TC.adtv | 0.010682 | 1.1492 | 1.03283 | 1.2787 | CC | 693 | 0.5868 | 2864 |
| hCV11786258 | KLKB1 | rs4253303 | G | A | A | 0.393142 | general | hCV11786258.AA | 0.041072 | 1.2175 | 1.00801 | 1.47061 | GG | 410 | 0.348 | 1662 |
| | | | | | | | recessive | hCV11786258.AA.rec | 0.048475 | 1.1868 | 1.00115 | 1.40687 | GG | 410 | 0.348 | 1662 |
| hCV11975250 | F5 | rs6025 | C | T | T | 0.026408 | dominant | hCV11975250.CC.dom | 9.91E-08 | 1.9003 | 1.50059 | 2.4065 | CC | 1084 | 0.9071 | 4311 |
| | | | | | | | general | hCV11975250.TC | 2.06E-07 | 1.8887 | 1.48577 | 2.40092 | CC | 1084 | 0.9071 | 4311 |
| | | | | | | | additive | hCV11975250.TT.TC.adtv | 1.25E-07 | 1.8329 | 1.46414 | 2.29465 | CC | 1084 | 0.9071 | 4311 |
| hCV1202883 | MTHFR | rs1801133 | G | A | G | 0.69837 | general | hCV1202883.AA | 0.025299 | 0.7168 | 0.53542 | 0.95963 | GG | 582 | 0.4818 | 2132 |
| | | | | | | | recessive | hCV1202883.AA.rec | 0.031062 | 0.7312 | 0.55017 | 0.97191 | GG | 582 | 0.4818 | 2132 |
| hCV12066124 | F11 | rs2036914 | C | T | C | 0.518478 | general | hCV12066124.TT | 0.00048 | 0.6059 | 0.6544 | 0.8687 | CC | 389 | 0.3316 | 1226 |
| | | | | | | | dominant | hCV12066124.CC.dom | 4.11E-05 | 0.7487 | 0.65205 | 0.85979 | CC | 389 | 0.3316 | 1226 |
| | | | | | | | additive | hCV12066124.TC | 0.000273 | 0.7598 | 0.65525 | 0.88093 | CC | 389 | 0.3316 | 1226 |
| hCV12092542 | CASP5 | rs507879 | T | C | T | 0.548201 | recessive | hCV12066124.TT.TC.adtv | 0.000208 | 0.8423 | 0.76928 | 0.92226 | CC | 389 | 0.3316 | 1226 |
| | | | | | | | general | hCV12092542.CC.rec | 0.006664 | 0.7876 | 0.66284 | 0.93587 | TT | 353 | 0.3046 | 1170 |
| | | | | | | | | hCV12092542.CC | 0.03597 | 0.8101 | 0.66544 | 0.98631 | TT | 353 | 0.3046 | 1170 |
| hCV15860433 | | rs2070006 | C | T | T | 0.395787 | general | hCV15860433.TT | 0.001749 | 1.3524 | 1.11945 | 1.63385 | CC | 369 | 0.314 | 1665 |
| | | | | | | | dominant | hCV15860433.CC.dom | 0.0005 | 1.2764 | 1.11253 | 1.46444 | CC | 369 | 0.314 | 1665 |
| | | | | | | | recessive | hCV15860433.TC | 0.002575 | 1.2504 | 1.08131 | 1.44596 | CC | 369 | 0.314 | 1665 |
| | | | | | | | | hCV15860433.TT.rec | 0.045925 | 1.1859 | 1.00309 | 1.40199 | CC | 369 | 0.314 | 1665 |
| | | | | | | | additive | hCV15860433.TT.TC.adtv | 0.000548 | 1.1753 | 1.07241 | 1.28797 | CC | 369 | 0.314 | 1665 |
| hCV15949414 | XYLB | rs2234628 | G | A | G | 0.947951 | general | hCV15949414.AG | 0.01515 | 0.744 | 0.58608 | 0.94452 | GG | 1087 | 0.9204 | 4059 |
| | | | | | | | dominant | hCV15949414.GG.dom | 0.027067 | 0.7696 | 0.6102 | 0.97075 | GG | 1087 | 0.9204 | 4059 |
| hCV15968043 | CYP4V2 | rs2292423 | T | A | A | 0.409182 | general | hCV15968043.AA | 0.036009 | 1.2214 | 1.01314 | 1.47241 | TT | 383 | 0.329 | 1562 |
| | | | | | | | recessive | hCV15968043.AA.rec | 0.040079 | 1.1899 | 1.0079 | 1.40466 | TT | 383 | 0.329 | 1562 |
| hCV16180170 | SERPINC1 | rs2227589 | C | T | T | 0.09279 | general | hCV16180170.TT | 0.024575 | 1.8494 | 1.08198 | 3.16127 | CC | 941 | 0.7842 | 3782 |
| | | | | | | | recessive | hCV16180170.TT.rec | 0.035841 | 1.7737 | 1.03862 | 3.02895 | CC | 941 | 0.7842 | 3782 |
| | | | | | | | dominant | hCV16180170.CC.dom | 0.001751 | 1.2856 | 1.09842 | 1.5046 | CC | 941 | 0.7842 | 3782 |
| | | | | | | | additive | hCV16180170.TT.TC.adtv | 0.000708 | 1.2794 | 1.10936 | 1.47544 | CC | 941 | 0.7842 | 3782 |
| hCV1842260 | LOC642043 | rs2281390 | G | T | T | 0.171422 | general | hCV1842260.TG | 0.006258 | 1.2536 | 1.06609 | 1.4742 | GG | 796 | 0.6589 | 3177 |
| | | | | | | | dominant | hCV1842260.GG.dom | 0.02393 | 1.1745 | 1.02147 | 1.35049 | GG | 796 | 0.6589 | 3177 |
| hCV1859855 | GOLGA3/POLE | rs2291260 | T | C | C | 0.218551 | recessive | hCV1859855.CC | 0.03773 | 1.1535 | 1.00813 | 1.31976 | TT | 742 | 0.622 | 2757 |
| | | | | | | | general | hCV1859855.CC | 0.000395 | 1.6269 | 1.24298 | 2.12951 | TT | 742 | 0.622 | 2757 |
| | | | | | | | | hCV1859855.CT | 0.001859 | 1.5434 | 1.17426 | 2.02848 | TT | 742 | 0.622 | 2757 |
| | | | | | | | general | | 0.034049 | 0.8603 | 0.74856 | 0.98874 | TT | 742 | 0.622 | 2757 |

TABLE 25-continued

Table 25. Age- and sex-adjusted association of 52 SNPs with isolated PE in MEGA (p <= 0.05)

| | | | | | | | | | | | | | |
|---|---|---|---|---|---|---|---|---|---|---|---|---|---|
| hCV2103346 | DKFZP564J102 | rs11733307 | T | C | C | 0.441711 | additive | hCV2103346.CC.CT.adtv | 0.043311 | 1.0967 | 1.00278 | 1.19951 | TT | 343 | 0.2917 | 1450 |
| hCV22272267 | KLKB1 | rs3733402 | A | G | A | 0.513535 | general | hCV22272267.GA | 3.14E-05 | 0.7277 | 0.62658 | 0.84518 | AA | 378 | 0.3206 | 1178 |
| | | | | | | | dominant | hCV22272267.AA.dom | 4.55E-05 | 0.7483 | 0.65098 | 0.86023 | AA | 378 | 0.3206 | 1178 |
| | | | | | | | additive | hCV22272267.GG | 0.010202 | 0.7927 | 0.66394 | 0.94642 | AA | 378 | 0.3206 | 1178 |
| | | | | | | | | hCV22272267.GG.GA.adtv | 0.004727 | 0.8775 | 0.80143 | 0.96077 | GG | 585 | 0.497 | 2340 |
| hCV233148 | AKT3/SDCCAG8 | rs1417121 | G | C | C | 0.27821 | general | hCV233148.CC | 0.027568 | 1.2973 | 1.02917 | 1.6352 | GG | 585 | 0.497 | 2340 |
| | | | | | | | recessive | hCV233148.CC.rec | 0.036974 | 1.2684 | 1.01448 | 1.58595 | AA | 273 | 0.2312 | 1218 |
| hCV25474413 | F11 | rs3822057 | A | C | C | 0.483878 | general | hCV25474413.CC | 0.000165 | 1.4124 | 1.18018 | 1.6902 | AA | 273 | 0.2312 | 1218 |
| | | | | | | | recessive | hCV25474413.CC.rec | 0.000395 | 1.2968 | 1.12318 | 1.49737 | AA | 273 | 0.2312 | 1218 |
| | | | | | | | dominant | hCV25474413.AA.dom | 0.007883 | 1.2264 | 1.055 | 1.42566 | AA | 273 | 0.2312 | 1218 |
| | | | | | | | additive | hCV25474413.CC.CA.adtv | 0.000155 | 1.1902 | 1.08754 | 1.30266 | AA | 273 | 0.2312 | 1218 |
| hCV25615302 | CUEDC1 | rs17762338 | C | T | T | 0.178556 | general | hCV25615302.TC | 0.01558 | 1.1856 | 1.03281 | 1.36102 | CC | 774 | 0.645 | 3107 |
| | | | | | | | dominant | hCV25615302.CC.dom | 0.032234 | 1.1572 | 1.01246 | 1.32268 | CC | 774 | 0.645 | 3107 |
| hCV25620145 | PROCR | rs867186 | A | G | G | 0.124401 | additive | hCV25620145.GG.GA.adtv | 0.013407 | 1.179 | 1.03473 | 1.34333 | AA | 884 | 0.7354 | 3514 |
| | | | | | | | dominant | hCV25620145.AA.dom | 0.026984 | 1.1783 | 1.01886 | 1.36277 | AA | 884 | 0.7354 | 3514 |
| hCV25748719 | NAP5 | NONE | C | T | C | 0.7673 | general | hCV25748719.TT | 0.033944 | 0.705 | 0.51043 | 0.97385 | CC | 738 | 0.6165 | 2693 |
| | | | | | | | additive | hCV25748719.TT.TC.adtv | 0.021016 | 0.8782 | 0.78644 | 0.98061 | CC | 738 | 0.6165 | 2693 |
| hCV25768636 | CCDC36/USP19 | rs4279134 | G | A | G | 0.648673 | recessive | hCV25768636.AA.rec | 0.032703 | 0.7973 | 0.64757 | 0.98153 | GG | 502 | 0.4265 | 1910 |
| hCV2590858 | ACDCY9 | rs2230738 | C | T | C | 0.733461 | general | hCV2590858.TT | 0.022606 | 0.7254 | 0.55052 | 0.95594 | CC | 654 | 0.5566 | 2418 |
| | | | | | | | recessive | hCV2590858.TT.rec | 0.020267 | 0.726 | 0.55407 | 0.95138 | CC | 654 | 0.5566 | 2418 |
| hCV25990131 | CYP4V2 | rs13146272 | A | C | A | 0.64085 | general | hCV25990131.CC | 0.009124 | 0.7483 | 0.60174 | 0.93053 | AA | 515 | 0.4522 | 1814 |
| | | | | | | | recessive | hCV25990131.CC.rec | 0.029035 | 0.7944 | 0.64605 | 0.97675 | AA | 515 | 0.4522 | 1814 |
| | | | | | | | dominant | hCV25990131.AA.dom | 0.021499 | 0.8571 | 0.7516 | 0.97752 | AA | 515 | 0.4522 | 1814 |
| | | | | | | | additive | hCV25990131.CC.CA.adtv | 0.006142 | 0.8728 | 0.79182 | 0.962 | AA | 515 | 0.4522 | 1814 |
| hCV26175114 | TUBA4A | rs373892 | A | G | G | 0.108496 | recessive | hCV26175114.GG.rec | 0.010391 | 1.6966 | 1.13236 | 2.54198 | AA | 936 | 0.7939 | 3655 |
| | | | | | | | general | hCV26175114.GG | 0.011269 | 1.6893 | 1.12616 | 2.53402 | AA | 936 | 0.7939 | 3655 |
| hCV27474895 | F11 | rs3756011 | C | A | A | 0.405226 | general | hCV27474895.AA | 1.4E-05 | 1.5002 | 1.24929 | 1.80148 | CC | 357 | 0.3036 | 1619 |
| | | | | | | | recessive | hCV27474895.AA.rec | 0.000287 | 1.344 | 1.14551 | 1.57678 | CC | 357 | 0.3036 | 1619 |
| | | | | | | | dominant | hCV27474895.CC.dom | 0.000437 | 1.2822 | 1.11632 | 1.47271 | CC | 357 | 0.3036 | 1619 |
| | | | | | | | additive | hCV27474895.AA.AC.adtv | 1.39E-05 | 1.2226 | 1.11666 | 1.33868 | CC | 357 | 0.3036 | 1619 |
| hCV27474984 | PIK3R1 | rs3756668 | G | A | A | 0.448895 | general | hCV27474984.AA | 0.013465 | 1.2044 | 1.03922 | 1.3958 | GG | 329 | 0.2769 | 1416 |
| | | | | | | | recessive | hCV27474984.AA.rec | 0.003924 | 1.3009 | 1.08794 | 1.55547 | GG | 329 | 0.2769 | 1416 |
| | | | | | | | dominant | hCV27474984.GG.dom | 0.013232 | 1.2106 | 1.04073 | 1.40818 | GG | 329 | 0.2769 | 1416 |
| | | | | | | | additive | hCV27474984.AA.AG.adtv | 0.024908 | 1.1763 | 1.02069 | 1.35558 | GG | 329 | 0.2769 | 1416 |
| hCV27477533 | F11 | rs3756008 | A | T | T | 0.395815 | general | hCV27477533.TT | 0.004131 | 1.1397 | 1.04227 | 1.24624 | AA | 369 | 0.3132 | 1671 |
| | | | | | | | recessive | hCV27477533.TT.rec | 5.37E-05 | 1.4656 | 1.21747 | 1.76441 | AA | 369 | 0.3132 | 1671 |
| | | | | | | | dominant | hCV27477533.AA.dom | 0.00183 | 1.2972 | 1.10137 | 1.52774 | AA | 369 | 0.3132 | 1671 |
| | | | | | | | additive | hCV27477533.TA | 0.000252 | 1.2923 | 1.12649 | 1.48254 | AA | 369 | 0.3132 | 1671 |
| | | | | | | | | hCV27477533.TT.TA.adtv | 0.004944 | 1.2326 | 1.06335 | 1.42618 | AA | 369 | 0.3132 | 1671 |
| hCV27902808 | CYP4V2 | rs4253236 | C | T | C | 0.636333 | general | hCV27902808.TT | 3.06E-05 | 1.2135 | 1.10796 | 1.32902 | CC | 529 | 0.4494 | 1838 |
| | | | | | | | dominant | hCV27902808.CC.dom | 0.037699 | 0.8022 | 0.65157 | 0.98755 | CC | 529 | 0.4494 | 1838 |
| | | | | | | | general | hCV27902808.TC | 0.007416 | 0.838 | 0.73623 | 0.95372 | CC | 529 | 0.4494 | 1838 |
| | | | | | | | additive | hCV27902808.TT.TC.adtv | 0.01876 | 0.8484 | 0.73967 | 0.97306 | CC | 529 | 0.4494 | 1838 |
| hCV2892877 | FGA | rs6050 | T | C | C | 0.23658 | general | hCV2892877.CT | 0.009101 | 0.8808 | 0.80074 | 0.96896 | TT | 503 | 0.4594 | 2237 |
| | | | | | | | dominant | hCV2892877.TT.dom | 2.84E-05 | 1.3303 | 1.16388 | 1.52044 | TT | 503 | 0.4594 | 2237 |
| | | | | | | | additive | hCV2892877.CC.CT.adtv | 3.74E-05 | 1.3257 | 1.15939 | 1.51579 | TT | 503 | 0.4594 | 2237 |
| hCV2915511 | OBSL1/STK11IP | rs627530 | T | C | C | 0.036056 | general | hCV2915511.CC | 2.16E-05 | 1.3265 | 1.16435 | 1.51125 | TT | 503 | 0.4594 | 2237 |
| | | | | | | | recessive | hCV2915511.CC.rec | 0.018869 | 2.8308 | 1.18768 | 6.74695 | TT | 1103 | 0.9154 | 4284 |
| | | | | | | | additive | hCV2915511.CC.CT.adtv | 0.020235 | 2.7975 | 1.17396 | 6.66633 | TT | 1103 | 0.9154 | 4284 |
| | | | | | | | | | 0.027831 | 1.2706 | 1.02644 | 1.57275 | TT | 1103 | 0.9154 | 4284 |

TABLE 25-continued

Table 25. Age- and sex-adjusted association of 52 SNPs with isolated PE in MEGA (p <= 0.05)

| | | | | | | | | | | | | | | |
|---|---|---|---|---|---|---|---|---|---|---|---|---|---|---|
| hCV29821005 | LOC728284 | rs6552970 | C | T | 0.829809 | general | hCV29821005.TC | 0.013769 | 0.8228 | 0.70448 | 0.96093 | CC | 827 | 0.7267 | 3068 |
| hCV30562347 | F11 | rs4253418 | G | A | 0.956444 | general | hCV30562347.AG | 0.04875 | 0.7731 | 0.59856 | 0.99859 | GG | 1098 | 0.9313 | 4119 |
| hCV3180954 | PTCRA | rs9471966 | G | A | 0.734992 | general | hCV3180954.AA | 0.043289 | 0.7611 | 0.58411 | 0.9918 | GG | 685 | 0.5689 | 2507 |
| hCV32291301 | KLKB1 | rs4253302 | A | G | 0.837091 | general | hCV32291301.GA | 5.63E-05 | 0.62248 | 0.65222 | 0.84899 | AA | 893 | 0.7568 | 3177 |
| | | | | | | dominant | hCV32291301.AA.dom | 0.000204 | 0.727 | 0.65222 | 0.87625 | AA | 893 | 0.7568 | 3177 |
| | | | | | | additive | hCV32291301.GG.GA.adtv | 0.00251 | 0.8204 | 0.72152 | 0.93278 | AA | 893 | 0.7568 | 3177 |
| hCV3230038 | F11 | rs2289252 | C | T | 0.403825 | general | hCV3230038.TT | 5.16E-06 | 1.5316 | 1.27506 | 1.83965 | CC | 355 | 0.3014 | 1626 |
| | | | | | | recessive | hCV3230038.TT.rec | 0.000163 | 1.3601 | 1.15911 | 1.59587 | CC | 355 | 0.3014 | 1626 |
| | | | | | | dominant | hCV3230038.CC.dom | 0.000187 | 1.3025 | 1.13389 | 1.49618 | CC | 355 | 0.3014 | 1626 |
| | | | | | | additive | hCV3230038.TT.TC.adtv | 4.8E-06 | 1.2359 | 1.12865 | 1.3533 | CC | 355 | 0.3014 | 1626 |
| hCV3230096 | | | | | | general | hCV3230038.TC | 0.007754 | 1.2218 | 1.05429 | 1.41601 | CC | 355 | 0.3014 | 1626 |
| hCV3230096 | CYP4V2 | rs3817184 | C | T | 0.415431 | general | hCV3230096.TT | 0.021851 | 1.2411 | 1.03187 | 1.49283 | CC | 374 | 0.3175 | 1546 |
| | | | | | | recessive | hCV3230096.TT.rec | 0.036521 | 1.1894 | 1.01093 | 1.39932 | CC | 374 | 0.3175 | 1546 |
| | | | | | | additive | hCV3230096.TT.TC.adtv | 0.026457 | 1.109 | 1.01216 | 1.215 | CC | 374 | 0.3175 | 1546 |
| hCV3230113 | CYP4V2 | rs1053094 | A | T | 0.490487 | recessive | hCV3230113.TT.rec | 0.007751 | 1.2185 | 1.05354 | 1.40928 | AA | 286 | 0.2436 | 1158 |
| | | | | | | general | hCV3230113.TT | 0.030129 | 1.22 | 0.0193 | 1.46022 | AA | 286 | 0.2436 | 1158 |
| | | | | | | additive | hCV3230113.TT.TA.adtv | 0.029142 | 1.1067 | 1.01035 | 1.21226 | AA | 286 | 0.2436 | 1158 |
| hCV3272537 | TIAM1 | rs497689 | T | A | 0.442161 | general | hCV3272537.AT | 0.003248 | 1.2507 | 1.07759 | 1.45156 | TT | 330 | 0.2782 | 1449 |
| | | | | | | dominant | hCV3272537.TT.dom | 0.012334 | 1.1982 | 1.03998 | 1.38055 | TT | 330 | 0.2782 | 1449 |
| hCV540410 | LASP1 | rs609529 | T | A | 0.063164 | general | hCV540410.AA | 0.007939 | 2.6467 | 1.29008 | 5.42985 | TT | 1037 | 0.8649 | 3967 |
| | | | | | | recessive | hCV540410.AA.rec | 0.008389 | 2.6271 | 1.28109 | 5.38731 | TT | 1037 | 0.8649 | 3967 |
| hCV596331 | F9 | rs6048 | A | G | 0.698278 | general | hCV596331.GG | 0.005303 | 0.7741 | 0.64659 | 0.92677 | AA | 759 | 0.6309 | 2719 |
| | | | | | | recessive | hCV596331.GG.rec | 0.011347 | 0.7941 | 0.66432 | 0.94926 | AA | 759 | 0.6309 | 2719 |
| | | | | | | dominant | hCV596331.AA.dom | 0.001786 | 0.8083 | 0.70723 | 0.92377 | AA | 759 | 0.6309 | 2719 |
| | | | | | | additive | hCV596331.GG.GA.adtv | 0.001633 | 0.8731 | 0.80244 | 0.95003 | AA | 759 | 0.6309 | 2719 |
| hCV7422466 | C9orf103 | rs1052690 | A | C | 0.803646 | general | hCV7422466.CA | 0.001726 | 0.7929 | 0.68582 | 0.91676 | AA | 815 | 0.6901 | 2630 |
| | | | | | | dominant | hCV7422466.AA.dom | 0.002711 | 0.8083 | 0.70328 | 0.92892 | AA | 815 | 0.6901 | 2630 |
| | | | | | | additive | hCV7422466.CC.CA.adtv | 0.011048 | 0.8557 | 0.75881 | 0.96499 | AA | 815 | 0.6901 | 2630 |
| hCV7581501 | USP45 | rs1323717 | G | C | 0.879567 | general | hCV7581501.CG | 0.043619 | 0.8471 | 0.72094 | 0.99526 | GG | 956 | 0.796 | 3528 |
| hCV7625318 | PLEKHG4 | rs3868142 | G | A | 0.084256 | general | hCV7625318.AA | 0.002718 | 2.0943 | 1.29169 | 3.39574 | GG | 992 | 0.8267 | 3877 |
| | | | | | | recessive | hCV7625318.AA.rec | 0.002865 | 2.0835 | 1.28604 | 3.37549 | GG | 992 | 0.8267 | 3877 |
| hCV8241630 | F11 | rs925451 | G | A | 0.379287 | general | hCV8241630.AA | 3.67E-05 | 1.4822 | 1.22955 | 1.78668 | GG | 394 | 0.3333 | 1768 |
| | | | | | | recessive | hCV8241630.AA.rec | 0.001099 | 1.3212 | 1.11769 | 1.56172 | GG | 394 | 0.3333 | 1768 |
| | | | | | | dominant | hCV8241630.GG.dom | 0.00023 | 1.2889 | 1.12609 | 1.4753 | GG | 394 | 0.3333 | 1768 |
| | | | | | | additive | hCV8241630.AG | 0.005449 | 1.2259 | 1.06187 | 1.41517 | GG | 394 | 0.3333 | 1768 |
| hCV8361354 | PANX1 | rs1138800 | C | A | 0.374456 | additive | hCV8241630.AA.AG.adtv | 2.03E-05 | 1.2188 | 1.11277 | 1.33486 | GG | 394 | 0.3333 | 1768 |
| | | | | | | recessive | hCV8361354.AA.rec | 0.011342 | 1.254 | 1.05247 | 1.49423 | CC | 464 | 0.3863 | 1774 |
| | | | | | | general | hCV8361354.AA | 0.046424 | 1.2139 | 1.00308 | 1.46897 | CC | 464 | 0.3863 | 1774 |
| hCV8717873 | GP6/RDH13 | rs1613662 | A | G | 0.816402 | dominant | hCV8717873.AA.dom | 0.00637 | 0.8245 | 0.71782 | 0.94713 | AA | 849 | 0.7063 | 3059 |
| | | | | | | general | hCV8717873.GA | 0.011484 | 0.8311 | 0.72009 | 0.95931 | AA | 849 | 0.7063 | 3059 |
| | | | | | | additive | hCV8717873.GG.GA.adtv | 0.006619 | 0.845 | 0.74824 | 0.95422 | AA | 849 | 0.7063 | 3059 |
| hCV8726802 | F2 | rs1799963 | G | A | 0.009998 | general | hCV8726802.AA.AG.adtv | 0.001832 | 1.7876 | 1.24051 | 2.57599 | GG | 1154 | 0.9649 | 4509 |
| | | | | | | dominant | hCV8726802.GG.dom | 0.002881 | 1.7586 | 1.21319 | 2.54921 | GG | 1154 | 0.9649 | 4509 |
| | | | | | | additive | hCV8726802.AG | 0.004755 | 1.7145 | 1.17921 | 2.49277 | GG | 1154 | 0.9649 | 4509 |
| hCV8911768 | SERPINC1 | rs941988 | C | T | 0.095461 | general | hCV8911768.TT.TC.adtv | 0.045997 | 1.2308 | 1.0037 | 1.50923 | CC | 432 | 0.7869 | 2274 |
| hCV8919444 | F5 | rs4524 | T | C | 0.737678 | general | hCV8919444.CC | 0.00142 | 0.6217 | 0.46423 | 0.83249 | TT | 703 | 0.5993 | 2466 |
| | | | | | | recessive | hCV8919444.CC.rec | 0.005126 | 0.6634 | 0.49765 | 0.88423 | TT | 703 | 0.5993 | 2466 |
| | | | | | | dominant | hCV8919444.TT.dom | 0.001654 | 0.8105 | 0.71104 | 0.92383 | TT | 703 | 0.5993 | 2466 |
| | | | | | | additive | hCV8919444.CC.CT.adtv | 0.000259 | 0.8188 | 0.73558 | 0.91152 | TT | 703 | 0.5993 | 2466 |
| | | | | | | general | hCV8919444.CT | 0.016842 | 0.8466 | 0.73854 | 0.97047 | TT | 703 | 0.5993 | 2466 |

TABLE 25-continued

Table 25. Age- and sex-adjusted association of 52 SNPs with isolated PE in MEGA (p <= 0.05)

| Marker | Gene Symbol | RS number | Ref-Allele | NonRef-Allele | Risk Allele | Control RAF | Model | Control-Freq3 | Genot2 | Case Count | Case-Freq4 | Control-Count4 | Control-Freq4 | Genot3 | Case-Count5 | Case-Freq5 | Control-Count | Control-Freq5 |
|---|---|---|---|---|---|---|---|---|---|---|---|---|---|---|---|---|---|---|
| hCV9102827 | GPATCH4 | rs3795733 | T | C | C | 0.258025 | general | | | | 1.2746 | | 1.01305 | 1.6037 | | | 0.5217 | |
| | | | | | | | dominant | | | | 1.1997 | | 1.05332 | 1.36641 | | | 0.5217 | |
| | | | | | | | general | | | | 1.1819 | | 1.02896 | 1.35755 | | | 0.5217 | |
| | | | | | | | additive | | | | 1.1485 | | 1.04116 | 1.26683 | | | 0.5217 | |
| hDV70683382 | RABGAP1L | rs16846815 | G | C | C | 0.061982 | general | | | | 0.040966 | | 1.04937 | 9.96795 | | | 0.854 | |
| | | | | | | | recessive | | | | 0.044861 | | 1.02675 | 9.74207 | | | 0.854 | |
| hCV11503414 | FGG | rs2066865 | G | A | A | 0.265941 | general | 0.539 | AG | 501 | 0.426 | 1756 | 0.3901 | AA | 128 | 0.1088 | 319 | 0.071 |
| | | | | | | | recessive | 0.539 | AG | 501 | 0.426 | 1756 | 0.3901 | AA | 128 | 0.1088 | 319 | 0.071 |
| | | | | | | | dominant | 0.539 | AG | 501 | 0.426 | 1756 | 0.3901 | AA | 128 | 0.1088 | 319 | 0.071 |
| | | | | | | | additive | 0.539 | AG | 501 | 0.426 | 1756 | 0.3901 | AA | 128 | 0.1088 | 319 | 0.071 |
| hCV11503469 | FGG | rs2066854 | T | A | A | 0.266985 | general | 0.538 | AT | 500 | 0.424 | 1757 | 0.3901 | AA | 127 | 0.1078 | 324 | 0.072 |
| | | | | | | | recessive | 0.538 | AT | 500 | 0.424 | 1757 | 0.3901 | AA | 127 | 0.1078 | 324 | 0.072 |
| | | | | | | | dominant | 0.538 | AT | 500 | 0.424 | 1757 | 0.3901 | AA | 127 | 0.1078 | 324 | 0.072 |
| | | | | | | | additive | 0.538 | AT | 500 | 0.424 | 1757 | 0.3901 | AA | 127 | 0.1078 | 324 | 0.072 |
| hCV11503470 | | rs1800788 | C | T | T | 0.208112 | general | 0.6331 | TC | 426 | 0.361 | 1437 | 0.3176 | TT | 62 | 0.0525 | 223 | 0.049 |
| | | | | | | | dominant | 0.6331 | TC | 426 | 0.361 | 1437 | 0.3176 | TT | 62 | 0.0525 | 223 | 0.049 |
| | | | | | | | additive | 0.6331 | TC | 426 | 0.361 | 1437 | 0.3176 | TT | 62 | 0.0525 | 223 | 0.049 |
| hCV11786258 | KLKB1 | rs4253303 | G | A | A | 0.393142 | general | 0.3677 | AG | 559 | 0.475 | 2162 | 0.4783 | AA | 209 | 0.1774 | 696 | 0.154 |
| | | | | | | | recessive | 0.3677 | AG | 559 | 0.475 | 2162 | 0.4783 | AA | 209 | 0.1774 | 696 | 0.154 |
| hCV11975250 | F5 | rs6025 | C | T | T | 0.026408 | dominant | 0.9487 | TC | 107 | 0.09 | 226 | 0.0497 | TT | 4 | 0.0033 | 7 | 0.002 |
| | | | | | | | additive | 0.9487 | TC | 107 | 0.09 | 226 | 0.0497 | TT | 4 | 0.0033 | 7 | 0.002 |
| | | | | | | | general | 0.9487 | TC | 107 | 0.09 | 226 | 0.0497 | TT | 4 | 0.0033 | 7 | 0.002 |
| hCV1202883 | MTHFR | rs1801133 | G | A | G | 0.69837 | general | 0.4635 | AG | 566 | 0.469 | 2161 | 0.4698 | AA | 60 | 0.0497 | 307 | 0.067 |
| | | | | | | | recessive | 0.4635 | AG | 566 | 0.469 | 2161 | 0.4698 | AA | 60 | 0.0497 | 307 | 0.067 |
| hCV12066124 | F11 | rs2036914 | C | T | C | 0.518478 | general | 0.2713 | TC | 540 | 0.46 | 2234 | 0.4944 | TT | 244 | 0.208 | 1059 | 0.234 |
| | | | | | | | dominant | 0.2713 | TC | 540 | 0.46 | 2234 | 0.4944 | TT | 244 | 0.208 | 1059 | 0.234 |
| | | | | | | | general | 0.2713 | TC | 540 | 0.46 | 2234 | 0.4944 | TT | 244 | 0.208 | 1059 | 0.234 |
| | | | | | | | additive | 0.2713 | TC | 540 | 0.46 | 2234 | 0.4944 | TT | 244 | 0.208 | 1059 | 0.234 |
| hCV12092542 | CASP5 | rs507879 | T | C | T | 0.548201 | recessive | 0.3008 | CT | 610 | 0.526 | 1925 | 0.4949 | CC | 196 | 0.1691 | 795 | 0.204 |
| | | | | | | | general | 0.3008 | CT | 610 | 0.526 | 1925 | 0.4949 | CC | 196 | 0.1691 | 795 | 0.204 |
| hCV15860433 | | rs2070006 | C | T | T | 0.395787 | general | 0.3692 | TC | 588 | 0.5 | 2120 | 0.4701 | TT | 218 | 0.1855 | 725 | 0.161 |
| | | | | | | | dominant | 0.3692 | TC | 588 | 0.5 | 2120 | 0.4701 | TT | 218 | 0.1855 | 725 | 0.161 |
| | | | | | | | general | 0.3692 | TC | 588 | 0.5 | 2120 | 0.4701 | TT | 218 | 0.1855 | 725 | 0.161 |
| | | | | | | | recessive | 0.3692 | TC | 588 | 0.5 | 2120 | 0.4701 | TT | 218 | 0.1855 | 725 | 0.161 |
| | | | | | | | additive | 0.3692 | TC | 588 | 0.5 | 2120 | 0.4701 | TT | 218 | 0.1855 | 725 | 0.161 |
| hCV15949414 | XYLB | rs2234628 | G | A | G | 0.947951 | general | 0.899 | AG | 88 | 0.075 | 442 | 0.0979 | AA | 6 | 0.0051 | 14 | 0.003 |
| | | | | | | | dominant | 0.899 | AG | 88 | 0.075 | 442 | 0.0979 | AA | 6 | 0.0051 | 14 | 0.003 |
| hCV15968043 | CYP4V2 | rs2292423 | T | A | A | 0.409182 | general | 0.3481 | AT | 558 | 0.479 | 2178 | 0.4854 | TT | 223 | 0.1916 | 747 | 0.166 |
| | | | | | | | recessive | 0.3481 | AT | 558 | 0.479 | 2178 | 0.4854 | TT | 223 | 0.1916 | 747 | 0.166 |
| hCV16180170 | SERPINC1 | rs2227589 | C | T | T | 0.09279 | general | 0.8238 | TC | 239 | 0.199 | 766 | 0.1668 | TT | 20 | 0.0167 | 43 | 0.009 |
| | | | | | | | recessive | 0.8238 | TC | 239 | 0.199 | 766 | 0.1668 | TT | 20 | 0.0167 | 43 | 0.009 |
| | | | | | | | dominant | 0.8238 | TC | 239 | 0.199 | 766 | 0.1668 | TT | 20 | 0.0167 | 43 | 0.009 |
| | | | | | | | additive | 0.8238 | TC | 239 | 0.199 | 766 | 0.1668 | TT | 20 | 0.0167 | 43 | 0.009 |
| | | | | | | | general | 0.8238 | TC | 239 | 0.199 | 766 | 0.1668 | TT | 20 | 0.0167 | 43 | 0.009 |

TABLE 25-continued

Table 25. Age- and sex-adjusted association of 52 SNPs with isolated PE in MEGA (p <= 0.05)

| | | | | | | | | | | | | | | | |
|---|---|---|---|---|---|---|---|---|---|---|---|---|---|---|---|
| hCV1842260 | LOC642043 | rs2281390 | G | T | | 0.171422 | general | 0.692 | TG | 372 | 0.308 | 1254 | 0.2731 | TT | 40 | 0.0331 | 160 | 0.035 |
| | | | | | | | dominant | 0.692 | TG | 372 | 0.308 | 1254 | 0.2731 | TT | 40 | 0.0331 | 160 | 0.035 |
| hCV1859855 | GOLGA3/POLE | rs2291260 | T | C | | 0.218551 | recessive | 0.6053 | CT | 371 | 0.311 | 1605 | 0.3524 | CC | 80 | 0.0671 | 193 | 0.042 |
| | | | | | | | general | 0.6053 | CT | 371 | 0.311 | 1605 | 0.3524 | CC | 80 | 0.0671 | 193 | 0.042 |
| hCV2103346 | DKFZP564J102 | rs11733307 | T | C | T | 0.781449 | general | 0.3214 | CT | 571 | 0.486 | 2138 | 0.4738 | CC | 262 | 0.2228 | 924 | 0.205 |
| hCV22272267 | KLKB1 | rs3733402 | A | G | C | 0.441711 | additive | 0.2614 | GA | 532 | 0.451 | 2273 | 0.5043 | GG | 269 | 0.2282 | 1056 | 0.234 |
| | | | | | A | 0.513535 | general | 0.2614 | GA | 532 | 0.451 | 2273 | 0.5043 | GG | 269 | 0.2282 | 1056 | 0.234 |
| | | | | | | | dominant | 0.2614 | GA | 532 | 0.451 | 2273 | 0.5043 | GG | 269 | 0.2282 | 1056 | 0.234 |
| | | | | | | | additive | 0.2614 | GA | 532 | 0.451 | 2273 | 0.5043 | GG | 269 | 0.2282 | 1056 | 0.234 |
| hCV233148 | AKT3/SDCCAG8 | rs1417121 | G | C | C | 0.27821 | general | 0.5198 | CG | 479 | 0.407 | 1819 | 0.404 | CC | 113 | 0.096 | 343 | 0.076 |
| | | | | | | | recessive | 0.5198 | CG | 479 | 0.407 | 1819 | 0.404 | CC | 113 | 0.096 | 343 | 0.076 |
| hCV25474413 | F11 | rs3822057 | A | C | C | 0.483878 | general | 0.269 | CA | 570 | 0.483 | 2238 | 0.4943 | CC | 338 | 0.2862 | 1072 | 0.237 |
| | | | | | | | recessive | 0.269 | CA | 570 | 0.483 | 2238 | 0.4943 | CC | 338 | 0.2862 | 1072 | 0.237 |
| | | | | | | | dominant | 0.269 | CA | 570 | 0.483 | 2238 | 0.4943 | CC | 338 | 0.2862 | 1072 | 0.237 |
| | | | | | | | additive | 0.269 | CA | 570 | 0.483 | 2238 | 0.4943 | CC | 338 | 0.2862 | 1072 | 0.237 |
| hCV25615302 | CUEDC1 | rs17762338 | C | T | T | 0.178556 | general | 0.6778 | TC | 389 | 0.324 | 1317 | 0.2873 | CC | 37 | 0.0308 | 160 | 0.035 |
| | | | | | | | additive | 0.6778 | TC | 389 | 0.324 | 1317 | 0.2873 | CC | 37 | 0.0308 | 160 | 0.035 |
| hCV25620145 | PROCR | rs867186 | A | G | G | 0.124401 | general | 0.7656 | GA | 292 | 0.243 | 1010 | 0.22 | GG | 26 | 0.0216 | 66 | 0.014 |
| | | | | | | | dominant | 0.7656 | GA | 292 | 0.243 | 1010 | 0.22 | GG | 26 | 0.0216 | 66 | 0.014 |
| hCV25748719 | NAP5 | NONE | C | T | C | 0.7673 | general | 0.5879 | TC | 412 | 0.344 | 1644 | 0.3589 | TT | 47 | 0.0393 | 244 | 0.053 |
| | | | | | | | additive | 0.5879 | TC | 412 | 0.344 | 1644 | 0.3589 | TT | 47 | 0.0393 | 244 | 0.053 |
| hCV25768636 | CCDC36/USP19 | rs4279134 | G | A | G | 0.648673 | recessive | 0.4226 | AG | 554 | 0.471 | 2044 | 0.4522 | AA | 121 | 0.1028 | 566 | 0.125 |
| hCV2590858 | ACDCY9 | rs2230738 | C | T | C | 0.733461 | general | 0.5441 | TC | 454 | 0.386 | 1683 | 0.3787 | TT | 67 | 0.057 | 343 | 0.077 |
| | | | | | | | recessive | 0.5441 | TC | 454 | 0.386 | 1683 | 0.3787 | TT | 67 | 0.057 | 343 | 0.077 |
| hCV25990131 | CYP4V2 | rs13146272 | A | C | A | 0.64085 | general | 0.4144 | CA | 501 | 0.44 | 1982 | 0.4528 | CC | 123 | 0.108 | 581 | 0.133 |
| | | | | | | | recessive | 0.4144 | CA | 501 | 0.44 | 1982 | 0.4528 | CC | 123 | 0.108 | 581 | 0.133 |
| | | | | | | | dominant | 0.4144 | CA | 501 | 0.44 | 1982 | 0.4528 | CC | 123 | 0.108 | 581 | 0.133 |
| | | | | | | | additive | 0.4144 | CA | 501 | 0.44 | 1982 | 0.4528 | CC | 123 | 0.108 | 581 | 0.133 |
| hCV26175114 | TUBA4A | rs3731892 | A | G | G | 0.108496 | recessive | 0.8003 | GA | 208 | 0.176 | 833 | 0.1824 | GG | 35 | 0.0297 | 79 | 0.017 |
| | | | | | | | general | 0.8003 | GA | 208 | 0.176 | 833 | 0.1824 | GG | 35 | 0.0297 | 79 | 0.017 |
| hCV27474895 | F11 | rs3756011 | C | A | A | 0.405226 | general | 0.3585 | AC | 567 | 0.482 | 2134 | 0.4725 | AA | 252 | 0.2143 | 763 | 0.169 |
| | | | | | | | recessive | 0.3585 | AC | 567 | 0.482 | 2134 | 0.4725 | AA | 252 | 0.2143 | 763 | 0.169 |
| | | | | | | | dominant | 0.3585 | AC | 567 | 0.482 | 2134 | 0.4725 | AA | 252 | 0.2143 | 763 | 0.169 |
| | | | | | | | additive | 0.3585 | AC | 567 | 0.482 | 2134 | 0.4725 | AA | 252 | 0.2143 | 763 | 0.169 |
| hCV27474984 | PIK3R1 | rs3756668 | G | A | A | 0.448895 | general | 0.3099 | AG | 573 | 0.482 | 2204 | 0.4824 | AA | 286 | 0.2407 | 949 | 0.208 |
| | | | | | | | recessive | 0.3099 | AG | 573 | 0.482 | 2204 | 0.4824 | AA | 286 | 0.2407 | 949 | 0.208 |
| | | | | | | | dominant | 0.3099 | AG | 573 | 0.482 | 2204 | 0.4824 | AA | 286 | 0.2407 | 949 | 0.208 |
| | | | | | | | additive | 0.3099 | AG | 573 | 0.482 | 2204 | 0.4824 | AA | 286 | 0.2407 | 949 | 0.208 |
| hCV27477533 | F11 | rs3756008 | A | T | T | 0.395815 | general | 0.37 | TA | 574 | 0.487 | 2115 | 0.4683 | TT | 235 | 0.1995 | 730 | 0.162 |
| | | | | | | | recessive | 0.37 | TA | 574 | 0.487 | 2115 | 0.4683 | TT | 235 | 0.1995 | 730 | 0.162 |
| | | | | | | | dominant | 0.37 | TA | 574 | 0.487 | 2115 | 0.4683 | TT | 235 | 0.1995 | 730 | 0.162 |
| | | | | | | | additive | 0.37 | TA | 574 | 0.487 | 2115 | 0.4683 | TT | 235 | 0.1995 | 730 | 0.162 |
| hCV27902808 | CYP4V2 | rs4253236 | C | T | C | 0.636333 | general | 0.4065 | TC | 508 | 0.432 | 2079 | 0.4598 | TT | 140 | 0.1189 | 605 | 0.134 |
| | | | | | | | dominant | 0.4065 | TC | 508 | 0.432 | 2079 | 0.4598 | TT | 140 | 0.1189 | 605 | 0.134 |
| | | | | | | | general | 0.4065 | TC | 508 | 0.432 | 2079 | 0.4598 | TT | 140 | 0.1189 | 605 | 0.134 |
| | | | | | | | additive | 0.4065 | TC | 508 | 0.432 | 2079 | 0.4598 | TT | 140 | 0.1189 | 605 | 0.134 |

TABLE 25-continued

Table 25. Age- and sex-adjusted association of 52 SNPs with isolated PE in MEGA (p <= 0.05)

| | | | | | | | | | | | | | | |
|---|---|---|---|---|---|---|---|---|---|---|---|---|---|---|
| hCV2892877 | FGA | rs6050 | T | C | C | 0.23658 | dominant | 0.5314 | 584 | CT | 0.533 | 1954 | 0.4641 | 8 | 0.0073 | 19 | 0.005 |
| | | | | | | | general | 0.5314 | 584 | CT | 0.533 | 1954 | 0.4641 | 8 | 0.0073 | 19 | 0.005 |
| | | | | | | | additive | 0.5314 | 584 | CT | 0.533 | 1954 | 0.4641 | 8 | 0.0073 | 19 | 0.005 |
| hCV2915511 | OBSL1/STK11P | rs627530 | T | C | C | 0.036056 | general | 0.9305 | 93 | CT | 0.077 | 308 | 0.0669 | 9 | 0.0075 | 12 | 0.003 |
| | | | | | | | recessive | 0.9305 | 93 | CT | 0.077 | 308 | 0.0669 | 9 | 0.0075 | 12 | 0.003 |
| | | | | | | | additive | 0.9305 | 93 | CT | 0.077 | 308 | 0.0669 | 9 | 0.0075 | 12 | 0.003 |
| hCV29821005 | LOC728284 | rs6552970 | C | T | C | 0.829809 | general | 0.6976 | 259 | TC | 0.228 | 1163 | 0.2644 | 52 | 0.0457 | 167 | 0.038 |
| hCV30562347 | F11 | rs4253418 | G | A | G | 0.956444 | general | 0.9153 | 76 | AG | 0.064 | 370 | 0.0822 | 5 | 0.0042 | 11 | 0.002 |
| hCV3180954 | PTCRA | rs9471966 | G | A | G | 0.734992 | general | 0.5473 | 445 | AG | 0.37 | 1720 | 0.3755 | 74 | 0.0615 | 354 | 0.077 |
| hCV3229130I | KLKB1 | rs4253302 | A | G | A | 0.837091 | general | 0.7023 | 250 | GA | 0.212 | 1220 | 0.2697 | 37 | 0.0314 | 127 | 0.028 |
| | | | | | | | dominant | 0.7023 | 250 | GA | 0.212 | 1220 | 0.2697 | 37 | 0.0314 | 127 | 0.028 |
| | | | | | | | additive | 0.7023 | 250 | GA | 0.212 | 1220 | 0.2697 | 37 | 0.0314 | 127 | 0.028 |
| hCV3230038 | F11 | rs2289252 | C | T | T | 0.403825 | general | 0.3595 | 571 | TC | 0.485 | 2141 | 0.4734 | 252 | 0.2139 | 756 | 0.167 |
| | | | | | | | recessive | 0.3595 | 571 | TC | 0.485 | 2141 | 0.4734 | 252 | 0.2139 | 756 | 0.167 |
| | | | | | | | dominant | 0.3595 | 571 | TC | 0.485 | 2141 | 0.4734 | 252 | 0.2139 | 756 | 0.167 |
| | | | | | | | additive | 0.3595 | 571 | TC | 0.485 | 2141 | 0.4734 | 252 | 0.2139 | 756 | 0.167 |
| hCV3230096 | CYP4V2 | rs3817184 | C | T | T | 0.415431 | general | 0.3423 | 569 | TC | 0.483 | 2189 | 0.4846 | 235 | 0.1995 | 782 | 0.173 |
| | | | | | | | recessive | 0.3423 | 569 | TC | 0.483 | 2189 | 0.4846 | 235 | 0.1995 | 782 | 0.173 |
| | | | | | | | additive | 0.3423 | 569 | TC | 0.483 | 2189 | 0.4846 | 235 | 0.1995 | 782 | 0.173 |
| hCV3230113 | CYP4V2 | rs1053094 | A | T | T | 0.490487 | recessive | 0.2562 | 565 | TA | 0.481 | 2290 | 0.5066 | 323 | 0.2751 | 1072 | 0.237 |
| | | | | | | | additive | 0.2562 | 565 | TA | 0.481 | 2290 | 0.5066 | 323 | 0.2751 | 1072 | 0.237 |
| hCV3272537 | TIAM1 | rs497689 | T | A | A | 0.442161 | general | 0.3169 | 630 | AT | 0.531 | 2204 | 0.482 | 226 | 0.1906 | 920 | 0.201 |
| | | | | | | | dominant | 0.3169 | 630 | AT | 0.531 | 2204 | 0.482 | 226 | 0.1906 | 920 | 0.201 |
| hCV540410 | LASP1 | rs609529 | T | A | A | 0.063164 | general | 0.8777 | 149 | AT | 0.124 | 535 | 0.1184 | 13 | 0.0108 | 18 | 0.004 |
| | | | | | | | recessive | 0.8777 | 149 | AT | 0.124 | 535 | 0.1184 | 13 | 0.0108 | 18 | 0.004 |
| hCV596331 | F9 | rs6048 | A | G | A | 0.698278 | general | 0.5928 | 259 | GA | 0.215 | 968 | 0.211 | 185 | 0.1538 | 900 | 0.196 |
| | | | | | | | recessive | 0.5928 | 259 | GA | 0.215 | 968 | 0.211 | 185 | 0.1538 | 900 | 0.196 |
| | | | | | | | dominant | 0.5928 | 259 | GA | 0.215 | 968 | 0.211 | 185 | 0.1538 | 900 | 0.196 |
| | | | | | | | additive | 0.5928 | 259 | GA | 0.215 | 968 | 0.211 | 185 | 0.1538 | 900 | 0.196 |
| hCV7422466 | C9orf103 | rs1052690 | A | C | A | 0.803646 | general | 0.6435 | 323 | CA | 0.273 | 1309 | 0.3203 | 43 | 0.0364 | 148 | 0.036 |
| | | | | | | | dominant | 0.6435 | 323 | CA | 0.273 | 1309 | 0.3203 | 43 | 0.0364 | 148 | 0.036 |
| | | | | | | | additive | 0.6435 | 323 | CA | 0.273 | 1309 | 0.3203 | 43 | 0.0364 | 148 | 0.036 |
| hCV7581501 | USP45 | rs1323717 | G | C | G | 0.879567 | general | 0.7718 | 227 | CG | 0.189 | 985 | 0.2155 | 18 | 0.015 | 58 | 0.013 |
| hCV7625318 | PLEKHG4 | rs3868142 | G | A | A | 0.084256 | recessive | 0.8419 | 182 | AG | 0.152 | 680 | 0.1477 | 26 | 0.0217 | 48 | 0.01 |
| | | | | | | | additive | 0.8419 | 182 | AG | 0.152 | 680 | 0.1477 | 26 | 0.0217 | 48 | 0.01 |
| hCV8241630 | F11 | rs925451 | G | A | A | 0.379287 | general | 0.3912 | 565 | AG | 0.478 | 2074 | 0.459 | 223 | 0.1887 | 677 | 0.15 |
| | | | | | | | recessive | 0.3912 | 565 | AG | 0.478 | 2074 | 0.459 | 223 | 0.1887 | 677 | 0.15 |
| | | | | | | | dominant | 0.3912 | 565 | AG | 0.478 | 2074 | 0.459 | 223 | 0.1887 | 677 | 0.15 |
| | | | | | | | additive | 0.3912 | 565 | AG | 0.478 | 2074 | 0.459 | 223 | 0.1887 | 677 | 0.15 |
| hCV8361354 | PANX1 | rs1138800 | C | A | A | 0.374456 | recessive | 0.3863 | 541 | AC | 0.45 | 2197 | 0.4784 | 196 | 0.1632 | 621 | 0.135 |
| | | | | | | | general | 0.3863 | 541 | AC | 0.45 | 2197 | 0.4784 | 196 | 0.1632 | 621 | 0.135 |
| hCV8717873 | GP6/RDH13 | rs1613662 | A | G | A | 0.816402 | dominant | 0.6654 | 321 | GA | 0.267 | 1388 | 0.3019 | 32 | 0.0266 | 150 | 0.033 |
| | | | | | | | additive | 0.6654 | 321 | GA | 0.267 | 1388 | 0.3019 | 32 | 0.0266 | 150 | 0.033 |
| hCV8726802 | F2 | rs1799963 | G | A | A | 0.009998 | general | 0.98 | 41 | AG | 0.034 | 92 | 0.02 | 1 | 0.0008 | 0 | 0 |
| | | | | | | | dominant | 0.98 | 41 | AG | 0.034 | 92 | 0.02 | 1 | 0.0008 | 0 | 0 |
| | | | | | | | general | 0.98 | 41 | AG | 0.034 | 92 | 0.02 | 1 | 0.0008 | 0 | 0 |

TABLE 25-continued

Table 25. Age- and sex-adjusted association of 52 SNPs with isolated PE in MEGA (p <= 0.05)

| | | | | | | | | | | | | | | |
|---|---|---|---|---|---|---|---|---|---|---|---|---|---|---|
| hCV8911768 | SERPINC1 | rs941988 | C | T | | 0.095461 | additive | 0.8192 | 107 | 0.195 | 474 | 0.1707 | TT | 10 | 0.0182 | 28 | 0.01 |
| hCV8919444 | F5 | rs4524 | T | C | T | 0.737678 | general | 0.5475 | 412 | 0.351 | 1713 | 0.3803 | CC | 58 | 0.0494 | 325 | 0.072 |
| | | | | | | | recessive | 0.5475 | 412 | 0.351 | 1713 | 0.3803 | CC | 58 | 0.0494 | 325 | 0.072 |
| | | | | | | | dominant | 0.5475 | 412 | 0.351 | 1713 | 0.3803 | CC | 58 | 0.0494 | 325 | 0.072 |
| | | | | | | | additive | 0.5475 | 412 | 0.351 | 1713 | 0.3803 | CC | 58 | 0.0494 | 325 | 0.072 |
| hCV9102827 | GPATCH4 | rs3795733 | T | C | C | 0.258025 | general | 0.5669 | 448 | 0.381 | 1440 | 0.3502 | CC | 115 | 0.0977 | 341 | 0.083 |
| | | | | | | | dominant | 0.5669 | 448 | 0.381 | 1440 | 0.3502 | CC | 115 | 0.0977 | 341 | 0.083 |
| | | | | | | | general | 0.5669 | 448 | 0.381 | 1440 | 0.3502 | CC | 115 | 0.0977 | 341 | 0.083 |
| | | | | | | | additive | 0.5669 | 448 | 0.381 | 1440 | 0.3502 | CC | 115 | 0.0977 | 341 | 0.083 |
| hDV70683382 | RABGAP1L | rs16846815 | G | C | C | 0.061982 | general | 0.8789 | 75 | 0.137 | 328 | 0.1182 | CC | 5 | 0.0091 | 8 | 0.003 |
| | | | | | | | recessive | 0.8789 | 75 | 0.137 | 328 | 0.1182 | CC | 5 | 0.0091 | 8 | 0.003 |

TABLE 26

Table 26. Age- and sex-adjusted association of 31 SNPs with cancer-related DVT in MEGA (p <= 0.05)

| Marker | Gene Symbol | RS number | Ref-Allele | NonRef-Allele | Risk Allele | Control RAF | Model | Parameter | P-value | OddsRatio | OR95l | OR95u | Genot | Case Count3 | Case-Freq3 | Control-Count3 |
|---|---|---|---|---|---|---|---|---|---|---|---|---|---|---|---|---|
| hCV11466393 | TACR1 | rs881 | C | G | C | 0.830716 | additive | hCV11466393.GG.GC..adtv | 0.0301 | 0.80141 | 0.6561 | 0.97891 | CC | 346 | 0.7425 | 3125 |
| hCV11503414 | FGG | rs2066865 | G | A | A | 0.265941 | general | hCV11503414.AA | 0.0001 | 1.96423 | 1.3869 | 2.78179 | GG | 196 | 0.4242 | 2426 |
|  |  |  |  |  |  |  | dominant | hCV11503414.GG.dom | 3E-06 | 1.61356 | 1.3218 | 1.96967 | GG | 196 | 0.4242 | 2426 |
|  |  |  |  |  |  |  | recessive | hCV11503414.AA.rec | 0.0056 | 1.59724 | 1.147 | 2.22421 | GG | 196 | 0.4242 | 2426 |
|  |  |  |  |  |  |  | additive | hCV11503414.AG | 4E-05 | 1.55126 | 1.259 | 1.91134 | GG | 196 | 0.4242 | 2426 |
|  |  |  |  |  |  |  |  | hCV11503414.AA.AG.adtv | 1E-06 | 1.4539 | 1.2513 | 1.68933 | GG | 196 | 0.4242 | 2426 |
| hCV11503469 | FGG | rs2066854 | T | A | A | 0.266985 | general | hCV11503469.AA | 0.0004 | 1.87504 | 1.3257 | 2.65193 | TT | 199 | 0.428 | 2423 |
|  |  |  |  |  |  |  | dominant | hCV11503469.TT.dom | 5E-06 | 1.58923 | 1.303 | 1.9383 | TT | 199 | 0.428 | 2423 |
|  |  |  |  |  |  |  | general | hCV11503469.AT | 5E-05 | 1.53661 | 1.24481 | 1.89177 | TT | 199 | 0.428 | 2423 |
|  |  |  |  |  |  |  | recessive | hCV11503469.AA.rec | 0.0112 | 1.53311 | 1.1021 | 2.13262 | TT | 199 | 0428 | 2423 |
|  |  |  |  |  |  |  | additive | hCV11503469.AA.AT.adtv | 3E-06 | 1.42741 | 1.2297 | 1.65692 | TT | 199 | 0.428 | 2423 |
| hCV11503470 |  | rs1800788 | C | T | T | 0.208112 | general | hCV11503470.TT | 0.0413 | 1.52638 | 1.0168 | 2.29142 | CC | 271 | 0.5815 | 2864 |
|  |  |  |  |  |  |  | dominant | hCV11503470.CC.dom | 0.0227 | 1.26427 | 1.0329 | 1.54013 | CC | 271 | 0.5815 | 2864 |
|  |  |  |  |  |  |  | additive | hCV11503470.TT.TC..adtv | 0.0118 | 1.22802 | 1.0466 | 1.44086 | CC | 271 | 0.5815 | 2864 |
| hCV11786258 | KLKB1 | rs4253303 | G | A | A | 0.393142 | general | hCV11786258.AA | 0.0038 | 1.51355 | 1.1429 | 2.00443 | GG | 147 | 0.3148 | 1662 |
|  |  |  |  |  |  |  | recessive | hCV11786258.AA.rec | 0.0109 | 1.37826 | 1.0768 | 1.76415 | GG | 147 | 0.3148 | 1662 |
|  |  |  |  |  |  |  | dominant | hCV11786258.GG.dom | 0.0322 | 1.25844 | 1.0198 | 1.55299 | GG | 147 | 0.3148 | 1662 |
|  |  |  |  |  |  |  | additive | hCV11786258.AA.AG.adtv | 0.0046 | 1.22332 | 1.064 | 1.40651 | GG | 147 | 0.3148 | 1662 |
| hCV11975250 | F5 | rs6025 | C | T | T | 0.026408 | general | hCV11975250.TC | 1E-06 | 2.37719 | 1.6784 | 3.36683 | CC | 428 | 0.8992 | 4311 |
|  |  |  |  |  |  |  | dominant | hCV11975250.CC.dom | 1E-06 | 2.35148 | 1.6662 | 3.31854 | CC | 428 | 0.8992 | 4311 |
|  |  |  |  |  |  |  | additive | hCV11975250.TT.TC..adtv | 2E-06 | 2.20614 | 1.5871 | 3.06664 | CC | 428 | 0.8992 | 4311 |
| hCV15860433 |  | rs2070006 | C | T | T | 0.395787 | general | hCV15860433.TT | 0.0099 | 1.47193 | 1.0975 | 1.97415 | CC | 135 | 0.2922 | 1665 |
|  |  |  |  |  |  |  | dominant | hCV15860433.CC.dom | 0.0013 | 1.42291 | 1.1477 | 1.76413 | CC | 135 | 0.2922 | 1665 |
|  |  |  |  |  |  |  | general | hCV15860433.TC | 0.0031 | 1.4064 | 1.1218 | 1.76314 | CC | 135 | 0.2922 | 1665 |
|  |  |  |  |  |  |  | additive | hCV15860433.TT.TC..adtv | 0.0031 | 1.2365 | 1.0744 | 1.42304 | CC | 135 | 0.2922 | 1665 |
| hCV15968043 | CYP4V2 | rs2292423 | T | A | A | 0.409182 | general | hCV15968043.AA | 0.0076 | 1.458 | 1.1056 | 1.92265 | TT | 143 | 0.3102 | 1562 |
|  |  |  |  |  |  |  | recessive | hCV15968043.AA.rec | 0.0042 | 1.42227 | 1.1178 | 1.80962 | TT | 143 | 0.3102 | 1562 |
|  |  |  |  |  |  |  | additive | hCV15968043.AA.AT.adtv | 0.015 | 1.1906 | 1.0345 | 1.37025 | TT | 143 | 0.3102 | 1562 |
| hCV1841975 | PROC | rs1799810 | A | T | T | 0.431275 | general | hCV1841975.TA | 0.0452 | 1.26045 | 1.005 | 1.58086 | AA | 134 | 0.2888 | 1472 |
| hCV1859855 | GOLGA3/POLE | rs2291260 | T | C | C | 0.218551 | general | hCV1859855.CC | 5E-05 | 2.20173 | 1.5067 | 3.21731 | TT | 263 | 0.5445 | 2757 |
|  |  |  |  |  |  |  | recessive | hCV1859855.CC.rec | 0.0001 | 2.07661 | 1.434 | 3.00721 | TT | 263 | 0.5445 | 2757 |
|  |  |  |  |  |  |  | additive | hCV1859855.CC.CT.adtv | 0.0005 | 1.3222 | 1.1293 | 1.54809 | TT | 263 | 0.5445 | 2757 |
|  |  |  |  |  |  |  | dominant | hCV1859855.TT.dom | 0.0148 | 1.27396 | 1.0486 | 1.54776 | TT | 263 | 0.5445 | 2757 |
| hCV1874482 | ZDHHC6 | rs2306158 | G | A | G | 0.638875 | general | hCV1874482.AA | 0.003 | 0.57869 | 0.403 | 0.83098 | GG | 205 | 0.4586 | 1613 |
|  |  |  |  |  |  |  | recessive | hCV1874482.AA.rec | 0.0049 | 0.6086 | 0.4307 | 0.86006 | GG | 205 | 0.4586 | 1613 |
|  |  |  |  |  |  |  | additive | hCV1874482.AA.AG.adtv | 0.0068 | 0.81053 | 0.6962 | 0.94361 | GG | 205 | 0.4586 | 1613 |
| hCV2144411 | NDUFB8/SEC31B | rs3763695 | A | G | A | 0.773979 | dominant | hCV2144411.AA.dom | 0.0498 | 0.81788 | 0.669 | 0.99986 | AA | 310 | 0.6418 | 2736 |
| hCV2211618 | DDT | rs12483950 | C | G | G | 0.429318 | recessive | hCV2211618.GG | 0.0431 | 1.32796 | 1.0088 | 1.74808 | CC | 144 | 0.3013 | 1478 |
|  |  |  |  |  |  |  | recessive | hCV2211618.GG.rec | 0.0494 | 1.26949 | 1.0006 | 1.61058 | CC | 144 | 0.3013 | 1478 |
| hCV2303891 | APOH | rs1801690 | C | G | G | 0.054656 | general | hCV2303891.GG | 0.0001 | 11.0922 | 3.2537 | 37.8146 | CC | 402 | 0.8701 | 4023 |
|  |  |  |  |  |  |  | dominant | hCV2303891.GG.rec | 0.0001 | 9.9845 | 3.2237 | 37.4293 | CC | 402 | 0.8701 | 4023 |
| hCV2599O131 | CYP4V2 | rs13146272 | A | C | A | 0.64085 | dominant | hCV25990131.CC..AA.dom | 0.0243 | 0.79512 | 0.6513 | 0.97074 | AA | 213 | 0.4702 | 1814 |
|  |  |  |  |  |  |  | additive | hCV25990131.CC..CA.adtv | 0.0198 | 0.83799 | 0.7222 | 0.97232 | AA | 213 | 0.4702 | 1814 |

TABLE 26-continued

Table 26. Age- and sex-adjusted association of 31 SNPs with cancer-related DVT in MEGA (p <= 0.05)

| Marker | Gene Symbol | RS number | Ref-Allele | NonRef-Allele | Risk Allele | Control RAF | Model | Genot1 | Case Freq1 | Control Freq1 | Genot2 | Case Freq2 | Control Freq2 | Genot3 | Case Count3 | Case Freq3 | Control Count3 | Control Freq3 |
|---|---|---|---|---|---|---|---|---|---|---|---|---|---|---|---|---|---|---|
| hCV26175114 | TUBA4A | rs3731892 | A | G | G | 0.108496 | general | hCV26175114.GG | 0.0039 | 2.45516 | 1.3332 | 4.52126 | AA | 371 | 0.7762 | 3655 |
| | | | | | | | recessive | hCV26175114.GG.rec | 0.0049 | 2.39667 | 1.3042 | 4.40436 | AA | 371 | 0.7762 | 3655 |
| | | | | | | | additive | hCV26175114.GG.GA.adtv | 0.0226 | 1.26882 | 1.034 | 1.55701 | AA | 371 | 0.7762 | 3655 |
| hCV27474895 | F11 | rs3756011 | C | A | A | 0.405226 | general | hCV27474895.AA | 0.0382 | 1.35187 | 1.0165 | 1.79786 | CC | 141 | 0.3045 | 1619 |
| | | | | | | | dominant | hCV27474895.CC.dom | 0.0202 | 1.28699 | 1.0402 | 1.59237 | CC | 141 | 0.3045 | 1619 |
| | | | | | | | general | hCV27474895.AC | 0.0425 | 1.26294 | 1.0079 | 1.5825 | CC | 141 | 0.3045 | 1619 |
| | | | | | | | additive | hCV27474895.AA.AC.adtv | 0.0234 | 1.1738 | 1.0219 | 1.34829 | CC | 141 | 0.3045 | 1619 |
| hCV27477533 | F11 | rs3756008 | A | T | T | 0.395815 | general | hCV27477533.TT | 0.0337 | 1.35365 | 1.0236 | 1.79005 | AA | 152 | 0.3269 | 1671 |
| | | | | | | | additive | hCV27477533.TT.TA.adtv | 0.0358 | 1.15943 | 1.0099 | 1.33116 | AA | 152 | 0.3269 | 1671 |
| hCV27502514 | KLF3 | rs3796533 | G | A | A | 0.164108 | general | hCV27502514.AA | 0.0467 | 1.71209 | 1.0078 | 2.90852 | GG | 308 | 0.6681 | 3134 |
| | | | | | | | additive | hCV27502514.AA.AG.adtv | 0.0227 | 1.23385 | 1.0298 | 1.47838 | GG | 308 | 0.6681 | 3134 |
| hCV2892877 | FGA | rs6050 | T | C | C | 0.23658 | dominant | hCV2892877.TT.dom | 0.0003 | 1.47541 | 1.1978 | 1.81744 | TT | 183 | 0.441 | 2237 |
| | | | | | | | general | hCV2892877.CC.CT.adtv | 0.0002 | 1.46842 | 1.1983 | 1.79943 | TT | 183 | 0.441 | 2237 |
| | | | | | | | additive | hCV2892877.CT | 0.0003 | 1.46956 | 1.1923 | 1.8113 | TT | 183 | 0.441 | 2237 |
| hCV3004828 | TNFSF4 | rs6700269 | C | T | T | 0.099423 | general | hCV3004828.TC | 0.0374 | 1.39291 | 1.0194 | 1.90319 | CC | 213 | 0.7662 | 2257 |
| | | | | | | | dominant | hCV3004828.CC.dom | 0.0342 | 1.38941 | 1.0247 | 1.88389 | CC | 213 | 0.7662 | 2257 |
| | | | | | | | additive | hCV3004828.TT.TC.adtv | 0.0421 | 1.32811 | 1.0101 | 1.74635 | CC | 213 | 0.7662 | 2257 |
| hCV3230038 | F11 | rs2289252 | C | T | T | 0.403825 | general | hCV3230038.TT | 0.0241 | 1.38491 | 1.0436 | 1.83792 | CC | 143 | 0.3082 | 1626 |
| | | | | | | | dominant | hCV3230038.CC.dom | 0.0236 | 1.27762 | 1.0334 | 1.57953 | CC | 143 | 0.3082 | 1626 |
| | | | | | | | additive | hCV3230038.TT.TC.adtv | 0.017 | 1.18364 | 1.0307 | 1.35933 | CC | 143 | 0.3082 | 1626 |
| hCV3230096 | CYP4V2 | rs3817184 | C | T | T | 0.415431 | general | hCV3230096.TT | 0.0064 | 1.46092 | 1.1125 | 1.91853 | CC | 144 | 0.3103 | 1546 |
| | | | | | | | recessive | hCV3230096.TT.rec | 0.0039 | 1.41651 | 1.1182 | 1.7944 | CC | 144 | 0.3103 | 1546 |
| | | | | | | | additive | hCV3230096.TT.TC.adtv | 0.0117 | 1.19499 | 1.0405 | 1.37242 | CC | 144 | 0.3103 | 1546 |
| hCV3230113 | CYP4V2 | rs1053094 | A | T | T | 0.490487 | recessive | hCV3230113.TT.rec | 0.0189 | 1.30142 | 1.0444 | 1.62169 | AA | 111 | 0.2403 | 1158 |
| hCV596331 | F9 | rs6048 | A | G | A | 0.698278 | dominant | hCV596331.GG | 0.0476 | 0.76464 | 0.5863 | 0.99719 | AA | 313 | 0.644 | 2719 |
| | | | | | | | additive | hCV596331.AA.dom | 0.0411 | 0.8085 | 0.6593 | 0.99142 | AA | 313 | 0.644 | 2719 |
| | | | | | | | additive | hCV596331.GG.GA.adtv | 0.0334 | 0.87259 | 0.7696 | 0.98931 | AA | 313 | 0.644 | 2719 |
| hCV7422466 | C9orf103 | rs1052690 | A | C | C | 0.196354 | recessive | hCV7422466.CC.rec | 0.0402 | 1.59328 | 1.021 | 2.4864 | GG | 311 | 0.6466 | 2630 |
| hCV7459627 | WBP11P1 | rs1985293 | A | G | G | 0.30776 | recessive | hCV7459627.GG.rec | 0.0057 | 1.50827 | 1.1268 | 2.01898 | GG | 225 | 0.463 | 2189 |
| | | | | | | | general | hCV7459627.GG | 0.0117 | 1.48469 | 1.092 | 2.01856 | GG | 225 | 0.463 | 2189 |
| hCV8726802 | F2 | rs1799963 | G | A | A | 0.009998 | additive | hCV8726802.AA.AG.adtv | 5E-06 | 2.86622 | 1.8273 | 4.49576 | GG | 454 | 0.9419 | 4509 |
| | | | | | | | dominant | hCV8726802.GG.dom | 8E-06 | 2.85006 | 1.8019 | 4.50807 | GG | 454 | 0.9419 | 4509 |
| | | | | | | | general | hCV8726802.AG | 2E-05 | 2.75908 | 1.7344 | 4.38918 | GG | 454 | 0.9419 | 4509 |
| hCV8919444 | F5 | rs4524 | T | C | T | 0.737678 | general | hCV8919444.CT | 0.0322 | 0.79363 | 0.6424 | 0.9805 | TT | 272 | 0.5849 | 2466 |
| | | | | | | | dominant | hCV8919444.TT.dom | 0.0388 | 0.8105 | 0.664 | 0.98929 | TT | 272 | 0.5849 | 2466 |
| hCV8957432 | RAC2 | rs6572 | G | C | G | 0.55628 | general | hCV8957432.CC | 0.032 | 0.72918 | 0.5464 | 0.97313 | GG | 169 | 0.3499 | 1439 |
| | | | | | | | additive | hCV8957432.CC.CG.adtv | 0.0353 | 0.86194 | 0.7506 | 0.98985 | GG | 169 | 0.3499 | 1439 |
| hCV9102827 | GPATCH4 | rs3795733 | T | C | C | 0.258025 | general | hCV9102827.CT | 0.0224 | 1.27189 | 1.0347 | 1.56351 | TT | 246 | 0.5136 | 2331 |
| | | | | | | | dominant | hCV9102827.TT.dom | 0.0202 | 1.26146 | 1.037 | 1.53456 | TT | 246 | 0.5136 | 2331 |
| | | | | | | | additive | hCV9102827.CC.CT.adtv | 0.0424 | 1.16745 | 1.0054 | 1.35567 | TT | 246 | 0.5136 | 2331 |

| Marker | Gene Symbol | RS number | Control-Freq3 | Model | Control-Freq4 | Case-Freq4 | Case Count4 | Control-Count4 | Control-Freq4 | Genot5 | Case-Count5 | Case-Freq5 | Control-Count5 | Control-Freq5 |
|---|---|---|---|---|---|---|---|---|---|---|---|---|---|---|
| hCV11466393 | TACR1 | rs881 | 0.691 | additive | GC | 0.24251263 | 113 | 263 | 0.2793 | GG | 7 | 0.015 | 134 | 0.0296 |
| hCV11503414 | FGG | rs2066865 | 0.539 | general | AG | 0.46971756 | 217 | 1756 | 0.3901 | AA | 49 | 0.1061 | 319 | 0.0709 |
| | | | 0.539 | dominant | AG | 0.46971756 | 217 | 1756 | 0.3901 | AA | 49 | 0.1061 | 319 | 0.0709 |
| | | | 0.539 | recessive | AG | 0.46971756 | 217 | 1756 | 0.3901 | AA | 49 | 0.1061 | 319 | 0.0709 |
| | | | 0.539 | general | AG | 0.46971756 | 217 | 1756 | 0.3901 | AA | 49 | 0.1061 | 319 | 0.0709 |
| | | | 0.539 | additive | AG | 0.46971756 | 217 | 1756 | 0.3901 | AA | 49 | 0.1061 | 319 | 0.0709 |

TABLE 26-continued

Table 26. Age- and sex-adjusted association of 31 SNPs with cancer-related DVT in MEGA (p <= 0.05)

| | | | | | | | | | | | | | |
|---|---|---|---|---|---|---|---|---|---|---|---|---|---|
| hCV11503469 | FGG | rs2066854 | T | A | | 0.266985 | general | 0.538 | AT | 217 | 1757 | 0.4667 | 0.3901 | 49 | 0.1054 | 324 | 0.0719 |
| | | | | | | | dominant | 0.538 | AT | 217 | 1757 | 0.4667 | 0.3901 | 49 | 0.1054 | 324 | 0.0719 |
| | | | | | | | general | 0.538 | AT | 217 | 1757 | 0.4667 | 0.3901 | 49 | 0.1054 | 324 | 0.0719 |
| | | | | | | | recessive | 0.538 | AT | 217 | 1757 | 0.4667 | 0.3901 | 49 | 0.1054 | 324 | 0.0719 |
| | | | | | | | additive | 0.538 | AT | 217 | 1757 | 0.4667 | 0.3901 | 49 | 0.1054 | 324 | 0.0719 |
| hCV11503470 | | rs1800788 | C | | T | 0.208112 | general | 0.633 | TC | 163 | 1437 | 0.3498 | 0.3176 | 32 | 0.0687 | 223 | 0.0493 |
| | | | | | | | dominant | 0.633 | TC | 163 | 1437 | 0.3498 | 0.3176 | 32 | 0.0687 | 223 | 0.0493 |
| | | | | | | | additive | 0.633 | TC | 163 | 1437 | 0.3498 | 0.3176 | 32 | 0.0687 | 223 | 0.0493 |
| hCV11786258 | KLKB1 | rs4253303 | G | | A | 0.393142 | general | 0.368 | AG | 224 | 2162 | 0.4797 | 0.4783 | 96 | 0.2056 | 696 | 0.154 |
| | | | | | | | recessive | 0.368 | AG | 224 | 2162 | 0.4797 | 0.4783 | 96 | 0.2056 | 696 | 0.154 |
| | | | | | | | dominant | 0.368 | AG | 224 | 2162 | 0.4797 | 0.4783 | 96 | 0.2056 | 696 | 0.154 |
| | | | | | | | additive | 0.368 | AG | 224 | 2162 | 0.4797 | 0.4783 | 96 | 0.2056 | 696 | 0.154 |
| hCV11975250 | F5 | rs6025 | C | | T | 0.026408 | general | 0.949 | TC | 47 | 226 | 0.0987 | 0.0497 | 1 | 0.0021 | 7 | 0.0015 |
| | | | | | | | dominant | 0.949 | TC | 47 | 226 | 0.0987 | 0.0497 | 1 | 0.0021 | 7 | 0.0015 |
| | | | | | | | additive | 0.949 | TC | 47 | 226 | 0.0987 | 0.0497 | 1 | 0.0021 | 7 | 0.0015 |
| hCV15860433 | | rs2070006 | C | | T | 0.395787 | general | 0.369 | TC | 242 | 2120 | 0.5238 | 0.4701 | 85 | 0.184 | 725 | 0.1608 |
| | | | | | | | dominant | 0.369 | TC | 242 | 2120 | 0.5238 | 0.4701 | 85 | 0.184 | 725 | 0.1608 |
| | | | | | | | recessive | 0.369 | TC | 242 | 2120 | 0.5238 | 0.4701 | 85 | 0.184 | 725 | 0.1608 |
| | | | | | | | additive | 0.369 | TC | 242 | 2120 | 0.5238 | 0.4701 | 85 | 0.184 | 725 | 0.1608 |
| hCV15968043 | CYP4V2 | rs2292423 | T | | A | 0.409182 | general | 0.348 | AT | 215 | 2178 | 0.4664 | 0.4854 | 103 | 0.2234 | 747 | 0.1665 |
| | | | | | | | recessive | 0.348 | AT | 215 | 2178 | 0.4664 | 0.4854 | 103 | 0.2234 | 747 | 0.1665 |
| | | | | | | | additive | 0.348 | AT | 215 | 2178 | 0.4664 | 0.4854 | 103 | 0.2234 | 747 | 0.1665 |
| hCV1841975 | PROC | rs1799810 | A | | T | 0.431275 | general | 0.326 | TA | 249 | 2195 | 0.5366 | 0.4858 | 81 | 0.1746 | 851 | 0.1884 |
| hCV1859855 | GOLGA3/POLE | rs2291260 | T | | C | 0.218551 | dominant | 0.605 | CT | 179 | 1605 | 0.3706 | 0.3524 | 41 | 0.0849 | 193 | 0.0424 |
| | | | | | | | recessive | 0.605 | CT | 179 | 1605 | 0.3706 | 0.3524 | 41 | 0.0849 | 193 | 0.0424 |
| | | | | | | | additive | 0.605 | CT | 179 | 1605 | 0.3706 | 0.3524 | 41 | 0.0849 | 193 | 0.0424 |
| hCV1874482 | ZDHHC6 | rs2306158 | G | | A | 0.638875 | general | 0.416 | AG | 202 | 1724 | 0.4519 | 0.445 | 40 | 0.0895 | 537 | 0.1386 |
| | | | | | | | recessive | 0.416 | AG | 202 | 1724 | 0.4519 | 0.445 | 40 | 0.0895 | 537 | 0.1386 |
| | | | | | | | additive | 0.416 | AG | 202 | 1724 | 0.4519 | 0.445 | 40 | 0.0895 | 537 | 0.1386 |
| hCV2144411 | NDUFB8/SEC31B | rs3763695 | A | | G | 0.773979 | dominant | 0.598 | GA | 152 | 1613 | 0.3147 | 0.3524 | 21 | 0.0435 | 228 | 0.0498 |
| hCV2211618 | DDT | rs12483950 | C | | G | 0.429318 | general | 0.329 | GC | 230 | 2179 | 0.4812 | 0.4843 | 104 | 0.2176 | 842 | 0.1872 |
| | | | | | | | recessive | 0.329 | GC | 230 | 2179 | 0.4812 | 0.4843 | 104 | 0.2176 | 842 | 0.1872 |
| hCV2303891 | APOH | rs1801690 | C | | G | 0.054656 | general | 0.892 | GC | 54 | 481 | 0.1169 | 0.1067 | 6 | 0.013 | 6 | 0.0013 |
| | | | | | | | recessive | 0.892 | GC | 54 | 481 | 0.1169 | 0.1067 | 6 | 0.013 | 6 | 0.0013 |
| hCV25990131 | CYP4V2 | rs13146272 | A | | C | 0.64085 | dominant | 0.414 | CA | 190 | 1982 | 0.4194 | 0.4528 | 50 | 0.1104 | 581 | 0.1327 |
| | | | | | | | additive | 0.414 | CA | 190 | 1982 | 0.4194 | 0.4528 | 50 | 0.1104 | 581 | 0.1327 |
| hCV26175114 | TUBA4A | rs3731892 | A | | G | 0.108496 | general | 0.8 | GA | 93 | 833 | 0.1946 | 0.1824 | 14 | 0.0293 | 79 | 0.0173 |
| | | | | | | | recessive | 0.8 | GA | 93 | 833 | 0.1946 | 0.1824 | 14 | 0.0293 | 79 | 0.0173 |
| hCV27474895 | F11 | rs3756011 | C | | A | 0.405226 | general | 0.359 | AC | 230 | 2134 | 0.4968 | 0.4725 | 92 | 0.1987 | 763 | 0.169 |
| | | | | | | | dominant | 0.359 | AC | 230 | 2134 | 0.4968 | 0.4725 | 92 | 0.1987 | 763 | 0.169 |
| | | | | | | | additive | 0.359 | AC | 230 | 2134 | 0.4968 | 0.4725 | 92 | 0.1987 | 763 | 0.169 |
| hCV27477533 | F11 | rs3756008 | A | | T | 0.395815 | general | 0.37 | TA | 218 | 2115 | 0.4688 | 0.4683 | 95 | 0.2043 | 730 | 0.1616 |
| | | | | | | | additive | 0.37 | TA | 218 | 2115 | 0.4688 | 0.4683 | 95 | 0.2043 | 730 | 0.1616 |
| hCV27502514 | KLF3 | rs3796533 | G | | A | 0.164108 | general | 0.697 | AG | 135 | 1245 | 0.2928 | 0.277 | 18 | 0.039 | 115 | 0.0256 |
| | | | | | | | additive | 0.697 | AG | 135 | 1245 | 0.2928 | 0.277 | 18 | 0.039 | 115 | 0.0256 |

TABLE 26-continued

Table 26. Age- and sex-adjusted association of 31 SNPs with cancer-related DVT in MEGA (p <= 0.05)

| | | | | | | | | | | | | | | | | |
|---|---|---|---|---|---|---|---|---|---|---|---|---|---|---|---|---|
| hCV2892877 | FGA | rs6050 | T | C | C | | 0.23658 | dominant | 0.531 | CT | 229 | 0.5518 | 1954 | 0.4641 | CC | 3 | 0.0072 | 19 | 0.0045 |
| | | | | | | | | additive | 0.531 | CT | 229 | 0.5518 | 1954 | 0.4641 | CC | 3 | 0.0072 | 19 | 0.0045 |
| | | | | | | | | general | 0.531 | CT | 229 | 0.5518 | 1954 | 0.4641 | CC | 3 | 0.0072 | 19 | 0.0045 |
| hCV30040828 | TNFSF4 | rs6700269 | C | T | T | | 0.099423 | dominant | 0.815 | TC | 61 | 0.2194 | 477 | 0.1721 | TT | 4 | 0.0144 | 37 | 0.0134 |
| | | | | | | | | additive | 0.815 | TC | 61 | 0.2194 | 477 | 0.1721 | TT | 4 | 0.0144 | 37 | 0.0134 |
| | | | | | | | | general | 0.815 | TC | 61 | 0.2194 | 477 | 0.1721 | TT | 4 | 0.0144 | 37 | 0.0134 |
| hCV3230038 | F11 | rs2289252 | C | T | T | | 0.403825 | dominant | 0.359 | TC | 227 | 0.4892 | 2141 | 0.4734 | TT | 94 | 0.2026 | 756 | 0.1671 |
| | | | | | | | | additive | 0.359 | TC | 227 | 0.4892 | 2141 | 0.4734 | TT | 94 | 0.2026 | 756 | 0.1671 |
| | | | | | | | | general | 0.359 | TC | 227 | 0.4892 | 2141 | 0.4734 | TT | 94 | 0.2026 | 756 | 0.1671 |
| hCV3230096 | CYP4V2 | rs3817184 | C | T | T | | 0.415431 | recessive | 0.342 | TC | 212 | 0.4569 | 2189 | 0.4846 | TT | 108 | 0.2328 | 782 | 0.1731 |
| | | | | | | | | additive | 0.342 | TC | 212 | 0.4569 | 2189 | 0.4846 | TT | 108 | 0.2328 | 782 | 0.1731 |
| | | | | | | | | general | 0.342 | TC | 212 | 0.4569 | 2189 | 0.4846 | TT | 108 | 0.2328 | 782 | 0.1731 |
| hCV3230113 | CYP4V2 | rs1053094 | A | T | T | | 0.490487 | recessive | 0.256 | TA | 218 | 0.4719 | 2290 | 0.5066 | TT | 133 | 0.2879 | 1072 | 0.2372 |
| hCV596331 | F9 | rs6048 | A | G | A | | 0.698278 | general | 0.593 | GA | 92 | 0.1893 | 968 | 0.211 | GG | 81 | 0.1667 | 900 | 0.1962 |
| | | | | | | | | dominant | 0.593 | GA | 92 | 0.1893 | 968 | 0.211 | GG | 81 | 0.1667 | 900 | 0.1962 |
| | | | | | | | | additive | 0.593 | GA | 92 | 0.1893 | 968 | 0.211 | GG | 81 | 0.1667 | 900 | 0.1962 |
| hCV7422466 | C9orf103 | rs1052690 | A | C | C | | 0.196354 | recessive | 0.644 | CA | 144 | 0.2994 | 1309 | 0.3203 | CC | 26 | 0.0541 | 148 | 0.0362 |
| hCV7459627 | WBP11P1 | rs1985293 | A | G | G | | 0.30776 | recessive | 0.478 | GA | 197 | 0.4053 | 1956 | 0.4275 | GG | 64 | 0.1317 | 430 | 0.094 |
| | | | | | | | | general | 0.478 | GA | 197 | 0.4053 | 1956 | 0.4275 | GG | 64 | 0.1317 | 430 | 0.094 |
| hCV8726802 | F2 | rs1799963 | G | A | A | | 0.009998 | additive | 0.98 | AG | 27 | 0.056 | 92 | 0.02 | AA | 1 | 0.0021 | 0 | 0 |
| | | | | | | | | dominant | 0.98 | AG | 27 | 0.056 | 92 | 0.02 | AA | 1 | 0.0021 | 0 | 0 |
| | | | | | | | | general | 0.98 | AG | 27 | 0.056 | 92 | 0.02 | AA | 1 | 0.0021 | 0 | 0 |
| hCV8919444 | F5 | rs4524 | T | C | T | | 0.737678 | general | 0.548 | CT | 158 | 0.3398 | 1713 | 0.3803 | CC | 35 | 0.0753 | 325 | 0.0722 |
| | | | | | | | | dominant | 0.548 | CT | 158 | 0.3398 | 1713 | 0.3803 | CC | 35 | 0.0753 | 325 | 0.0722 |
| hCV8957432 | RAC2 | rs6572 | G | C | G | | 0.55628 | additive | 0.313 | CG | 236 | 0.4886 | 2242 | 0.4872 | CC | 78 | 0.1615 | 921 | 0.2001 |
| hCV9102827 | GPATCH4 | rs3795733 | T | C | C | | 0.258025 | general | 0.567 | CT | 193 | 0.4029 | 1440 | 0.3502 | CC | 40 | 0.0835 | 341 | 0.0829 |
| | | | | | | | | dominant | 0.567 | CT | 193 | 0.4029 | 1440 | 0.3502 | CC | 40 | 0.0835 | 341 | 0.0829 |
| | | | | | | | | additive | 0.567 | CT | 193 | 0.4029 | 1440 | 0.3502 | CC | 40 | 0.0835 | 341 | 0.0829 |

TABLE 27

Table 27. Additive association for 123 finemapping SNPs with DVT in LETS, with LD data from Hapmap (p-value cutoff <= 0.1 in LETS)

| marker | annotation | P Value | OR (95% CI) | Additive Model Comparison | Finemapping target | R-Squared | D-Prime | Distance Between Targets |
|---|---|---|---|---|---|---|---|---|
| hDV70683187 | (rs16846561) | 0.022041 | 1.43 (1.05-1.93) | G_vs_C | SERPINC1 (hCV16180170) | 1 | 1 | 17106 |
| hCV16135173 | (rs2146372) | 0.033754 | 1.39 (1.03-1.89) | C_vs_G | SERPINC1 (hCV16180170) | 1 | 1 | 16648 |
| hCV15956077 | SERPINC1 (rs2227611) | 0.093487 | 6.14 (0.74-51.16) | G_vs_A | SERPINC1 (hCV16180170) | not hapmap | not hapmap | not hapmap |
| hCV8911768 | SERPINC1 (rs941988) | 0.017019 | 1.46 (1.07-1.98) | T_vs_C | SERPINC1 (hCV16180170) | 1 | 1 | 4324 |
| hCV15956034 | SERPINC1 (rs2227603) | 0.077266 | 1.71 (0.94-3.09) | A_vs_C | SERPINC1 (hCV16180170) | 0.0129 | 0.2026 | 3669 |
| hCV15956059 | SERPINC1 (rs2227592) | 0.022768 | 1.44 (1.05-1.96) | T_vs_C | SERPINC1 (hCV16180170) | 1 | 1 | 505 |
| hCV16180170 | SERPINC1 (rs2227589) | 0.025749 | 1.42 (1.04-1.94) | T_vs_C | SERPINC1 (hCV16180170) | 1 | 1 | 1 |
| hCV11975658 | (rs1951626) | 0.078232 | 1.2 (0.98-1.47) | A_vs_G | SERPINC1 (hCV16180170) | 0.204 | 1 | 5886 |
| hDV70683212 | RC3H1 (rs16846593) | 0.044415 | 1.45 (1.01-2.07) | G_vs_C | SERPINC1 (hCV16180170) | 0.425 | 1 | 12002 |
| hCV30440155 | (rs6699146) | 0.061774 | 1.19 (0.99-1.43) | C_vs_G | SERPINC1 (hCV16180170) | 0.1123 | 1 | 173307 |
| hCV30205817 | RABGAP1L (rs10489254) | 0.073088 | 1.42 (0.97-2.09) | T_vs_C | SERPINC1 (hCV16180170) | 0.3247 | 0.7784 | 311586 |
| hCV25932979 | RABGAP1L (rs16846809) | 0.096111 | 1.38 (0.94-2.02) | G_vs_A | SERPINC1 (hCV16180170) | 0.2519 | 0.7228 | 333183 |
| hDV70683382 | RABGAP1L (rs16846815) | 0.040023 | 1.49 (1.02-2.18) | C_vs_G | SERPINC1 (hCV16180170) | 0.3247 | 0.7784 | 334327 |
| hCV815038 | RGS7 (rs390488) | 0.096645 | 1.18 (0.97-1.43) | T_vs_C | RGS7 (hCV916107) | 0.1298 | 0.6645 | 92924 |
| hCV1703855 | RGS7 (rs261828) | 0.082919 | 1.19 (0.98-1.44) | C_vs_T | RGS7 (hCV916107) | 0.1108 | 0.6027 | 90577 |
| hCV1703867 | RGS7 (rs261861) | 0.028305 | 1.24 (1.02-1.5) | T_vs_C | RGS7 (hCV916107) | 0.0283 | 0.2557 | 66200 |
| hCV29269378 | RGS7 (rs6657406) | 0.085115 | 1.49 (0.95-2.36) | G_vs_A | RGS7 (hCV916107) | 0.0129 | 1 | 56263 |
| hCV30626715 | RGS7 (rs6690744) | 0.058389 | 1.2 (0.99-1.45) | G_vs_T | RGS7 (hCV916107) | 0.2435 | 0.7882 | 28216 |
| hCV31714450 | RGS7 (rs6429232) | 0.039477 | 1.22 (1.01-1.48) | T_vs_C | RGS7 (hCV916107) | 0.2201 | 0.7854 | 27206 |
| hCV26887403 | RGS7 (rs6682084) | 0.054414 | 1.2 (1-1.44) | C_vs_A | RGS7 (hCV916107) | 0.279 | 0.6754 | 26666 |
| hCV1703892 | RGS7 (rs3893179) | 0.086181 | 1.18 (0.98-1.43) | T_vs_A | RGS7 (hCV916107) | 0.2315 | 0.7973 | 26412 |
| hCV27878067 | RGS7 (rs4660016) | 0.069991 | 1.19 (0.99-1.44) | G_vs_A | RGS7 (hCV916107) | 0.2315 | 0.7973 | 26331 |
| hCV27956129 | RGS7 (rs4659585) | 0.072323 | 1.19 (0.98-1.44) | A_vs_C | RGS7 (hCV916107) | 0.2315 | 0.7973 | 26266 |
| hCV8857351 | RGS7 (rs2341021) | 0.073263 | 1.19 (0.98-1.43) | T_vs_C | RGS7 (hCV916107) | 0.2315 | 0.7973 | 21760 |
| hCV1703910 | RGS7 (rs3911618) | 0.033677 | 1.23 (1.02-1.48) | A_vs_G | RGS7 (hCV916107) | 0.263 | 0.8034 | 16533 |
| hCV26887434 | RGS7 (rs12723522) | 0.056937 | 1.2 (0.99-1.45) | C_vs_A | RGS7 (hCV916107) | 0.2787 | 0.8674 | 14037 |
| hCV8856223 | RGS7 (rs1382243) | 0.039025 | 1.22 (1.01-1.47) | G_vs_C | RGS7 (hCV916107) | 0.3276 | 0.7273 | 7275 |
| hCV916106 | RGS7 (rs575226) | 0.021282 | 1.26 (1.04-1.54) | A_vs_G | RGS7 (hCV916107) | 1 | 1 | 128 |
| hCV916107 | LOC729138 (rs670659) | 0.017944 | 1.27 (1.04-1.54) | C_vs_T | RGS7 (hCV916107) | 1 | 1 | 1 |
| hCV26887464 | RGS7 (rs6669640) | 0.092625 | 1.18 (0.97-1.43) | A_vs_G | RGS7 (hCV916107) | 0.6131 | 0.874 | 6356 |
| hCV31056155 | SDCCAG8 (rs12131952) | 0.018087 | 1.74 (1.1-2.75) | G_vs_C | AKT3 (hCV233148) | 0.0258 | 1 | 81464 |
| hCV15755949 | SDCCAG8 (rs2997494) | 0.098814 | 1.35 (0.94-1.94) | G_vs_A | AKT3 (hCV233148) | 0.0403 | 1 | 54670 |
| hCV26338482 | SDCCAG8 (rs10803143) | 0.050211 | 1.23 (1-1.51) | T_vs_C | AKT3 (hCV233148) | 0.1943 | 0.4617 | 53762 |
| hCV26338512 | SDCCAG8 (rs2994339) | 0.002976 | 1.41 (1.12-1.77) | G_vs_A | AKT3 (hCV233148) | 0.4321 | 0.8476 | 27931 |
| hCV26338513 | AKT3 (rs3006917) | 0.004793 | 1.39 (1.1-1.74) | T_vs_C | AKT3 (hCV233148) | 0.4774 | 0.8689 | 27380 |
| hCV26034157 | LOC729199 (rs2994329) | 0.012253 | 1.32 (1.06-1.64) | T_vs_C | AKT3 (hCV233148) | 0.5147 | 0.8759 | 21430 |
| hCV30690784 | SDCCAG8 (rs4658574) | 0.01138 | 1.32 (1.06-1.64) | C_vs_T | AKT3 (hCV233148) | 0.7442 | 0.9033 | 18635 |
| hCV26034142 | AKT3 (rs9428576) | 0.024681 | 1.23 (1.03-1.47) | C_vs_T | AKT3 (hCV233148) | 0.4446 | 1 | 7324 |
| hCV12073840 | AKT3 (rs14403) | 0.005929 | 1.36 (1.09-1.69) | T_vs_C | AKT3 (hCV233148) | 0.8697 | 1 | 5458 |
| hCV9493081 | AKT3 (rs1058304) | 0.000379 | 1.45 (1.18-1.78) | T_vs_C | AKT3 (hCV233148) | 1 | 1 | 4494 |
| hCV233148 | AKT3 (rs1417121) | 0.000345 | 1.45 (1.18-1.78) | C_vs_G | AKT3 (hCV233148) | 1 | 1 | 1 |
| hCV30690777 | AKT3 (rs12045585) | 0.035416 | 1.32 (1.02-1.72) | A_vs_G | AKT3 (hCV233148) | 0.3153 | 0.8291 | 3750 |
| hCV30690778 | AKT3 (rs12140414) | 0.002597 | 1.44 (1.14-1.82) | C_vs_T | AKT3 (hCV233148) | 0.5904 | 0.9381 | 5038 |
| hCV97631 | AKT3 (rs1538773) | 9.68E-05 | 1.55 (1.24-1.92) | G_vs_T | AKT3 (hCV233148) | 0.6656 | 0.9434 | 5333 |
| hCV30690780 | AKT3 (rs10737888) | 3.78E-05 | 1.58 (1.27-1.96) | C_vs_A | AKT3 (hCV233148) | 0.6656 | 0.9434 | 9134 |
| hCV8688111 | AKT3 (rs1578275) | 0.001215 | 1.49 (1.17-1.89) | C_vs_G | AKT3 (hCV233148) | 0.5904 | 0.9381 | 11093 |
| hCV26719108 | AKT3 (rs10927035) | 0.001896 | 1.36 (1.12-1.66) | C_vs_T | AKT3 (hCV233148) | 0.2417 | 0.7058 | 34633 |
| hCV29210363 | AKT3 (rs6656918) | 5.24E-05 | 1.56 (1.26-1.94) | G_vs_A | AKT3 (hCV233148) | 0.656 | 0.941 | 36875 |
| hCV26719113 | AKT3 (rs7517340) | 0.000163 | 1.58 (1.24-2) | T_vs_C | AKT3 (hCV233148) | 0.3991 | 0.9147 | 40841 |
| hCV26719121 | AKT3 (rs10927041) | 0.000111 | 1.59 (1.26-2) | C_vs_T | AKT3 (hCV233148) | 0.5615 | 1 | 62541 |
| hCV31523608 | AKT3 (rs12744297) | 0.005758 | 1.32 (1.08-1.61) | G_vs_A | AKT3 (hCV233148) | 0.1547 | 0.4381 | 64947 |
| hCV31523638 | AKT3 (rs12037013) | 0.002893 | 1.49 (1.15-1.93) | A_vs_G | AKT3 (hCV233148) | 0.382 | 0.9142 | 114858 |
| hCV31523643 | AKT3 (rs6671475) | 0.000377 | 1.52 (1.21-1.91) | G_vs_A | AKT3 (hCV233148) | 0.4875 | 0.9224 | 119993 |
| hCV31523557 | AKT3 (rs10754807) | 0.000179 | 1.57 (1.24-1.98) | A_vs_G | AKT3 (hCV233148) | 0.4481 | 0.9239 | 134809 |
| hCV15885425 | AKT3 (rs2290754) | 0.000145 | 1.57 (1.24-1.97) | C_vs_A | AKT3 (hCV233148) | 0.4499 | 0.9244 | 136919 |
| hCV1678682 | AKT3 (rs320339) | 0.00034 | 1.51 (1.21-1.9) | T_vs_G | AKT3 (hCV233148) | 0.3838 | 0.9147 | 201561 |
| hCV1678674 | AKT3 (rs1458023) | 0.000408 | 1.5 (1.2-1.88) | C_vs_T | AKT3 (hCV233148) | 0.3517 | 0.9089 | 217324 |
| hCV26719227 | AKT3 (rs10927065) | 0.009997 | 1.4 (1.08-1.8) | A_vs_G | AKT3 (hCV233148) | 0.3517 | 0.9089 | 245262 |
| hCV26719154 | AKT3 (rs11588042) | 0.025097 | 1.79 (1.08-2.98) | T_vs_C | AKT3 (hCV233148) | 0.0097 | 1 | 265282 |
| hCV31523650 | AKT3 (rs12048930) | 0.000974 | 1.47 (1.17-1.86) | T_vs_C | AKT3 (hCV233148) | 0.3459 | 0.7848 | 270727 |
| hCV31523658 | AKT3 (rs12047209) | 0.006153 | 1.43 (1.11-1.85) | C_vs_A | AKT3 (hCV233148) | 0.317 | 0.8314 | 285058 |
| hCV15953063 | (rs2953331) | 0.041925 | 1.22 (1.01-1.48) | A_vs_G | AKT3 (hCV233148) | 0.0556 | 0.2841 | 354919 |
| hCV134275 | C3orf15 (rs9847068) | 0.065868 | 1.21 (0.99-1.48) | G_vs_A | NR1I2 (hCV263841) | 0.5453 | 0.8675 | 76427 |
| hCV134278 | C3orf15 (rs9848716) | 0.085183 | 1.19 (0.98-1.46) | T_vs_C | NR1I2 (hCV263841) | 0.329 | 0.8118 | 74733 |
| hCV30699692 | C3orf15 (rs6781992) | 0.078978 | 1.66 (0.94-2.94) | C_vs_T | NR1I2 (hCV263841) | 0.1035 | 1 | 47857 |
| hCV1834242 | C3orf15 (rs11712308) | 0.005499 | 1.3 (1.08-1.56) | G_vs_A | NR1I2 (hCV263841) | 0.5486 | 0.9531 | 17773 |
| hCV1833991 | NR1I2 (rs11926554) | 0.057578 | 1.25 (0.99-1.58) | C_vs_T | NR1I2 (hCV263841) | 0.5548 | 1 | 5484 |
| hCV263841 | NR1I2 (rs1523127) | 0.000146 | 1.44 (1.19-1.73) | C_vs_A | NR1I2 (hCV263841) | 1 | 1 | 1 |
| hCV30747430 | NR1I2 (rs11712211) | 0.014443 | 1.35 (1.06-1.71) | T_vs_C | NR1I2 (hCV263841) | 0.176 | 1 | 3102 |
| hCV11503470 | (rs1800788) | 0.013778 | 1.32 (1.06-1.65) | T_vs_C | FGG (hCV11503469) | 0.3992 | 0.7151 | 51268 |
| hCV15860433 | (rs2070006) | 0.023913 | 1.24 (1.03-1.5) | T_vs_C | FGG (hCV11503469) | 0.5455 | 1 | 21316 |

TABLE 27-continued

Table 27. Additive association for 123 finemapping SNPs with DVT in LETS, with LD data from Hapmap
(p-value cutoff <= 0.1 in LETS)

| marker | annotation | P Value | OR (95% CI) | Additive Model Comparison | Finemapping target | R-Squared | D-Prime | Distance Between Targets |
|---|---|---|---|---|---|---|---|---|
| hCV2892869 | (rs13109457) | 0.002493 | 1.37 (1.12-1.68) | A_vs_G | FGG (hCV11503469) | 0.9149 | 0.9565 | 20303 |
| hCV27020269 | (rs7659613) | 0.027027 | 1.24 (1.02-1.49) | C_vs_G | FGG (hCV11503469) | 0.5455 | 1 | 19766 |
| hCV31863982 | (rs7659024) | 0.000205 | 1.48 (1.2-1.82) | A_vs_G | FGG (hCV11503469) | 0.9579 | 1 | 14252 |
| hCV7429782 | FGG (rs1118823) | 0.014285 | 1.3 (1.05-1.6) | T_vs_A | FGG (hCV11503469) | 0.1442 | 1 | 11336 |
| hCV11503414 | FGG (rs2066865) | 0.000446 | 1.45 (1.18-1.78) | A_vs_G | FGG (hCV11503469) | 0.9579 | 1 | 9906 |
| hCV11503431 | FGG (rs2066861) | 0.000351 | 1.46 (1.19-1.8) | T_vs_C | FGG (hCV11503469) | 0.9579 | 1 | 7746 |
| hCV11503469 | FGG (rs2066854) | 0.000205 | 1.48 (1.2-1.83) | A_vs_T | FGG (hCV11503469) | 1 | 1 | 1 |
| hCV11853483 | FGG (rs12644950) | 0.000278 | 1.47 (1.19-1.81) | A_vs_G | FGG (hCV11503469) | 0.9545 | 1 | 2141 |
| hCV2892855 | FGG (rs6536024) | 0.0009 | 1.39 (1.14-1.68) | C_vs_T | FGG (hCV11503469) | 0.2597 | 1 | 8189 |
| hCV11853496 | FGG (rs7654093) | 0.000364 | 1.46 (1.18-1.79) | T_vs_A | FGG (hCV11503469) | 0.9576 | 1 | 9892 |
| hCV25990131 | CYP4V2 (rs13146272) | 0.04894 | 1.22 (1-1.49) | A_vs_C | CYP4V2 (hCV25990131) | 1 | 1 | 1 |
| hCV3230099 | CYP4V2 (rs3736456) | 0.075392 | 1.49 (0.96-2.32) | T_vs_C | CYP4V2 (hCV25990131) | 0.119 | 1 | 2145 |
| hCV3230016 | KLKB1 (rs4253325) | 0.044164 | 1.37 (1.01-1.86) | G_vs_A | CYP4V2 (hCV25990131) | 0.0097 | 0.2187 | 58263 |
| hCV25634754 | KLKB1 (rs4253331) | 0.005773 | 1.7 (1.17-2.48) | C_vs_T | CYP4V2 (hCV25990131) | 0.0545 | 1 | 58925 |
| hCV27477533 | (rs3756008) | 0.030992 | 1.22 (1.02-1.46) | T_vs_A | CYP4V2 (hCV25990131) | 0.1626 | 0.6312 | 65175 |
| hCV8241630 | F11 (rs925451) | 0.045183 | 1.2 (1-1.44) | A_vs_G | CYP4V2 (hCV25990131) | 0.1371 | 0.6445 | 67359 |
| hCV25474414 | F11 (rs4253399) | 0.023178 | 1.23 (1.03-1.48) | G_vs_T | CYP4V2 (hCV25990131) | 0.1211 | 0.5547 | 67884 |
| hCV25474413 | F11 (rs3822057) | 0.066697 | 1.19 (0.99-1.42) | C_vs_A | CYP4V2 (hCV25990131) | 0.1545 | 0.4747 | 67942 |
| hCV12066124 | F11 (rs2036914) | 0.013274 | 1.27 (1.05-1.53) | C_vs_T | CYP4V2 (hCV25990131) | 0.1525 | 0.456 | 72271 |
| hCV3230030 | F11 (rs4253408) | 0.04234 | 1.43 (1.01-2.01) | A_vs_G | CYP4V2 (hCV25990131) | 0.0486 | 1 | 73648 |
| hCV27474895 | F11 (rs3756011) | 0.035267 | 1.21 (1.01-1.45) | A_vs_C | CYP4V2 (hCV25990131) | 0.1303 | 0.6017 | 86039 |
| hCV3230038 | F11 (rs2289252) | 0.061325 | 1.19 (0.99-1.42) | T_vs_C | CYP4V2 (hCV25990131) | 0.1185 | 0.5845 | 87171 |
| hCV3230136 | LOC728284 (rs13116273) | 0.092188 | 1.2 (0.97-1.48) | G_vs_A | CYP4V2 (hCV25990131) | 0.0006 | 0.0282 | 97676 |
| hCV29821005 | LOC728284 (rs6552970) | 0.088436 | 1.22 (0.97-1.53) | T_vs_C | CYP4V2 (hCV25990131) | 0.0012 | 0.0582 | 118016 |
| hCV32209620 | LOC728284 (rs6552972) | 0.088796 | 1.21 (0.97-1.52) | C_vs_T | CYP4V2 (hCV25990131) | 0.0012 | 0.0582 | 118194 |
| hCV32209605 | LOC728284 (rs6829128) | 0.097805 | 1.17 (0.97-1.42) | T_vs_C | CYP4V2 (hCV25990131) | 0.0101 | 0.204 | 136794 |
| hCV1376207 | NLRP2 (rs11672113) | 0.081881 | 1.18 (0.98-1.43) | G_vs_C | GP6 (hCV8717873) | 0.112 | 0.8676 | 41715 |
| hCV8717949 | NLRP2 (rs1654495) | 0.079445 | 1.18 (0.98-1.43) | C_vs_A | GP6 (hCV8717873) | 0.1439 | 0.858 | 35017 |
| hCV1376227 | NLRP2 (rs1671133) | 0.071931 | 1.19 (0.98-1.43) | C_vs_A | GP6 (hCV8717873) | 0.1501 | 0.8785 | 29547 |
| hCV8717916 | NLRP2 (rs1043673) | 0.0279 | 1.24 (1.02-1.5) | A_vs_C | GP6 (hCV8717873) | 0.1296 | 0.8728 | 24364 |
| hCV8717893 | GP6 (rs1671192) | 0.085361 | 1.22 (0.97-1.54) | G_vs_A | GP6 (hCV8717873) | 0.8755 | 1 | 6663 |
| hCV1376342 | GP6 (rs1654416) | 0.081328 | 1.23 (0.97-1.54) | T_vs_C | GP6 (hCV8717873) | 0.838 | 1 | 6561 |
| hCV8717873 | GP6 (rs1613662) | 0.01299 | 1.36 (1.07-1.74) | A_vs_G | GP6 (hCV8717873) | 1 | 1 | 1 |
| hCV8717752 | RDH13 (rs1671217) | 0.024278 | 1.34 (1.04-1.72) | G_vs_A | GP6 (hCV8717873) | 0.8868 | 1 | 17638 |
| hCV29271569 | RDH13 (rs1626971) | 0.014499 | 1.36 (1.06-1.75) | T_vs_C | GP6 (hCV8717873) | 0.8868 | 1 | 20430 |
| hCV8703249 | RDH13 (rs1654444) | 0.051859 | 1.28 (1-1.64) | G_vs_T | GP6 (hCV8717873) | 0.8868 | 1 | 29860 |
| hCV27904396 | (rs4829996) | 0.056818 | 1.19 (1-1.41) | G_vs_A | F9 (hCV596331) | 0.2533 | 0.6172 | 42147 |
| hCV596663 | (rs411017) | 0.013879 | 1.23 (1.04-1.45) | G_vs_A | F9 (hCV596331) | 0.2537 | 0.5796 | 21179 |
| hCV2288095 | F9 (rs378815) | 0.01722 | 1.22 (1.04-1.44) | C_vs_T | F9 (hCV596331) | 0.2537 | 0.5796 | 21084 |
| hCV2986575 | F9 (rs4149674) | 0.071571 | 1.16 (0.99-1.37) | A_vs_T | F9 (hCV596331) | 0.6414 | 0.8782 | 16480 |
| hCV596669 | F9 (rs376165) | 0.06633 | 1.16 (0.99-1.37) | A_vs_G | F9 (hCV596331) | 0.7113 | 0.9583 | 15548 |
| hCV596326 | F9 (rs398101) | 0.017442 | 1.23 (1.04-1.45) | A_vs_G | F9 (hCV596331) | 0.8216 | 0.9064 | 9324 |
| hCV596330 | F9 (rs422187) | 0.047525 | 1.19 (1-1.41) | A_vs_C | F9 (hCV596331) | 1 | 1 | 422 |
| hCV596331 | F9 (rs6048) | 0.026883 | 1.21 (1.02-1.44) | A_vs_G | F9 (hCV596331) | 1 | 1 | 1 |
| hDV76976792 | F9 (rs4149759) | 0.05842 | 1.31 (0.99-1.74) | T_vs_C | F9 (hCV596331) | 0.0744 | 0.596 | 1775 |
| hCV596335 | F9 (rs413957) | 0.080856 | 1.19 (0.98-1.44) | C_vs_G | F9 (hCV596331) | 0.4049 | 0.9319 | 4237 |
| hCV596336 | F9 (rs110583) | 0.07609 | 1.19 (0.98-1.44) | T_vs_C | F9 (hCV596331) | 0.4049 | 0.9319 | 5252 |
| hCV596337 | F9 (rs421766) | 0.059328 | 1.21 (0.99-1.46) | G_vs_C | F9 (hCV596331) | 0.4049 | 0.9319 | 94835 |
| hDV76976795 | F9 (rs4149762) | 0.072018 | 1.34 (0.97-1.85) | A_vs_G | F9 (hCV596331) | 0.0065 | 0.1534 | 8918 |
| hCV2969899 | (rs434144) | 0.030535 | 1.23 (1.02-1.49) | C_vs_G | F9 (hCV596331) | 0.343 | 0.8128 | 13146 |
| hDV70941043 | (rs17342358) | 0.056568 | 4.08 (0.96-17.3) | G_vs_A | F9 (hCV596331) | 0.0123 | 1 | 21299 |
| hCV15952952 | MCF2 (rs2235708) | 0.057867 | 4.05 (0.95-17.15) | G_vs_A | F9 (hCV596331) | 0.0123 | 1 | 45465 |

SEQUENCE LISTING (2580 sequences)

SEQ ID NO: 1 - DNA, 4195 bp, Homo sapiens
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 2 - DNA, 2503 bp, Homo sapiens
cgctcttattggccaggggacggtagctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 3 - DNA, 7732 bp, Homo sapiens
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccgggcccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccaccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccatgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgttcctctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccatcgggagtggaggtgttggtcctggaagctgactcatcggagagggaaataccaaataaacatccgaggttgcatttatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgctgatgaggcccagggtgcactccttgtcagtcttgcccgttgtccctgtgcattttgctttccgctgtcaaatctcactgtctcgttttcacaccgcatcagtccccatcatcactactcctccccagagacatacagattgccctccccggcatgaagaagtcacaattctgacccgccacctctccaggggcggtgcctgggatggccacccatcaggacagccagagccagggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggagagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaataaaaaaaa

SEQ ID NO: 4 - DNA, 2362 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 5 - DNA, 2336 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 6 - DNA, 2278 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 7 - DNA, 2420 bp, Homo sapiens
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccagatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 8 - DNA, 2236 bp, Homo sapiens
atgaagaaaatgaatcacaagtcaactgacagtccaaaggctccacagctcagaggagggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaaaaaaaa

SEQ ID NO: 9 - DNA, 8300 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaaaaaa

SEQ ID NO: 10 - DNA, 8165 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaaaaaa

SEQ ID NO: 11 - DNA, 8240 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaaaaaa

SEQ ID NO: 12 - DNA, 7754 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaaaaaa

SEQ ID NO: 13 - DNA, 5207 bp, Homo sapiens
cgggctcggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcgttaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttaaaaaaaaaaaaaaaaaa

SEQ ID NO: 14 - DNA, 1216 bp, Homo sapiens
ggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacacaaaatgtcacacttgtttcttgttcatccaaggaacctaattgaaatttaaaaataaagctactgaatttattgccgcacccaaaaaaaaaaaaaaaa

SEQ ID NO: 15 - DNA, 2344 bp, Homo sapiens
agttttacttccgtttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaagaataaacaactaaataactgtattagaaaaaaaagaaacttactaaatatcataatctgatgatatgtggtcctgaattggctactagtttaagcaaataaactgtaagtcatttatgggttagttggggaataaatggatatgggctggatattcggtaatatcattaatgaaaagcagattgcagaaatacagtatgatctcagtattttgaaattgtaaatacatgtacagacaaatacttagacagtatgcatactggtgttaacagtcacaatttctgggtgatgaaaatgtaacttgaaaccgctccatttctacaatgcacatttactgtttctgttataataaaagggtatgttagaaaaacaaaaaggaggctgggcatggtggctcatgcctctaatctcagcactttgggaggccaaggtgggcggatcacttgaggtctggagtttgagaccagcctgagcaacatggtgagaccccatctctacaaaaaaaatataaaaattagccaggtgtggtggtgcacacctgtggtcccagctacttgggaggctgaggtgggaaaatcacttgaacctgggagggtgaggttgcagtgagctgagatcatgccactgcactccagcctgggtgacaggaaaaaaaaaaaaaaaaaaaaaaaaaaaaaa

SEQ ID NO: 16 - DNA, 2954 bp, Homo sapiens
tccctcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaacatttttttttcttgagacagagtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaatttttgtatttttagtagagatggggtttcaccatattggccaggctggtcttgaactcctgacttcaggtgacccacccgcctcggcctctcaaaatgctgggattacaggtgtgagccaccgtgcctggccaattccaacattcttaaattctctcatccctccagggctccccgtgctatgttctctttaccccttccccctcttctcttgctcaggcctgcaccactgcagccaccgttcatttattcattcattaaacactgagcactcactctgtgctgggtcccgggaagggtgagggggtcagacacaggccctgcccctgccctcagtgactggccagtccagcccaggcggggagagatgtgtacataggttttaaagcagacccagagctcatgggggcctgtgttctgggtgttcaggtgctgctggtcctccattacccactgctccccaaggctggtgggacggggtcccggtggcaggggcaggtatctccttcccgttcctcatccacctgcccagtgctcatcgttacagcaaaccccagggggccttggccaggtcaagggttctgtgaggagaggacccaggagtgtgggggcatttggggggtgaagtggcccccgaagaatggaacccacacccatagctctccccacagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgaggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggcaaaaaaaaaaaaaaaaaa

SEQ ID NO: 17 - DNA, 1670 bp, Homo sapiens
tccctcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgaggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttggcaaaaaaaaaaaaaaaaaa

SEQ ID NO: 18 - DNA, 1866 bp, Homo sapiens
cgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtg

SEQ ID NO: 19 - DNA, 4449 bp, Homo sapiens
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctccagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagccaaaaaaaaaaaaaaaaaa

SEQ ID NO: 20 - DNA, 8643 bp, Homo sapiens
gtttgcggtttagaccccaaagattcctgttggtggtctgggtcacaggaggcaggtttcgggagctggaaatgtgagcgggtacgacaggcaccgcgggtaaccgacgccccgggtccttgctgcagccgggtacgcgggataccggcaccccgccttctccgcccgagtgctgccaggcgtgggcctggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgggaaggtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaagctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttatgcattaaagaattatgggttctacttattcatcttctagaccacagaagtaaatggtttgtctcggaatcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagggtgtcattctagaagaacaattacgaatgtatcttcactgttgtttgacactttgtgatttctgggagccaaacattgcaattgttaccattttatgggaatattatagtaagaacctgaatagttccttcagtatttcttggcttccttttaaaggccttgctaataccatgaagtcacccttgtctatgcttgaaatggtgaagacttgctgttgcgataaacaagatcaggaactatataaatccagcagtagttatactatttttctttgtattctggcaaaagttgttaaaaaagcaatgaagagcaatggccctcatccttggaaacaagtcaaaggaagaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgcttttgtaacgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcagactttactttgctagcaatggacatgccaagcacagctccatcagattttcagcctcagccagttatatcaattattcaactttttggttgggatgatatcatctgccctcaagttgtagcaagatatttaagtcatgtcctacaaaatagcacattatgtgaagcactttctcattcaggctatgtatcttttcaagccttaaccgtaagatcatggattcgttgtgttttgcaaatgtatattaaaaacctctctgggcctgatgatttgctcatagataaaaatctggaagaggcagttgaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggcagtttatccaggattatggtatgaggtactattaccaggtttacagcattttagaaacagtagcaacattggaccagcaggttgtcatccacttgatttctacccttactcagtctctgaaggattcagagcagaaatggggccttggcaggaatatagcacaaagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaacattttctgagagtgttttctgtgtgtgagtattaagcagatacttcatccatagactttttgttgtagtatgacttcctgcctccctgccttgtgactgatttgtcatgtttattttttatttttacaataatagttatgttttaaaatgatactttttcaaagtacctggctaccctatactgtgtttttggtgggggaaaggtgttgggaaatgtgactgtgtatttgtttttcttttttatatgtgtgaggcaagttaacaaagaaaacccttacaaagcacacttaactgtgttaggaatgagactgaatctggctaaaggattatacagctgatatccaaaaagaagtgtaaacatgccaacagggtttatatttaggttccaagagttgccaaattttttttttattcatcctttcttttggagttgtcattaaaaaaaaaatcatatcaggaggaggaaataaaggagactttaagaggagagtaaataaaaatattctagaaaagtaacaatagtagtggtctgagaagtcagctgatccatcttcttgctctttagccagagcttcttataacttagcattttatccaagaaacctgtttagtttcctttaacaacattgtttctcaacttttgaactcttaactcatccagattgttttaccagttggagcttgtccttgactccttttcctattgagcattatttggttgaaagagctccagtcctagttttgggaacccacctgggtctcaaactcagctttgctttatgatcttgagctagttacgtaacctttctcagtctagtttcttcatggagaagaaaagaagaatccctttactatttgacagtgttgttgtgagaatcaatgggataatgtacgtgaaaatatttggtggcccaaattctgttgggaaatgtacagacacgattagtttattactcgtgcacaattaaggcaaagaacacctctcaattttatctttctctaatgatatgtcccagatgaatgatcccactttccaatgttttcttacatcatgttttctaactttgaagtactttgtttccttcttgggattatagtctttatcatggttctactcttccttcaagaaaacatttcaacccttctctggctcaaggagtatctttaaaaatgaaatactttgcaatcagtattctgtagttaatagcgttctcttaattataatctgtgaaatccaaaggagtgtctgttattttcataacatataaatggtccttctctcaaatcagcttcatcaaagggaataaatgaaagcttaaggctgtttaatagacttcataacactgaatttcttttcatcatgatagtgacttactaaacaaataatgtatggcttggaaagttccagcagtcactaaggagttttatctatttaaggtgatgcctttaaagaggttatttatgtgtatatgtgtttttgtgtgtgtgtgtgtgtgtgtgtgtgtgtgtgtgtgtgtgtgggttttttttttccaaaggagattgataaagatacctttgagaatcttgctccttagagtatgaaaacgtttaaaggataggaaaagctgctactgaatcatgctttaggacatatatctatagatactaagaataactaaaatttgtacttaagaatggtaacaacaaagtgtgtaacaatatgtgtgtgtattatatgttttgtatttatgtataagtaactttttttaaagcttttttttaaattgaaaaaagaagaaaatttatggctcagttccttttttttaaaatcttcactgatccttcacttattactacaatcttgccctctttcattcccagacttggagtcccttatacctgcttctttaatagccactttccctaaataccctgtaatttctgaggctgctgcttctaccagtgtaatacaagccattgtcttttggtcaaatctgagtttgttctcctttctcatgttctttgtcctctctgtgacaattgtattttcttttatcttcccatcatttccacaatggtactgctccttcctacatatacagttgacccttgagcaacacaagtttgaactgtgcaggtccacttatatgtggatctaaaatacagtatttgtgggatgcaaaatctgagtatatggaggaccaactttttgtagaggcaggttcctcagggttaactgcaggacttgagtaagtgcagattatggtatgcacaggggatcctggaaccagtccccagaccaaaaatgaccactgtatcttgagagcaccttcatggtcttctttcctgtccccagtcgtaagatacgacccttcatctgctttgtctcaacattctgttagtggtgaactgataactccagcttttctctctctttttttttttttttttttttttgttgttgttgttgttgttgttttgaggcagagtcttgctctgtcgcccaggctggagtgcagtggcacgatctcggctcactgcaagctctgcctcccgggttcacgccattctcctgcctcagcctcccaagtagctgggactacaggtgcccgccaccacgcccggctaattttttttgtatttttagtagagacggggtttcaccatgttgggctcgatctcctgacctcatgatccgcccgcctcggcctcccaaagtgctgggattacaggcgtgatgagccacctagtgctaattcatctctaaacctctgtagttggagtctcctgaaatctcagactacctcctgctttcattttctacccagggaatacactattgtcctaagttatttagccttgaaatgtcagaggcattttaggttcttcatgtttctcccactttcagttgattaccattacaggatcttaggcttctttttatctttttgcagtgccttgcatccactggttgtttgttttttctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaaacaagaggctcatttagcagctttctctgattgccatgttcatcctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaactta

SEQ ID NO: 21 - DNA, 1723 bp, Homo sapiens
aaacttcacctaaattgtttttacttgcttcaccttaaatcagttattcggttcctttgaagaacatgtagctttagcaacccccaaagtgaacccagatacccaggactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 22 - DNA, 1479 bp, Homo sapiens
aaacttcacctaaattgtttttacttgcttcaccttaaatcagttattcggttcctttgaagaacatgtagctttagcaacccccaaagtgaacccagatacccaggactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaaaactaaaaatgtctattacttttgtcaaaactcata

SEQ ID NO: 23 - DNA, 1831 bp, Homo sapiens
aaacttcacctaaattgtttttacttgcttcaccttaaatcagttattcggttcctttgaagaacatgtagctttagcaacccccaaagtgaacccagatacccaggactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgtctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 24 - DNA, 1476 bp, Homo sapiens
aaacttcacctaaattgtttttacttgcttcaccttaaatcagttattcggttcctttgaagaacatgtagctttagcaacccccaaagtgaacccagatacccaggactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaaaactaaaaatgtctattacttttgtcaaaactcata

SEQ ID NO: 25 - DNA, 1457 bp, Homo sapiens
ctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatctttttaaaa

SEQ ID NO: 26 - DNA, 2771 bp, Homo sapiens
ctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggctggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggtcaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacagggtctcactctgttgcccaggctggagtgcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccctgtagcaacccaaaaaaaaaaaaaaaaaaaa

SEQ ID NO: 27 - DNA, 2549 bp, Homo sapiens
atcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccagacctttggggtatccagcagtggccaaagcgtcagctccaaccagcgtccctgtagttcggacatccccgactctccctgcagtggagggcccatcgtctcgcactccggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcattccagccagtggggactggtggggtccagctctgtggaggcggctccacgggctccaagggaccctgctctccctccagttctcgagtccccagcagttctagcatttccagcagctccggtttaccctaccatccctgcggcagtgcttcccagagcccctgctccccaccaggcaccggctccttcagcagcagctccagttcccaatccagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcaacagtccataagaagtcaactgttgtgtgtgtgcatgccttgggcacaaacaagcacatacactatatcccatatgggagaagtccagtgcccaggcatagggttagctcagtttccctccttcccaaaagagtggttctgctttctccactaccccaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgtggaaatggtccattgagtaacacccccatcagcttctcaactgggaaacccctgaaatgctctcagagcacctctgacgcctgaagaagttataccttcctcttcccctttaccaaataaagcaaagtcaaaccatcatctggaaacagtggccacttttcactgacctttcttcgacatctagtcaacccacccaatatgccactgggctctcgctcccaattccaccccaccctccattacagagctcaccacgccctcctagatcaccgtccccaacacacccattgcctctcaaggcccttatctcagccccttcctgtggccacttccctcagtgctcagatgattccctgggtgagggagacactggggcaccctcagaggttgaagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgttcctcattttccttcaaaagcgggctgtgtttctcttctaccttccagctgctcccacagaggaggaagacaataaatatttgttgaactg

SEQ ID NO: 28 - DNA, 2813 bp, Homo sapiens
agtacattgaaattcaaagtcatgcttgtaactgttaatgaaagcagatttaaagcaacaccaccatcactggagtatttttagttatacacgattgagactaccaagcatgttgctcttattcagtgtaatcctaatctcatgggtatccactgttgggggagaaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactaaaggagaatgtcatgttccaattttagaagccaatgtagatgctcagccaaaaaaagaaagctacaaagttggagacgtgttgaaattctcctgcagaaaaaatcttataagagttggatcagactcagttcaatgttaccaatttgggtggtcacctaactttccaacatgcaaaggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttgaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttgcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttgagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctatgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggcggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagtacttaattcatctaatccctcctgtttgtctcaaattataggataactttgaaactttctgaattaacgttatttaaaaggaaatgtagatgttattttagtctctatcttcatgttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaaaaga

SEQ ID NO: 29 - DNA, 3783 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 30 - DNA, 3945 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 31 - DNA, 3902 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtgggcagcacggggaaggacctgtgagtggccaacctggttcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 32 - DNA, 3871 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 33 - DNA, 3857 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 34 - DNA, 2193 bp, Homo sapiens
aagtgtggccacttcctcttgcctgtcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgctccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaaaccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccgaccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggaactgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccgggcgttcctatggtcaaagagtggaaatgcaggaaccaacctcccttt

SEQ ID NO: 35 - DNA, 1895 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaaaaaaaaaaaaaaaaaaaaaaaaaa

SEQ ID NO: 36 - DNA, 2058 bp, Homo sapiens
cacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattcaaaaaaaaaaaaaaa

SEQ ID NO: 37 - DNA, 1681 bp, Homo sapiens
cacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattcaaaaaaaaaaaaaaa

SEQ ID NO: 38 - DNA, 4470 bp, Homo sapiens
cttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgctacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatgaaaaaaaaaaaaaaaaa

SEQ ID NO: 39 - DNA, 1593 bp, Homo sapiens
ctgggagcgcggcgtaggtggctgccgagtcttttcctgtttagggtcttatcctggcattgagggcgccggactggcgcttttggccggcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaaaaaaaaaaaaaaaaaaa

SEQ ID NO: 40 - DNA, 2166 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaaaaaaaaaaaaa

SEQ ID NO: 41 - DNA, 2256 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaaaaaaaaaaaaa

SEQ ID NO: 42 - DNA, 2259 bp, Homo sapiens
gcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaaaaaaaaaaaaa

SEQ ID NO: 43 - DNA, 3278 bp, Homo sapiens
aggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtg

SEQ ID NO: 44 - DNA, 2217 bp, Homo sapiens
agtgcttagaattgttaaaatctttgtgaagcacaccactgaagatgaggttgaaaaacctgacttttatcatcatattgataatctcaggagaactctatgcagaagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcaaaaaatgcactaagcctgacctgagtaatggttacatctctgatgtaaagttattgtataaaattcaagagaacatgcgttatggttgcgcttcagggtacaaaaccactggagggaaggatgaagaagtggttcaatgtctctctgatggatggtcttctcaaccaacctgtaggaaagaacatgaaacatgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccaaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattgaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttgaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttggaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttagagccatgcacattatcttttactgaaatggaaaagaataatttacttctgaaatgggattttgacaatagaccacacattttgcatggtgaatatattgagtttatttgtagaggagatacttatccagctgaattatatattactggatctatacttagaatgcaatgtgacagagggcagttaaaatatccaagatgtattccaagacaaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcgttatttataaatgaaaaccaataaatgtctaatttttagtttgt

SEQ ID NO: 45 - DNA, 2029 bp, Homo sapiens
attaacccagaggggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgagcctc

SEQ ID NO: 46 - DNA, 1967 bp, Homo sapiens
caggagctgacacactatggcgcacgtccgaggcttgcagctgcctggctgcctggccctggctgccctgtgtagccttgtgcacagccagcatgcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgagcctc

SEQ ID NO: 47 - DNA, 2028 bp, Homo sapiens
attaacccagaggggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggcaagttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcga

SEQ ID NO: 48 - DNA, 9179 bp, Homo sapiens
gcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaacgtgtacatatatcaaaatgttatgtataccataaatatataaaattttatcaacgaaattcataacaatctctcagaccacagagaaatcaaattagaactgaggactaagaaactcactcgaaaccacacaactacatggaaactgaacaacctgctcctgaatgactactgggtaaataatgaaattaaggcagaaataaataagttccttaaaaccaatgagaacaaagagacaacataccagaatctctaggagacagggctttgcttttgctgcattctattcgttgtgaacacaaattacaggccagtctcgattcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattcgtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctgttattttgaaataaaaaagatacccactttt

SEQ ID NO: 49 - DNA, 2771 bp, Homo sapiens
cttgtactttggtacaactaatcgaccttaccactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgactttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 50 - DNA, 2777 bp, Homo sapiens
cttgtactttggtacaactaatcgaccttaccactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagttttttgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 51 - DNA, 2831 bp, Homo sapiens
cttgtactttggtacaactaatcgaccttaccactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 52 - DNA, 3655 bp, Homo sapiens
agcaatcctttctttcagctggagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagc

SEQ ID NO: 53 - DNA, 2210 bp, Homo sapiens
agcaatcctttctttcagctggagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatg

SEQ ID NO: 54 - DNA, 1763 bp, Homo sapiens
cttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgcaaa

SEQ ID NO: 55 - DNA, 9252 bp, Homo sapiens
ggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatactgaatatcataatccaatctttgttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgatgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagattttc

SEQ ID NO: 56 - DNA, 2268 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacaggaacctctgtgacccccagccggttaccaacagaaccaccttccccggtagcagaattctcagaagccaccgctgaactgaccgtctcattcacaaacgaagtcttcacaactgagacttctaggagtatcaccgccagtccaaaggagtcagactctccagctggtgagtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgcagacccggaaatcacacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 57 - DNA, 2264 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacaggaacctctgtgacccccagccggttaccaacagaaccaccttccccggtagcagaattctcagaagccaccgctgaactgaccgtctcattcacaaacgaagtcttcacaactgagacttctaggagtatcaccgccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgcagacccggaaatcacacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 58 - DNA, 1906 bp, Homo sapiens
tttccgggaagatggcggcgcacaagtcaggtccggcacatgtttccgcggagcggacccagcaatgacgaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtgatggaagaagcaggaaaagcaagaagaaaagacagcagcatcaagaggaggaggacatcttggatgtaagggatgagaaggatggcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggacgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaaaaaaaaaaaaaaa

SEQ ID NO: 59 - DNA, 1980 bp, Homo sapiens
tttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtgatggaagaagcaggaaaagcaagaagaaaagacagcagcatcaagaggaggaggacatcttggatgtaagggatgagaaggatggcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggacgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaaaaaaaaaaaaaaa

SEQ ID NO: 60 - DNA, 5951 bp, Homo sapiens
caacgcccccatcgagcttgctttgcttacgcaaggcctcagcctttgcctcttccccaaacccaagctacctgaggaggaggagctgagtgagggggagggaccaacagatttgtcccctgtgcaggctgcctgcctgcttgagttacatccacaaatgcctcggaagcagccagctggctgcatctttctcctcacattcctgggtctgtctgggctggttggcacagttaccagaacgtactacattgggattgtggaagaatactggaactatgtaccccaagggaagaatgttattactgggaaaagtttcacagaagacaaacttgcaaccttatttctcgaaagagggcccaacaggataggcagtatttacaaaaaggctgtttacagacgcttcacggatggaacctactccatagagatccccaaacctccctggcttggattcctgggccccatcttgagggccgaagtgggtgatgtgattgtcattcatttaaagaactttgcttctcgaccttactctctgcatccacatggcgttttctacaacaaagattcagaaggagccctatacccagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaaggtatcctgaatagatattcagggacacggaatgatgtggatcgagagtttgttataatgtttactcttgtggatgagaatcaaagctggtacctcaatgaaaatatcaaacatttctgcaccaaccctgattcagttgacaagaaagatgctgttttccagaggagtaacaaaatgcatgccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaagctggtatgctggggcaatacaatgttgataactgcaaaagtgatattttctaccccaagatgaagggtcaacagaggcgctactttatagcagctgaaaaaattctttgggattatgctcctcaaggctataacaaattcagtggtcttcctctaaacgcctctggcagtgactctgatctctacttcacacaaggggacaacagaataggaggaaaatactggaaggttcggtatactgaatttgttgatgcaacttttactaaaagaaagagactctctgctgaagaagcccatcttggaattcttggcccagtcatcaaggcagaggtgggtgataccctgttagtgacctttgccaacaaagccgacaaggtctatagcattttaccccatggtgtgatctatgacaaggcatctgatgcagccccaaacctagatggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatgctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaagacatggagatatatttatgaaccgcactgaaaattggattggctctcagtacaagaaggtggtttacagggaatatacggatggagaatttgtggagatcaaagcccgaccaccacgagaggagcacttagaactcctgggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggagaagtaaaaacttatagatggaatatccctaaaagatccggtccagggccttctgatcccaattgtattccatgggtttactattcaacagtaaactttgtgaaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatgccattaatggaaagatttttgggaatctccatggcctcataatgaacgaagatacaatgacaaactggtatttgttagggataggaagtgaagtggacatacataccatccattatcatgctgagagctttcttttcaaaatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacatagacaacaggattccttactccaccacatctcctggagtggcatctcacccagccacggtgccatctaacgaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtggctatttgcatggttattttcacttaaaattatctatcactgaactaggggaggtggttaaagtggaattaatttttagatatttaggggctatgactatgccaatgacacttgttagaggaaatgaaacaaaatagtgtatctccacaaataatatgacttctcaaacattgtttcctcaaacataactacactccttgttctcagcctcactcttgagaaaatcaactctgccttcacttacacacatatttcttcctattacaatacacgtgtccctgctcctagcaggacagtctcttcatttgactttgggtctcattgcttcttgctttctcaagacttcattcccttgggtatccatttttcctcctgcatctttctatgaaaccatcagcaatgtccgccattaaaaacagaaagcaatgtgctgtcttatttaactctataaccccct

SEQ ID NO: 61 - DNA, 9215 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaatattttttaattcaaggtaaaatatattagtttcacaagatttctggctaatagggaaattattatcttcagtcttcatgagttgggggaaatgataatgctgacactcttagtgctcctaaagtttccttttctccatttatacatttggaatgttgtgatttatattcattttgattcccttttctctaaaatttcatctttttgattaaaaaatatgatacaggcatacctcagagatattgtgggtttggctccataccacaataaaatgaatattacaataaagcaagttgtaaggactttttggtttctcactgtatgtaaaagttatttatatactatactgtaacatactaagtgtgcaatagcattgtgtctaaaaaatatatactttaaaaataatttattgttaaaaaaatgccaacaattatctgggcctttagtgagtgctaatctttttgctggtggagggtcgtgcttcagtattgatcgctgtggactgatcatggtggtagttgctgaaggttgctgggatggctgtgtgtgtggcaatttcttaaaataagacaacagtgaagtgctgtatcaattgatttttccattcacaaaagatttctctgtagcatgcaatgctgtttgatagcatttaacccacagcagaatttctttgaaaattggactcagtcctctcaaactgtgctgctgctttatcaactaagtttttgtaattttctgaatcctttgttgtcatttcagcagtttacagcatcttcattggaagtatattccatctcaaacattctttgttcatccataagaagcaacttcttatcaagttttttcatgacattgcagtaactcagccccatcttcaggctctacttctaattctggttctcttgctacatctccctcatctgcagtgacctctccacggaagtcttgaactcctcaaagtaatccatgagggttggaatcaacttctaaactcctgttaatgttgatatattgaccccctcccatgaattatgaatgttcttaataacttctaaatggtgatacctttccagaaggctttcaatgtactttgcccggatccatcagaagactatcttggcagctgtagactaacaatatatttcttaaatgataagacttgaaagtcaaaagtactccttaatccataggctgcagaatcaatgttgtattaacaggcacgaaaacagcattaatcttgtgcatctccatcggagctcttgggtgactaggtgccttgagcagtaatattttgaaaggaggttttggttttgttttttgttttttttttttgttttttagcagtaagtctcaacactgggcttaaaatattcagtaaactatgttgtaaaaagatgtgttatcatccagactttgttgttccattactctacacaagcagggtacacttagcataattcttaagggccttggaattttcagaatggtaaatgagtatgggcttcaacttaaaatcatcaactgcattagcctgtaacaagagagtcagcctgtcctttgaagcaaggcattgacttctatctatgaaagtcttagatggcaccttgtttcaatagtaggctgtttagtacagccaccttcatcagtgatcttagctagatcttctgcataacttgctgcagcttctacatcagcacttgctgcctcaccttgtccttttatgttatagagacagctgcgcttcttaaactttataaaccaacttctgctagcttccaacttctcttctgcagcttcctcattctcttcatagaactgaagggagtcaaggccttgctctggattaagctttggcttaaggaatgttgtggctgacgtgatcttctatccagaccactaaagcgctctccatatcagcaataaggccgttttgctttcttacctttcatgtgttcactggagtaatttccttcaagaatttttcctttacattcacaacttggctaactggcatgcaaggcctagctttcagcctgtcttggcttttgacatgccttcctcacttagctcgtcatatctagcttttgatttaaagtggcaggcatacaactcttcctttcacttgaacacttagaggccactgtagggttattaattggcctaatttcaatattgttgtgttttagggaatagagaggcccagggagagggagagagcccaaacggctggttgatagagcaggcagaatgcacacaacatttatcagattatgtttgcaccatttaccagattatgggtacggtttgtggcaccccccaaaaattagaatagtaacatcaaagatcactgatcacagatcgccataacataaataataataaactttaaaatactgtgagaattaccaaaatgtgatacagagacatgaagtgagcacatgctgttgaaaaaaatgacactgatagacatacttaacacgtgggattgccacaaaccttcagtttgtaaaagtcacagtaactgtgactcacaaaagaacaaagcacaataaaacgaggtatgcctgtatttttaaaaaaagctttttgttaaaattcaggatatgtaataggtctgtaggaatagtgaaatatttttgctgatggatgtagatatatacgtggatagagatgaagatcttaattatagctatgcagcatagatttagtcaaagacatttgaaaagacaaatgttaaattagtgtggctaatgacctacccgtgccatgttttccctcttgcaatgagataccccacactgtgtagaaggatggagggaggactcctactgtccctctttgcgtgtggttattaagttgcctcactgggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatattt

SEQ ID NO: 62 - DNA, 2252 bp, Homo sapiens
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 63 - DNA, 1669 bp, Homo sapiens
gaaagattcatttattcattcaacaaacagtggccgaaggcttgttatgtgctgtgcctggacttggcatgaaggcaccagatgtcagaagcgaggctgctgcccaggaggacacacctgatggggctctgggaccaggacgatggtggagacatcacatccggaataactttgttaggaaggtgaacttgacagttaggacttagttctccttgaagacgtccttcacatccctttttcctgagctcgaactctactttttgcaacaagcagaatgtacacatgttaaacaagggcacacaagcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaatgcccatgaaggagtttcctggtttgttcctttggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagagtcttcctggctgtccagaagaacaagcctatcagcaagaaggaaatgattcagaggtccaaacggacacacgcaggaggaacagtagcacaaaggcttcccggtgccttgtgggtgaaagaaaggcttccagggaaaggagagaaacacccagggatcccggtgacgtcgggaagcagcacccagaccataaaaatgaaacagatgggaatcaaaaagactgaatgaagcagaaacccagaagctaccccacaggcaatcgcatgggactcagatgttaatggacaataagcttttattgcacagaaaggtcattgcagtcagaggttggggattgcttgctgctacagccgaatggattctattctgaccaatacagaaggaaagaaatcatagacgccctgcctgagcagaagggaggtgatagatgaaatgaactgtatgaagatccaccagcctggcccacacgtggaagaaggactggcccgtcttcttgaagcccaagctctggtagaggcccatggcagagagctggatgttgctggtgtccaggacaacttcactgtagccctagtcccgggcaaactggaggacagtcctgaccagggcttttgctatcccctgaccacggtgctcattgtccacagagagatgaaacagctgcaaccgcttctccctcaaggtgggatcatcaacgggcagagctcctactgtgcccaccaccttctcttcagattcacccacccaga

SEQ ID NO: 64 - DNA, 2387 bp, Homo sapiens
cacccaggaacctgaagaaagatctagctcagcattggagcattgctgatattgttggaattccacagcaattatccaaaccacagcgttagaaacagactttgcaggatgaatattcgagtatggatacacagtatcctggcagcctgcctccagaactccgggtgaactcagatgagcctccagggccccctgagtaagttggactttctcaattccatctagagcctgaaactcaaaatccagagacccttgaagatatccagtcctcttcactccaggaagaagccccagagcagcttccacacctccttcttcaacccagcaggaggccccagctctgcctccagagtcctctatggagagtctagctcaaactctaccaaatcatgaggtgacagttcaacctccaggtgaggatcaagctcattataacttgcccaacattacagttaaacctgcagatgtggaggttaccataacttcggagcctaccaatgagaaagaatcttcccaagcccagcaggaggctccagttcagtttccagaggaggtggaaccttctgcaacccaacagtaggccccaaccgagcctccatgtcatcctacggagcgtgaactttccattagtgagcaggagcagccagctcagccttctgagtcttctggggaggttgaatcttctcagactcggcaggagaccccagctcagcctccagaagagatggaacctcctgcaaaccaagaggaggccccaactgagcctccaggtcctcctgtagagcctgaactttcccccagtgagcaggagcagccagctcagccttctggggaggttgaatcttctccagcccagcaggagaccccagctcagcctccagaacatcatgaagtcaccgtttcacctccaggtcaccatcaaactcagcattcagatttgcccaatgtctctgttaagcctccagacatgcagctcaccatagcaacagagcctagtgcagaggtgggaacttctccagtccaccaggaggctacagctcagctctcaggaccaggtaatgatgtagaacctcccactatccagcacgggggcccacctcttcctccagagtcaccggaagatgctggacctttagcaattcaacaggagacttcagttcaatctccggaacctgttaataatgagaacccctctccaacccagcaggaagctgcagctgagcatccacagactgctgagaagggtaagtcttctctaacccagcaggaggccccagctgagactccagagctccctaatgtagttgtagctcaatctccggaacattcaaacctgactcaagccacagttcaacctttggacctggggcttaccatcactccagaatccacaacagaagttgaactttctccaaccatgcaggagaccccaactcatcctcctaagaaagttgtaccccaacttccagtatatcaagaggttacaattccaacaccaggtcaggatcaggctcagcatccaatgtcacccagcattacagttcaacctttggacctgggacttaccatcactccagaacccactacggaggttggacattctacacccctgaagaagaatgtagttcctccaaagcaccctaaggtgacacttccacatccagaccaggttcagactcagcattcaaacctgactcaagccacagttcaacctttggatttggggcttaccaccactccagaatccacaacagagattgaaccttctgcagccctgacgactacagctcctcctccagaacaccctgaggtgacacttccaccttcagacaagggtcgggctcagcattcaaacctgactcaagtcacacttccacctctggacctggagcttaccataactacagaacctactacagaggttaaaccgtctccaaccacggaggagacctcaactcagcctccagacctggggcttgccataactccagagcccactacagagactggacattctacagccctggagaagactacagctcctcatccagaccaggttcagactctgcatcgaaaactgactgaagtcacaggtccacctactgaactagaacctactcaggattcactggtgcagtctgaaagttacgcccaaaataaggctttaaccgcaccagaggaacagtaggcctccacaagcaccaacatatgtgagctctgtacctgcggaggtgagacgctgtcgtgtattgatctcagcccaaaacagaggctctgccaagtgcctgtgccagagcccaacacctaccatggcaccttcaccatcttaaatttccaaggaaactatatttcttacattgatggaaatgtatggaaagcatacagtt

SEQ ID NO: 65 - DNA, 1397 bp, Homo sapiens
gaggcggctgtggagcccatgcaagtcgacaaggacctcccggaggacctgcagaatgcacccgacatcaactacttggtggacgccaccctggaactggagcagtgcgttgccagttgcagcggcctgatgtgcactgagcggctgcagtttattgctgactgactactgccccttgctgcgggtggatgccctgaatatggcgctctccttcctgcagagaatctttaacgtggacctgtacgaagaggtccaccggaagctctcgaagaggtccacctgaagctctcggaggccaccaggaatctgaggaactcacccgacgccatccttgagagtggcgtggagcccccgtccctggacacggcctgggtggaggccactcagaaagaggccctgcttaagctggagaagccggacgcagacctgaagaactacaagcgcaactccaccaaggagcgcaccaggcgcggccatgatgattcagcaatgccctcaagtgtcactcacggcctgagactactgcagcagcgccaagcacgccatcaacatgtcctcaacgtcttcaaggtcagcgtctacttgcaaaattggccttacgtgctgagccgcgtcagcaaggccgagtccaccctggagattgcctagcagcgaggacagaggggcagccagccaggcgcaggcggtcctcacccagcttcaatgcgctggaggcttggcagagctggtcgcgaggaagtacaagcaggctgccaaatgcttcctgctggcttcgtttgatcactgtgacgtcccccagctgctgtcccccagcaacgtggccgtctgtgggggcctatgcgccttggccaccttcgaccggcagaagctgcagcgccgcctcatctccagcagctccttcaagttgttcttggagctggagccgcaggttggagacatcgtcttctaattccacgagtccaagcgtgcctcgtgtctgaagatgctggacgatgcctcgacgacctgctcttggacatgtgtacctcccccacccccactccctcaccgccccaccgtcaggaccctgtacgcccagattcgcaactctgccctcaactcgcacagggtggccgtgcccttagccccgctgtggcagcccgggagggtgagctgacgcagcaagtccgggaggggctgacgcgcccgcgtggactcgcacagcaagatcctggacgcccgggatgtggatcagcgcaagcaccaccttcgagaagtctctgcggatcggcagggagtttcagcaccgcgccaaaggccggatgctgagggtagctgtgctgcgcaaccagatccacgtgaaatcccttccagagaagggagcccggggagcgactccggccaacagccagtcccgg

SEQ ID NO: 66 - DNA, 768 bp, Homo sapiens
atggacggcatgctgtggcggggctggtgcaagatgccgctgcgggttcaggaggcggctgtggagcccatgcaagtcgacaaggacctcccggaggacctgcagaatgcacccgacatcaactacttggtggacgccaccctggaactggagcacagcgccaagcacgccatcaacatgtcctcaacgtcttcaagcagcgaggacagaggggcagccagccaggcgcaggcggtcctcacccagcttcaatgcgctggaggcttggcagagctggtcgcgaggaagtacaagcaggctgccaaatgcttcctgctggcttcgtttgatcactgtgacgtcccccagctgctgtcccccagcaacgtggccgtctgtgggggcctatgcgccttggccaccttcgaccggcagaagctgcagcgccgcctcatctccagcagctccttcaagttgttcttggagctggagccgcagggtggccgtgcccttagccccgctgtggcagcccgggagggtgagctgacgcagcaagtccgggaggggctgacgcgcccgccaagatcctggacgcccgggatgtggatcagcgcaagcaccaccttcgagaagtctctgcggatcggcagggagtttcagcaccgcgccaaaggccggatgctgagggtagctgtgctgcgcaaccagatccacgtgaaatcccttccagagaagggagcccggggagcgactccggccaacagccagtcccggtggacaccagcttct

SEQ ID NO: 67 - DNA, 3922 bp, Homo sapiens
atggctcccaatcagtgcacggcactagcatgtgtcatgtcctggctgcgtttctggggcccgtggcccctccttacgtggcagctattgtgtctcctagtggcaattattgtgtctactagtcaaggaggctccacatctggtgttgcagccccaggggactttgattacctggggccctctgcttcctcacaggtgtcagccctgccccaggaatcaaatgaaaatttggttccattcctggatacggattcaggtggagagctgcccctggggccagagcagttcttggctgcacatcaggatttaaatgacaagcggactccacaagaaaggctcccagaggtggttccactgctggacagggatcagaaccagaccctagttcagcttcctcgcctcaaaagtaagtttcaaactgcagatctagatcgggctgcaggtcatcaggcagatgaaatacttgttccgctagacagtaaggtttcaaaaccaaccaaatttgttgtttttccaaagaacttgaagaaagatctagctgagcgttggagccttgctaagattgtcgggattccacaccaattatacaaacctcagcaactccgggtgaatgcagatgagcctccagggcctcctgagcaagttggactttctcaattccatctagagcctgaaactcaaaatccagagacccttgaagacatccagtcctcttcactccaggaagaaaccccagcacagcttccactgctccctcaggaggtagaaccttcaacccagcaggaggccccagctctgcctccagagtcctctatggagagtctagctcaaactccactgaatcatgaagtgacagttcaacctccagtcaaacctgcagatgtggaagttaccatgacttcagagcccaaaaatgagacagaatcttcccaagcccagcaggaggccccaattcagcctccagaggaggtggcaccttctgcaacccaacaggaggccccaactgagcctccaggtcctcctatggagcctgaactttcccccagtgaacaggagcagccagctcagccttctgagtcttctggagaggttgaatcttctccagcccagcacgagaccccagctcagcctccagaagagatggaaccatctgcattccaagaggaggccccaactgagcctccacgtcctcctatagagcctgaactttcccccagtgagcaggagcagctagctcagccttctgagtcttctggggaggttgaatcttctccaacccagcaggagaccccagctcagcccccagaacatcatgaagtcccagtttcaccttcaggttaccatgaaactcagcattcagattttcccaatgtctctgttaagcctccagacgtgcagctcactatagcaacagagcctagtgcagaggtggaaacttctccagtccaccaggaggctacagctcagctctcaggtccaggtaatgtagaacctcccgccatccagcacgggtgcccacctctgcctccagagtcatcagaagaggctggacatttacaaattcaacaggaaacttcagttcaatctccagaacctattaataaagagaacaccactccaacccagcaggaggctgcagctgagcatccacagaccgctgaggagggtgagtcttctccaatccagcaggaggccccagctcagcccttaatgtcccctgagcagtttcaacatttgaaagaccagcaagacattataattcagcagctaaatagacctgaaaattatgaacctcctccagtccataaagagcctacaactcagcctccaactcagctctcctcagactttgtaagttcaatggatgatgaagcaataggttcacctccagatgtgtcatatctagatctagatagggagcttaccaaacctacagcagtcactatgtgggtagaaccttctccagtccagcaggacaacccttctattcccactgagcaggctgacttttctttaacccagcctgatctcccttccccacctctgcattctcctgagaagattgaatctccagtccaccaagaggccacagctcagactccagatccccctaaggaggcagaaccttctccagtccagcaagagttcccagctgagccaccagagccccctaaggaggttgaaccatctgcaacccagcaggaagcctcaggtcatccttggaagtccactgaagcggtcagtcctccaccacagtgggagacaccagctcagccatcagagccacctgagaaggccccaacttggcttttagagccacctaaagaggtagaatcctctccagtccagcaggcagtccctgctcagtcttcagaccccactatggtgatagaaccctctctgacccagcagatggccccatctttgcctccagggttccctcaggaggtagaaccatctgtaactcagcaggaggttccagctcagattccagagccccctgtggaggcagaaccttctctgacccagcaggaggccacagttcaggctgcagagtcccctagggaggtagaatcttcaaggcagcaaatggtcccagttcagcttccagagccacctaaggaagttgcagctcaacctccagctcattatgaggtgacagtcccaacactaggccaggatccagctcagaattcaacattgcccagtgtcactgttcaacctttggacctgggacttaccatcattccagaatcaacgacagaggttgaactttctccaaccatgcaggagaccccaactcagcctcctaagaaagttctacaacaacttgtactatatcaagaggtaaaaattccaacaccaggtcaggatcaagctcagcatccaatgtcacccagcattacagttcaacctttggacctgggacttaccatcactccagaacccactatggaggttgaacattctacacccctgaagagaactatagttcctccaaagcaccttaaggtgatacttccacatccagaccagtttcagactcagcattcacacctgactgaagccacagttcaacctttggatctggagcttaccatcactccagaatccacaacagagaacaccctgaggtgttcaccttcagacaagggtcaggctcagctttcacacctgaccgaagccacagttcaacctctggacctggagcttagcataactacagagcctactacagaggttaaaccatctccaaccacggaggaaacctcagctcagcctctagacccggggcttgccataactccagaacctactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaggcaccaacatatgtgagctctgcacctgcggagatgagactctgtcatgtgttggtctcagcccaaagcagaggctccgccaagtgcctgtgccagagccctacacctacaatggcatcttcaccaccttaaatttccaaggaaactatatttcatacattgatggaaatgtatggaaagcatacagttggaccgagaaactaattctcagtgaaaattatttgactgaattacctaaggattcatttgaaggcctgctatccctccagtatttgtaaattcatcctgcaataaaatacggtatattgaaagacaaacatttgaatcactaccatttttgcagtatacaaatctgggctgcaatttaattacaaaactgagccttggaacatttcaggcctggcacggaatgcagtttttacacaactt

SEQ ID NO: 68 - DNA, 7555 bp, Homo sapiens
ggagccagaggaggcgccggtcgctggcagctgagcggcggaacccttcgctggcgggagcgcggttcggggccgcagaggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacgcaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccagctcctccaagagcgaagggaagaagtctagggagcagccctcagtgctgagtcgctaccccccggctgctcaggagcacagtaaagcgtggaaggggacttccaagccaggcaccgagagtggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaagaacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaggggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccagtctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgcccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgggtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgaaaaaaaaaaaaaaaa

SEQ ID NO: 69 - DNA, 2639 bp, Homo sapiens
aaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaagattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatg

SEQ ID NO: 70 - DNA, 3705 bp, Homo sapiens
aaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttaga

SEQ ID NO: 71 - DNA, 3691 bp, Homo sapiens
gatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaatgttgcgttgacaattggaaaagaaaagtgtaattgcgtacaggcgaaatggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttaga

SEQ ID NO: 72 - DNA, 17400 bp, Homo sapiens
cgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggtttctgtgctgatccctctcttggagaatggagagctcttgattcctggccgaggtgactgtctgaaagtggcacctggatttcagttttttgcaaccaggagactcttgagctgtggaggaaattggtatcgaccgctaaacagtcatgctactttgctagacaaatattggaccaaaattcacctggataacctggataagagagaactgaatgaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggctctagactgtttcacagcaatgctttctgagcatacaagcaaactgaaaatggcagaagttattggaagcaaattgaacatttctagaaaaaaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctggtgggagagaccgggactggcaaaacctctaccatccaatacttggctcacattacaggccaccgtttgagggttgtcaatatgaatcaacaaagtgatactgcagacttgcttggaggttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactgggttactcataaaagagaaatgggaagcatttggtcttagactcaaccatgcccaacaacagatgaaaatgactgaaaataccttattgttcgcatttgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcaggaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcagtcctatcgcagaagttcttcagtgtttgctggaaagcagggcttcatcacccttcgtgatctgttccgatgggctgaaagatacagattggctgagccgaccgagaaggagtatgactggctacagcatttagccaatgatggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtgtgggaaaactactatctgtcaggtatttgcagccttggcaaatcagaaattatactctgtcagctgccacttacacatggagacatcagacttcctgggtggcctgcggccagtgagacaaaagccaaacgacaaggaagaaattgacacatcaagactctttgagtggcatgatgggcctctggttcaggccatgaaggaggacggctttttcctcttggatgagatctcattggccgatgactctgtcttggaaagactcaacagtgtccttgaagtagaaaagtctctggtattagctgaaaaaggcagtccagaggacaaggatagtgaaatagagctgttgactgctgggaaaaaatttcgtattctagcaaccatgaaccctgggggtgactttggaaaaaaggagctgtctcctgccttaagaaaccggtttacagaaatatggtgccctcaaagcacaagccgtgaagatttaattcagatcatcagtcataatcttcgtccaggattgtgtctgggcagaatagatcctaaagggtctgacatacctgaagtgatgctggatttcattgactggctgacccaccaagagtttggcagaaagtgtgtggtcagtatcagagatatcctgtcctgggttaacttcatgaacaaaatgggggaggaagctgctttgaaaaggccagagatcatctccactgtgacatcttttgtccatgctgcatgcctggtgtacatagatggaataggttcaggggtaacttcctctgggtttggtacagcccttttggcacgaaaagaatgtctgaaatttctaatcaagaggcttgccaagatagtacgacttacagaatatcagaaaaatgagttgaagatttatgacagaatgaaggccaaagaattcactggaatagataacctttggggaattcatccattttttataccaaggggacctgtcctacacaggaataatattgcagactatgcactcagtgcagggaccactgctatgaatgcacagaggctcttaagagctaccaaactgaagaagcccattctcctggagggttcccctggtgttggcaagacaagtttggtgggagcattagcaaaggcttcaggaaatacccttgttagaatcaacttatcagagcaaacggacatcacagacctgtttggagcagatctacctgttgaaggtggcaagggaggagagtttgcctggcgtgatggccccttactggcagctttgaaggcaggccattgggtggtgttggatgagcttaacctggcttctcagtctgtattggaaggactcaatgcttgttttgaccaccgaggagaaatctatgtgcctgagttaggaatgagctttcaagtgcagcatgaaaagacgaagatttttgggtgtcagaatccctttagacaaggaggtgggaggaaaggcttgcccaggtctttccttaacagattcactcaggtcttcgttgatccccttacagtaattgacatggagttcattgccagtactttgtttccagccattgagaaaaatattgttaagaaaatggttgctttcaataaccaaattgatcatgaagtgactgttgagaagaaatgggggcaaaaaggaggaccctgggaattcaacctccgggaccttttccgctggtgtcagttgatgctggttgaccagtcccctgggtgttatgatcctggtcagcatgtgtttttggtctatggtgaaagaatgagaaccgaagaggacaaaaaaaaggtcattgctgtattcaaggatgtgtttggttcaaattccaacccatacatgggaaccagactatttcgtatcactccctatgatgttcagttgggctactcagtcctttcccgtgggagctgtgttcctcacccgtcccgccatcccctgttgctcctgcaccagtcattccaacccctggagtcaatcatgaagtgtgtgcagatgagctggatggtcatcctggtcgggccagcctctgtgggcaagaccagcctggtccagcttctggcacaccttactggccacacattaaagatcatggctatgaacagtgcaatggatactactgagctgctgggtggatttgagcaggttgatcttatacgaccttggaggaggctgctagagaaggtggagggaactgtaagggcactgttaagggatagcctccttatcagtgctgatgatgcagaagtagtgctgcgagcctggagtcattttcttctgacatataagcctaagtgtcttggagaaggtggtaaagctatcacgatggagattgtcaacaaactagaagcagtgttattgcttatgcagcgactcaacaataaaatcaactcatactgcaaggcagagtttgccaaacttgttgaagagttccgaagctttggtgtgaagcttacgcagttggccagtggccatagccatggcacatttgaatgggttgacagcatgttggttcaggccctgaagtctggagactggcttctgatggacaatgttaacttctgcaacccatcagtgttggatcgtttgaatgctttgcttgaacccggaggtgtcctcactattagtgagagaggaatgatagatggatccactcccacgataacaccaaatcccaatttcagacttttcctctcgatggatcctgttcatggagatatatcccgagctatgaggaatcgtggacttgaaatctacatttcaggggaaggggatgcaagcaccccagacaacctggatttgaaagttctgctgcacagccttggattggtggggaacagtgtatgtgacatcctcttggctttacacacagagacccggagcactgttgtaggttctccaacatcttctgtatcaactctaatccagacagccatactaattgtccagtacctgcagcgagggctgagtttagacagagccttttctgaagcatgctgggaagtatatgtctgttcccagcattcaccagcaaaccggaagcttgtacaggctttactggagaaacatgtttcttctttgcgagcacatgaaacctggggagactccattcttggcatgggactgtggccagattctgtgccctcagctctctttgctactgaagattcacacctgtctacagtccgaagagatggacagatcttagtatattgtctcaacaggatgagcatgaaaaccagcagctggacaaggagtcagccttttaccttgcaagacttagagaaaattatgcagtcccccagccctgagaacctgaaattcaatgcagtcgaagtgaatacttactggatcgatgaaccagatgttttggtcatggctgttaaattgctcatagaaagagcaaccaatcaggattggatgctcagagttaaatggctttatcatttagccaagaatataccgcaggggcttgagtccatacaaattcatttggaagccagtgctgcatctctcaggaatttttactcacattccctctcaggtgcagtcagtaatgttttcaaaatattacaaccaaatacaacagatgaatttgtgatccctctggatccccgatggaatatgcaggctctggacatgattagaaatttgatggactttgacccacaaacagaccagcctgaccagctctttgcccttttagaatcagctgcaaacaagacaatcatatatcttgaccgggaaaaacgggtttttactgaagcaaatttggtttctgttggtagcaaaaagctaagagagagtgttttgagaatgtcctttgaattccatcaagatccagaaagctatcacactctgccccatgaaattgtggtcaatcttgctgctttttttgaactttgtgatgcactagtcctgctctgggtacagtcctcccagggaatggtgtctgatgccagtgccaatgagatcttaggttctctgcggtggcgggaccggttctggactgtggccgacacagtaaaagtagatgccccaggtctggcccttcttgccctccattggcactgggttttaaaacatctggtccaccagatcccccgacttctgatgaattatgaagacaaatattacaaagaagttcagactgtctcagaacatattcagaattgtctggggagccagactggtggcttcgctggtataaagaagttgcagaagttcctgggacgaccgtttccttttaaggacaagctggtggtggagtgtttttcacaactgaaggtccttaacaaagtccttgccatcagggagcagatgtctgcccttggggagagtggatggcaggaagacattaaccgtctccaagtggttgcttctcagtggacattaaagaaaagtctcctgcaagcctggggactgatcctcagagcaaatattttggaagatgtcagcctagatgaattgaagaattttgtgcatgctcagtgtttagaactgaaagccaaaggactctcacttggttttctggagaaaaagcatgatgaagcttcctccctgtcccatccagacttgacctccgtaatccacctcaccaggagtgttcagttgtggcctgcaatggagtacctggctatgctttggcggtacaaagtgacagctgattttatggcacaagcttgtctcagaagatgcagcaaaaatcaacaaccccagataaatgaggagataagtcacctcatctcattttgtctttatcacacacctgttacacctcaagagcttcgagatctgtggtccttgctgcatcatcagaaggtgtctcctgaagaaattacatctttgtggtccgagttatttaattccatgtttatgtctttctggagcagtactgtgaccacaaatccagagtactggctaatgtggaaccctttgcctggtatgcagcagagggaggcacccaagtctgttttggactccacattgaagggccccggcaatctcaatagacccatattctctaagtgctgctttgaagtcttaaccagcagctggagagcaagtccctgggatgtgagtggcctccccattctttcctcctctcacgtgaccctaggagagtgggttgagagaactcagcagctccaggacatcagttcgatgctttggactaacatggctatctcttcagtagcagaattcagacgcacggattcccaactccaggggcaggtgctgttccggcacctggcaggcctagcagagctgctcccagagtcccggcggcaggagtacatgcagaactgtgagcagctgctgcttgggagcagccaggccttccagcatgtgggccagacacttggggacatggctggtcaggaggtgctgcccaaggaactgctctgccagttgctcacctccctgcaccactttgttggtgaaggggagagtaagaggagcctgcctgagccagcccagcgtgggagcctctgggtgagcctcggcttgctccagattcagacatggcttccccaggcacgctttgaccctgcggtgaagagggagtacaagctcaattacgtcaaggaagagttacaccaactgcagtgtgaatggaagacccggaacctgtcatcccagctgcagactggaagagacctggaagatgaagtcgttgtcagctactctcatcctcacgttaggctgcttcgccaaaggatggatcggctggataatttaacctgtcacctgttgaagaaacaggcctttagaccccagctgcctgcctacgagtccctggttcaggagatccaccactacgtcaccagcatcgccaaggcccctgctgttcaggatctgctcacacggcttctgcaggccctccacatagatgggccacggtctgcccaagtagcccagagccttctaaaggaggaggcctcttggcagcagtcacaccaccagttccggaagcggctgtcagaggagtacaccttctatccagatgccgtgagcccactgcaggcatccatattgcagttacaacatggcatgaggctggtggcctctgagctccacacctcactccacagcagtatggttggtgcagacaggctggggaccctggccacagccttgctggctttcccatcggtgggccccaccttcccgacttactatgctcatgcagacactttgtgctcggtgaagtctgaggaggttctacgaggccttgggaagctaatcctcaagcgctcaggaggaaaggagctggaaggcaagggccagaaagcctgtcccactcgggagcagctgctgatgaatgctctcctttacctgcgctcccacgtgttatgcaagggagagttggaccagagggccctgcagctcttcagacatgtgtgtcaggaaatcatcagtgagtgggatgagcaggaacgcatagcccaagagaaggctgagcaggaaagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaacctcgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggag

SEQ ID NO: 73 - DNA, 2850 bp, Homo sapiens
actgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagccgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggttctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaag

SEQ ID NO: 74 - DNA, 7105 bp, Homo sapiens
atgttgggggcggggcttccggtcacccgcgccggtggtttccgccctgtaggcccgcctctccagcaacctgacacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaacgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgac

SEQ ID NO: 75 - DNA, 7611 bp, Homo sapiens
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgcaaaaaaaaaaaaaaaaaa

SEQ ID NO: 76 - DNA, 845 bp, Homo sapiens
ctggactcagtgacttcagacacagaagtctgtccatggctccttatcacatccgcaaataccaggagagcgaccgcaagtcggtcgtgggcttgctctcccgggggatggccgaacacgccccagccaccttccggcgattactgaagctgcctcgaaccctcatactcttacttgggggggcccttgccctactcctggtctctggctcctggattctggccctcgtgttcagcctcagcctccttcctgccctgtggttccttgccaaaaaaccctggacgcggtatgtagacatagcattgcgcacagacatgtctgacatcaccaaatcctacctgagtgagtgtggctcctgcttctgggtgggtgaatctgaagagaaggtggtgggcacagtaggagctctgcccgttgatgatcccaccttgagggagaagcggttgcagctgtttcatctctctgtggacaatgagcaccgtggtcaggggatagcaaaagccctggtcaggactgtcctccagtttgcccgggaccagggctacagtgaagttgtcctggacaccagcaacatccagctctctgccatgggcctctaccagagcttgggcttcaagaagacgggccagtccttcttccacgtgtgggccaggctggtggatcttcatacagttcatttcatctatcacctcccttctgctcaggcagggcgtctatgatttctttccttctgtattggtcagaatagaatccattcggctgtagcagcaagcaatccccaacctctgactgcaatgacctttctgtgcaataaaagcttattgtccattaaaaaaaaaaaaaaa

SEQ ID NO: 77 - DNA, 3530 bp, Homo sapiens
aaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaaacctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatagatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaaaaaaaaaaaaaaaaa

SEQ ID NO: 78 - DNA, 4446 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggctaaaaaaaaaaaaaaaaaaaaaaaaaaaaaa

SEQ ID NO: 79 - DNA, 4335 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccgggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggctaaaaaaaaaaaaaaaaaaaaaaaaaaaaaa

SEQ ID NO: 80 - DNA, 6784 bp, Homo sapiens
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 81 - DNA, 6614 bp, Homo sapiens
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagaggttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 82 - DNA, 6517 bp, Homo sapiens
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 83 - DNA, 6410 bp, Homo sapiens
cttctctcccagtgcgagagcgcggcggcggcagctgaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 84 - DNA, 7286 bp, Homo sapiens
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagagggtaagagaagaaaaaagggaaagtggtgaaggcagggaggaaaattgcttagtgtgaatatgcacgcattcatttagttttcaaatccttgttgagcatgataaaattcccagcatcagacctcacatgttggtttccattaggatctgcctgggggaatatctgctgaatcagtggctctgagctgaactaggaaattcaccataattaggagagtcactgtatttctctccaaaaaaaaaaaagttatacccgagagacaggatcttctgatctgaaattttcttcacttctgaaattctctggtttgtgctcatcgttggtagctatttgttcatcaagagttgtgtagctggcttcttctgaaaaaaggaatctgcgtcatatctaagtcagatttcattctggtgctctcagagcagttagcccaggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 85 - DNA, 4154 bp, Homo sapiens
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaaaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 86 - DNA, 6787 bp, Homo sapiens
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 87 - DNA, 957 bp, Homo sapiens
atgatgagctttgcccctaatgcttcacactctccggtttttttgctccttgggttctcgagagctaacatctcctacactctcctcttcttcctgttcctggctatttacctgaccaccatactggggaatgtgacactggtgctgctcatctcctgggactccagactgcactcacccatgtattatctgcttcgtggcctctctgtgatagacatggggctatccacagttacactgccccagttgctggcccatttggtctctcattacccaaccattcctgctgcccgctgcttggctcagttctttttcttctatgcatttggggttacagatacacttgtcattgctgtcatggctctggatcgctatgtggccatctgtgaccccctgcactatgctttggtaatgaatcaccaacggtgtgcctgcttactagccttgagctgggtggtgtccatactgcacaccatgttgcgtgtgggactcgtcctgcctctttgctggactggggatgctgggggcaacgttaaccttcctcacttcttttgtgaccaccggccacttctgcgagcctcttgttctgacatacattctaatgagctggccatattctttgagggtggcttccttatgctgggcccctgtgccctcattgtactctcttatgtccgaattggggccgctattctacgtttgccttcagctgctggtcgccgccgagcagtctccacctgtggatcccacctcaccatggttggtttcctctacggcaccatcatttgtgtctacttccagcctcccttccagaactctcagtatcaggacatggtggcttcagtaatgtatactgccattacacctttggccaacccatttgtgtatagcctccacaataaggatgtcaagggtgcactctgcaggctgcttgaatgggtgaaggtagacccctga

SEQ ID NO: 88 - DNA, 933 bp, Homo sapiens
atgcagcaaaataacagtgtgactgaattcatactgttaggattaacacaggatcccttgaggcagaaaatagtgtttgtaatcttcttaattttctatatgggaactgtggtggggaatatgctcattattgtgaccatcaagtccagccggacactaggaagccccatgtacttctttctattttatttgtcctttgcagattcttgcttttcaacttccacagcccctagattaattgtggatgctctctctgaaaagaaaattataacctacaatgagtgcatgacacaagtctttgcactacatttatttggctgcatggagatctttgtcctcattctcatggctgttgatcgctatgtggccatctgtaagcccttgcgttacccaaccatcatgagccagcaggtctgcatcatcctgattgttcttgcctggatagggtctttaatacactctacagctcagattatcctggccttaagattgcctttctgtggaccctatttgattgatcattattgctgtgatttgcagcccttgttgaaacttgcctgcatggacacttacatgatcaacctgctgttggtgtctaacagtggggcaatttgctcaagtagtttcatgattttgataatttcatatattgtcatcttgcattcactgagaaaccacagtgccaaagggaagaaaaaggctctctccgcttgcacgtctcacataattgtagtcatcttattctttggcccatgtatattcatatatacacgccccccgaccactttccccatggacaagatggtggcagtattttatactattggaccaccctttctcaatccactcatctacacactgaggaatgcagaagtgaaaaatgccatgagaaagttatggcatggcaaaattatttcagaaaacaaaggataa

SEQ ID NO: 89 - DNA, 1002 bp, Homo sapiens
atgggacccagaaaccaaacagctgtttcagaatttcttctcatgaaagtgacagaggacccagaactgaagttaatccctttcagcctgttcctgtccatgtacctggtcaccatcctggggaacctgctcattctcctggctgtcatctctgactcccacctccacacccccatgtacttccttctctttaatctctcctttactgacatctgtttaaccacaaccacagtcccaaagatcctagtgaacatccaagctcagaatcagagtatcacttacacaggctgcctcacccagatctgtcttgtcttggtttttgctggcttggaaagttgctttcttgcagtcatggcctacgaccgctatgtggccatttgccacccactgaggtacacagtcctcatgaatgtccatttctggggcttgctgattcttctctccatgttcatgagcactatggatgccctggttcagagtctgatggtattgcagctgtccttctgcaaaaacgttgaaatccctttgttcttctgtgaagtcgttcaggtcatcaagctcgcctgttctgacaccctcatcaacaacatcctcatatattttgcaagtagtgtatttggtgcaattcctctctctggaataattttctcttattctcaaatagtcacctctgttctgagaatgccatcagcaagaggaaagtataaagcgttttccacctgtggctgtcacctctctgttttttccttgttctatgggacagcttttggggtgtacattagttctgctgttgctgagtcttcccgaattactgctgtggcttcagtgatgtacactgtggtccctcaaatgatgaaccccttcatctacagcctgagaaataaggagatgaagaaagctttgaggaaacttattggctggagtacagtggcacgatctcggctcactgcaaactccgcctcccgggttcatgcaattctcctgcctcggcctcccgagtag

SEQ ID NO: 90 - DNA, 8622 bp, Homo sapiens
agtgcagagccacagccagagccagccgggcaacccagcagcagccaccaggaggcgacccttgccatgggggacaaggctacagtcgtgggaggccagcaggctgaagccccagactccgtggccatgtcttcctgggaaaggcggctccatcgggccaagtgtgcaccatcctacttgttctcctgcttcaatggaggcgagtgtgtgcacccagccttctgtgactgcagacgcttcaatgccactggaccgcgctgccagatggtgtacaatgccggccctgagagggacagcatttgccgggcgtgggggcagcaccacgtggagacatttgatgggctctactactacctctccggaaagggcagctacaccctggtgggtcgccatgagcccgagggacagagcttctccatccaggtacacaatgacccgcagtgtggctcttcaccctacacctgctccagggctgtcagcctcttctttgtgggtgagcaggagatccatctggccaaggaggtcacccatggaggcatgagggtccaactgccacatgtcatggggagcgcgcgtctgcagcagcttgccggctatgtcatcgtgcggcatcagtcagccttcacactggcctgggatggtgcctcggctgtctacatcaagatgagtccagagcttctgggctggacccatgggctgtgtgggaacaacaatgctgaccccaaggatgatctggtgaccagctctgggaagctgactgacgacgtggttgagtttgtgcacagctggcaggagcaggcccctaaccagcctccagggcccacaacttcctccctgcctcgcccaccgtgcctacagcagaacccaggaaccatgcagggcgtgtacgagcagtgtgaggctctactgcggcccccctttgacgcctgccacgcctacgtcagccctctgcccttcacagccagttgtaccagtgatctctgccaatcaatgggtgatgtagccacctggtgccgggcactggcggagtatgcccgggcgtgtgcccaggcagggcggcccttgcaaggctggaggacccagctccggcaatgcactgtgcactgcaaggagaaggcctttacctacaatgagtgcatcgcctgctgccctgcctcctgccatccccgggcatcctgtgtggacagtgagatcgcctgtgtggacggctgctattgccccaatgggctcatcttcgaggatgggggctgcgtggcaccagctgagtgtccctgtgagtttcacgggactctgtacccacctggctctgtggtgaaggaagactgcaatacttgcacatgcacctcaggcaagtgggagtgcagcacagctgtctgcccagctgagtgctcagtgactggtgacattcacttcacaacctttgatggccgccggtacacgttccccgccacatgtcagtacatcctggccaagagccgctcttcgggcaccttcaccgtgacattgcagaatgccccatgtggcctgaaccaagatggagcctgtgtccagtcagtgtcagtgattctgcaccaggaccctcggaggcaggtgaccctgacccaggcaggggatgtccttctgtttgaccagtacaagatcatcccgccatacacagatgatgcctttgagatccgtaggctgtcctccgtgttcctgcgggtgaggacgaacgtgggcgtgcgggtgctctacgaccgtgaagggctccgactgtacctgcaagtggaccagcgatgggtggaggataccgtgggcctctgcggcaccttcaatggcaacacgcaggatgacttcctgtctccagtgggtgtacctgagagcaccccacaactttttggcaattcctggaaaacactttctgcttgctccccgctggtctctggctcccctctggacccctgcgatgtgcacctgcaagccgcctcctactcagtgcaggcctgcagcgtgctcacgggggagatgtttgcgccctgctctgcgttcctgagccccgtgccctactttgagcagtgccgcagggatgcctgccgctgcgggcagccctgcctgtgcgccacactggcccactacgcccacctgtgccggcgccatgggctccccgttgatttccgcgcccgcctgccagcctgtgcactgtcctgtgaggcctccaaggagtatagcccctgcgtggccccgtgtggacgtacctgccaggacctggccagccctgaggcctgtggggttgatggtggcgatgacctgagcagagacgagtgtgtggagggctgtgcctgcccaccggacacctatctggacacccaggctgacctctgtgtcccccggaaccagtgctcctgccacttccagggagtggactatccccccggagacagtgacatcccatccctgggccactgccactgcaaagatggagtcatgagctgtgatagcagagccccagctgctgcctgcccagcaggccaggtcttcgtgaactgcagcgacctgcacacggacctggagctgagcagggagaggacgtgtgagcagcaactgctgaacctgagcgtgtcagcccgtggcccctgcctctcgggctgcgcctgtccccagggtctgctcagacacggggatgcatgtttcctgccagaggagtgcccctgcacttggaaggggaaggagtatttccctggggaccaggtgatgtctccttgccatacctgtgtgtgccagcggggctcattccagtgcaccctgcacccttgcgcctccacctgcactgcctatggggaccggcattaccgcacgtttgatgggctcccgtttgacttcgtgggggcatgcaaagtgcacctggtcaagagcacatcagatgtcagcttctctgtgattgtagagaatgtgaactgctacagctctggcatgatctgcaggaaatttatttccatcaacgttgggaactcactcattgtctttgatgatgactccggaaatcctagtccagagagcttcctggatgacaagcaggaggtccacacatggcgagtgggatttttcacactggtgcatttcccacaggagcacatcaccctcttgtgggaccagagaaccacagtgcacgtccaggctgggcctcagtggcagggccagctggcgggcctctgtgggaactttgacttaaaaaccatcaatgagatgaggaccccggagaacctagagctaactaacccccaggagtttggcagcagttgggctgcagttgagtgcccagacaccctcgatcctcgggatatgtgtgtcctgaatcctctccgagaaccatttgccaagaaggagtgcagcatcctgctcagtgaggtgtttgagatctgccaccctgtggttgatgtcacttggttttactcaaactgcctgacagacacatgtggctgcagccagggtggtgactgtgagtgcttctgtgccagcgtctccgcttatgcccaccagtgttgccagcatggggtggctgttgactggcgaaccccccgcctctgcccgtatgactgtgacttctttaacaaagtgctaggtaagggcccctatcagctatccagcttggcagccggtggtgctctggtgggcatgaaggcggtgggcgatgacatagtcctagtgaggacagaggatgtggcgccagcagacattgtgagcttcctgctgacagctgctctgtacaaggccaaggcccatgacccagatgtggtgtccctggaggcagcagacagacccaacttcttccttcacgtcacagccaacgggtctctggagctggctaagtggcagggccgtgacaccttccaacagcatgcctccttcttgctgcaccgggggacacggcaggcaggcctggtggccctggagtccctggccaagcccagctccttcctctatgtgtcgggcgcggtgctggccctgcggctgtacgaacacacagaggtgttccgccggggcacactcttccgccttctggatgccaagccctcgggggctgcctaccccatctgcgagtggcgctacgatgcctgtgccagcccctgcttccaaacctgccgggacccacgggcagccagctgccgggacgtacccagggtagaaggctgtgtccctgtgtgccccaccccccaggtcctggatgaagtcacacagagatgtgtctacttggaggactgtgtggagccagcagtttgggttcccacagaggcccttggcaatgagaccctccctcccagtcaagggttgcccactcccagtgatgaggagccacagctgtcacaggaaagccccaggacccccacccacaggccagccctcaccccagctgccccactcaccacagccctgaacccaccagtgacagccactgaggagccagtggtgtctccaggccccacccagaccaccctgcagcagccactggagctcactgcatctcaactccccgccggccccacggagtccccagccagcaagggagtgactgccagcctcctggccatcccccatacaccagagtcctcatccctccctgttgcactgcagacacccacacctggcatggtgtcaggtgccatggagacaacaagggtgactgtgatctttgcaggaagccctaacatcacagtctcctcccggtcgccccctgcccctcgcttcccgctcatgaccaaggctgtgacagtccgaggccatggctccttgcctgttaggacgacacccctacagccctccttgacagcaagtccctcctccagacctgtggcttcccctggagccatctccaggtcccccacctcctcgggatcccacaaggctgtgctgacacctgcagtaactaaggtcataagcaggacaggggtcccccagcccacccaggcccagagtgcttcaagtcccagcacccctctaactgtggctggaacagcagcagaacaggttcctgtcagtccccttgcaaccaggagcttggagatagtgctatccacagagaagggcgaagccgggcacagccagcccatgggctcgcctgcctccccacagccacacccactcccctctgcaccaccccgcccagcccagcataccaccatggccaccaggtctccagctctgcccccagagaccccagctgccgccagcctgtcaacagccactgatgggctggcagccacacccttcatgtcccttgagtcaactcgtccctcccagctcctctctggcctgcctcccgacaccagcctgcccctggccaaggtgggcacatctgccccagtggccacacccggccccaaagcctctgtcatcaccactccactccagccacaggccacgactctgcctgctcagacacttagcccagtactgcctttcactccagcagcaatgacccaggcgcacccacccactcacatagcacccccagcagcaggcacagctccaggcctgctgctgggagccacattgccaacctctggagtcctgcctgtggctgagggcacggcctccatggtatctgttgtcccacgaaagagcaccacagggaaggtggccatcctatccaagcaagtgtctctgcccacttccatgtatggttctgcagagggtgggcccacagagctcacgcctgctacgagccaccctctcacgcccttggtggctgagcccgagggagcccaggcaggcacagctctgccagtgcccacatcctatgccctgagccgtgtctcagccaggacggccccccaagacagcatgctggttctgttgcctcagctggctgaggcccatggaacctcggcagggcctcacctggcagcagagccggtggacgaggccaccacagaaccatctgggcgctcagccccagccctgagcatcgtagagggtttggcggaggctttggcaactaccactgaggccaatacatccaccacctgtgttccaatcgccgagcaggactgcgtccgccacatctgcctggagggccagctgattcgcgtgaatcagtcccagcactgtccccagggtgctgctccccctcgctgtgggatcctgggcctcgccgtgcgggtgggtggggaccgctgctgcccactctgggagtgtgcctgccggtgctcaatcttccctgacctgagcttcgtgaccttcgatgggagccacgtagctctgttcaaggaggccatctacatcctcagccagagcccagatgaaatgctcaccgtccatgtactggactgcaaaagtgccaacctggggcacctgaactggcccccgttctgtctggtgatgttgaacatgactcacttggcccatcaggtcactattgatcgcttcaaccgaaaggtgactgtggacttgcagcctgtgtggccaccggtgagcaggtatggattcagaattgaggacacaggccacatgtacatgatcctgactccctcagacatccagatccagtggctccacagctcaggactcatgatcgtggaggccagcaaaaccagcaaggcccagggccatggcctgtgcggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccccttcctgtgctccagcgactccacataccaggcatgtgtgacagcctgtgagccacccaagacatgccaggatgggatactagggcctctggacccagagcactgccaggtgctgggcgagggctgcgtctgctccgagggcaccatcttacaccggcgccactctgcactctgcatcccggaggccaagtgcgcctgcactgacagcatgggggtgccgagggccctgggggagacctggaacagctccctcagcggctgctgccagcaccagtgccaagccccagacaccattgtcccggtggatctgggctgccccagtccccgccctgagagctgcctgcgattcggggaggtggccttgctcctacccaccaaggacccctgctgcctggggactgtctgtgtgtgtaaccagactctgtgtgagggtctcgcccccacatgccgcccaggccaccgcctcctcacccacttccaggaggactcctgctgccccagctacagctgtgagtgtgacccagatctctgtgaggcagagctggtccccagctgccgacaggaccagatcctgatcacgggccgcctgggggactcctgctgcacctcctacttctgcgcctgtggtgactgtccagactccatccccgaatgtcaagaaggggaggcgctcactgtgcacaggaataccacggaactctgctgccctctgtaccagtgtgtgtgtgagaacttccgctgtccccaagtgcagtgtggcctgggcactgccctggtggaggtgtggagccccgaccgctgctgcccctacaaatcctgtgaatgtgactgtgacacaatcccggtgccccggtgccatctgtgggagaaatcccagctggatgaggagttcatgcacagcgtggagaatgtgtgtggctgcgccaagtacgagtgtgtgaaggccccggtgtgtctgagccgcgagctgggtgtgatgcagcccggccagacagtggtggagctctcagcagatggcgtgtgccacacctcccgctgcaccaccgtgctcgaccctctcaccaacttctaccagatcaacaccacctccgtgctctgtgacatccactgtgaggcgaaccaggagtacgagcacccgcgggacctcgctgcctgctgcggctcctgcaggaacgtgtcctgtctcttcaccttccccaatggcaccacctccctgttcttgcccggggcatcctggatcgcagactgcgcccgccaccactgcagcagcacgcccctgggtgccgtgctggtccgctctcccataagctgcccaccgctcaatgagactgagtgtgccaaggttgggggttccgtggtaccttccttggaaggatgctgcaggacctgtaaggaggatgggcgctcctgcaagaaggtgaccatccgcatgaccatccgcaagaatgaatgcaggagcagcacccctgtgaacctagtgtcctgcgatgggaggtgcccatccgccagcatctacaactacaacatcaacacctatgcccgattctgcaagtgctgccgtgaggtgggcctgcagcggcgctctgtgcagctcttctgtgccaccaatgccacctgggtgccctatacagtgcaggagcccaccgactgtgcctgccagtggtcc

SEQ ID NO: 91 - DNA, 2642 bp, Homo sapiens
actttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaggacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagagg

SEQ ID NO: 92 - DNA, 2782 bp, Homo sapiens
gggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcatgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagacaaaaaaaaaaaaaaaa

SEQ ID NO: 93 - DNA, 5663 bp, Homo sapiens
attacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 94 - DNA, 6453 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 95 - DNA, 5823 bp, Homo sapiens
agcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 96 - DNA, 4997 bp, Homo sapiens
gcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaactgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgcaaaaaaaaaaaaaaaaaaaaa

SEQ ID NO: 97 - DNA, 6826 bp, Homo sapiens
tggtcagccacccctggctggctccaggcccagctccccaatattccccactaggcctcagtgtgtcctcatttctatctgtacctttgccatcctgggccatgcaacctgtagctctcggcctcttctgtctcctttcaggctgagtctctgaatctgtctccatttgtgactctggtttccatgggatacatagatgtggagcctcaggagggcaggggtagtgtgatcagtgtcaggcgccccaaagcatttattctgtgccaggccctgtgctggatgctgaaagtacggaagtggataacatacagtctctgtttccatgaagcctacaatgcacattctctgtggagtggagaaaccagggcccagccctgcctctatctcagtatggctgtacctcccctgaatctgcctgctgtgcccagggtgccaggtcagctatagcctgtggcttgaggctcttctttgcctctggcattcacaggggtatgtgtgcccgccagcaggtcccccccggctcttagggctcctgggggacttggctggtgggtgctggtgggcagcagaaggggagggagggagcagaaggcagtgactcagtgggggtggccctgggacagaactggggaggaagccaaggttggatgatgcttcctgaagccaggagggtgggaagagaggtctggctgggagttagggatggagcaggacaactccaaggctcccctctggcagccagacctgctcatgaagaaggctcctcggtagctgcctgaaagtctggactctgggggctgggctgggctgggtggggagattgctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgtcccgcggtgccccccgcgcactcaccctcgctcacccacgcggccttcctggcgggagagcgcttccggcgtcctcgccaggcccggggagtgggcacggtggagctgccgaccgttggtcgctgccccaacccacgcactgcgacgccgcgggtgaggcgcgcggtctgcggggcccgggggtgcggcggggcggggctggcgggctgtccgggcccacggagaggacggcggcgggcgggggttgctgcagggcccgcaccttgtcttccgcgccggcagggctgtgccccgtcgagacctgctcgggctgtggctccgtcctccggcctccagggggcggcgcggcgctgcgcggcgccccggcggcactgccctcccttcccagcggccaggaggcggtgtcccgtgacgccgcgcggccgcgctgtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaaaaaaaaaaaaaaaaaaaaaaaaaaaaaaaaaaaaaaaaaaaa

SEQ ID NO: 98 - DNA, 6637 bp, Homo sapiens
attggctgaagcggaagaagacgaaagcaatcataaaatgggaggttgcaagctcatggtttgaaagacttcgtcacggaagctaaaagctctatacacccgatttgcctcggaggaattttcctaaatgattattttgatgtcttatatatctttgattgttttcaaaacaaaagagcgagcagagagtcgtacaactatttgttccccccccatgtagaagtgatctcatccacgtaaatgtcgttcctgcgaccgcttccgcgcgcaagcgcacgttgaatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatcccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacgtttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacagcctgcagatgatggtgcagtcgggagccaaaggttcaactgtgaacacgatgcagatctcgtgcctgctgggccagattgaactggaaggtcggagacccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggggacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgggcttaggcactgaggaggacccgtcccttcccgccctcctgacgcagccccggaaacccacccacagccaggagccccaggggcccgaggccatggagcgccgggtccaggctgtgcgtgagatccacccgttcatagatgactaccagtacgacaccgaggagagcctgtggtgccaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttatacaaaggctttgtaaaaccagaggctagcttctatctttgtctactgttatttcagctcagggcgggtaattaacatcattggaactagctattaggaaagaaaaaaaacttggttttttttacaacaa

SEQ ID NO: 99 - DNA, 2399 bp, Homo sapiens
ataaaagcctagtggccattgtgttcgttgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgtagcgaaaaaaaaaaaaaaaaa

SEQ ID NO: 100 - DNA, 1483 bp, Homo sapiens
gacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcaaaaaaaaaataaaaaaaaaaaaaaaaaaaaaaa

SEQ ID NO: 101 - DNA, 1097 bp, Homo sapiens
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagcaaaaaaaaaaaaaaaaa

SEQ ID NO: 102 - DNA, 1516 bp, Homo sapiens
tgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaaaaaaaaaaaaaaaaaaaaaaaaaaaaaaaaaaaaaaaaaaaaaaaaaa

SEQ ID NO: 103 - DNA, 2346 bp, Homo sapiens
agtcacgttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacagggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtggtgggcgcctgtaagagatgtgggtgcctgggctgtgcccagtcactgaaatggcacacctgatgctacctgttcact

SEQ ID NO: 104 - DNA, 2281 bp, Homo sapiens
agtcacgttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacagggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtggtgggcgcctgta

SEQ ID NO: 105 - DNA, 2714 bp, Homo sapiens
gcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccagggatggccacctccccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaaaaaaaaaaaaaa

SEQ ID NO: 106 - DNA, 1815 bp, Homo sapiens
gccgtcacgcgcaccgtacagcccagtccacgaagggcgccacgggccgtgacgtcactagccgccgacggcgcgctttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagcagaaaaaaaaaaaaaaa

SEQ ID NO: 107 - DNA, 2614 bp, Homo sapiens
agcccccaagagctctgtgcgggattctaggctcccctgtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagaaaaaaaaaaa

SEQ ID NO: 108 - DNA, 4631 bp, Homo sapiens
gccagaggagcggctccggccgccgcgcctgacccttgtccggggtcttccgcacagtgggctgagggccatgtcagttttctgccacctacaggatagaccatgaagctgaaggaacttgagcggccagctgtccaggcatggagcccagccagccaataccctttgtatctggccacaggaacatctgcccaacagctagattcctccttcagcacaaatggcacattggaaatatttgaggttgatttcagggacccttctctggacttgaaacacagaggagtcctttctgccttgagcaggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccagggcaacctcctggcttcaggggccagcgattctgaaatcttcatttgggatctgaataacttgaatgtgccaatgaccctgggatccaagtcacagcagcctccagaggacatcaaggcactgtcttggaaccggcaagcccaacacattctgtcttctgctcaccccagtggcaaggcagttgtgtgggatctcaggaagaatgaacctatcatcaaagtcagtgatcacagcaacaggatgcactgctcaggcctggcctggcatcctgacatagccacccagttagtgctgtgctcagaggatgatcgacttcccgtgattcagctgtgggacttgcgctttgcctcctcgcccttgaaggtgctggagagccacagcagggggatcttgtcagtgtcatggagccaggctgatgctgagctgctgctcactagtgctaaggacagccagatcttgtgccggaacctggggagcagtgaggtggtatataagctaccaacacagagcagctggtgctttgatgtgcagtggtgccctcgggacccttcagtgttctctgctgcctccttcaacggctggatcagtttgtactctgtgatgggtaggagctgggaagtccagcatatgagacaggctgacaagatctcctcttccttcagcaaaggccagcctctcccaccactgcaggtgccagagcaagtggcacaagcaccactgatacctcccctgaaaaaaccccccaaatggattagaagaccaacaggtgtttcatttgcttttggagggaagctggttacttttggcctccccagcacccctgcccatctggtgccacagccttgcccccgcctagtcttcatcagtcaagtcaccacagaatctgaattcctgatgcgatcagctgagctgcaggaggccttgggatcaggaaatctactgaattactgtcagaacaagagccagcaagctttactgcaaagtgaaaagatgctgtggcagttcctgaaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaaaccaggcagcctctcttgctaggaggccacttctgctgttacataactcctccctgcagaagaggggacttctgcaacagattctgtttctttttcccgactcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttggtaaaaaaaaaaaaaaaaaaa

SEQ ID NO: 109 - DNA, 1559 bp, Homo sapiens
aaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtagagaaggaactcaccccagaggtgctgcaagagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaa

SEQ ID NO: 110 - DNA, 7596 bp, Homo sapiens
ggaggggaggggagggaggaggctagacaaggcgggggaagggggagtagcggtggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatgtaaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtttttcttttgtgcctttgtttacccctaattgagataagcagtttgacttactagattacaactttggcagttcaaagtctttgttgaagactttgaggaaaaagatttggaaaaattgttgactttcggccgggcatgatggctcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaaaaaaaagaaaaaaaaaagtgttgactttgtagaaattatgttctttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattagccatgttgcaaaattctagacagtaaaacctgtgttttagaaacagaggggaaatttaaataatggagtcctggttagcctttcagggattagggatttgggtttttttttttttctctttttaatactagaatatctcagtttttataaaaggtaagtttaaaatgtttattgtgccattattttaactggcatcttgaaagaacagtaggttttctccatgataaactgattccagtaagaattttcagtacataccaagtacctggaaagttcttcagataagttaatagatccaaggagatacatgcctcagtgagataaactgacctttttactagctaaactatttagccagagcaatactctgtagaactgtgcttttctaaagtaaagattatctgtttctcaattttatgtgcataatacttttcctggtgctagctttgataggcaaaatattttgaaatgttggtcccataatgattgtgctagttcataagctttgttgttatgagtgtaatcataaaaatatttccaagcagtttttgacctttattctacatttctgggcatttgtaatatggtattctactggtatatatttttaaagtttgcgtttagattatggtaaagaaatttcaagcatatttcttctaataaagtattaagacagtgtttcagaatatcaaggcacacctccttagttgttttagattagaactctagaaacaattttgtgaacattgaaagtattttgagttaagcctaagctgattaatcacacaatacatacttttcctgcattttctttcagtgacatttgagaattgggtgacattttaaaatgtgttttataccatttagcttttgcaaacaagttctaaagttttggagaaaaagtgatgtggtcaagagttgaagtctcatatatctttagtagcactcccatgaattatttccgtgacagtaacaagtgtgtgttccatgtctgatttggggcactggttagactgcattaatagctacttgattagaattcgaacttttaaaattttgaaatgtttaagaatgtattagaaaatgcatgctttatgttgaaaaaatacattgctttaatattcctcattcttgagttaagaaatttatgttaattttgcatgggcacaaacttaatcagaaacattttgtggagttacatttcctcttattatttatcaaggttcagtattgatctttgaaaccttggtcccgttaacttactagtcacattgaccaatgttttatagaaatgcctagaattttgagactaatagtagttatccattaacattccaaaagttttgtgctttttaaaatttgttttggtaattatcacatttttttctcttaccttcctttaaatggccacagtgtgtactgctggaatgttccatccaaaagatgtagcttcagaagcacagtgattgccccagggtccatgagatattgtttgtattatgaagttggagtgctgtctactgaaattatactcttaaataaatatgtatgtagtgtgtaatattttctaataaattcttttgataaactaa

SEQ ID NO: 111 - DNA, 3602 bp, Homo sapiens
gataggcgccgggcagctgagctggtaggaggaccagacggggatgttcggctccgccccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtctgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcataa

SEQ ID NO: 112 - DNA, 2049 bp, Homo sapiens
aattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggatgaattctgcagcacagctgcggacccggaagactcattttcctggagccccgtgttacttcaataaagttatctcagattagcctcctgcagctggaggctcctatcaccccagcctacgcttgacagggtgaacaaaagaaggcaccacataacatctaaatgaaaaatttagccctgtcttctaagcatctgtgaaaagaaacatatgtattcccctttttggcatctcagtatttcagtacatttatacatcatgagattgagaacctcgggcttccacat

SEQ ID NO: 113 - DNA, 2304 bp, Homo sapiens
ctcgcgtttccggccggaagcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcgtattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatgatcttggaaaaaaaaa

SEQ ID NO: 114 - DNA, 1730 bp, Homo sapiens
ccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaaaaaaaaaaaaaaaaaaaaaaaaa

SEQ ID NO: 115 - DNA, 4878 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccacgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 116 - DNA, 5262 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccacgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 117 - DNA, 6388 bp, Homo sapiens
ggcgctttggtcgcagcggcggtatggtcgccgcagtttctcggtcttcgcttcggcgaccttgacccccttgtgggtgggcgaggctggaagagaggctccccaccccactcggcttcctgatccctgggggcgccgggcggtcaccgagggccgtgtgagcgccgctctgccggctccgggtccatgcggctgcgggagaagccctgggcgtcggggctggcctgggaggggcccgagtcccctggtgacctgggcgcgcggcggccccacacctttccgtccgcctcatcgcggcgcatttctcttcacatcctcggggtgtgtgtgtgttggtgaccggaggaagcctgtctaatgacttttctggaagcgtcgtgtattaggagctccggggccggactgcttgggtccgcatctccatccaccgcttactggctttgggacctctgcaagtcacttcacttctctttctcagtttcaagtgtaaaatgcggaaaataatagcaacttatctcctaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgttacaagattggtcctggaattttcacagtttacgttattgacagaatgttttatcaacaatgcatttgcttatgtcttagtccactcaggctgctataataaaataccatcaactatgtggtgtattaacaaaaa

SEQ ID NO: 118 - DNA, 1546 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaaaaaaaaaaaaaaaaaa

SEQ ID NO: 119 - DNA, 1687 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaaaaaaaaaaaaaaaaaa

SEQ ID NO: 120 - DNA, 1878 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaaaaaaaaaaaaaaaaaa

SEQ ID NO: 121 - DNA, 1575 bp, Homo sapiens
atgagcaatgaaaataaggcaaggagagaggaatggaaaagaagggattatacaaggaaagcttctaaggaggaattggcaacagctgatagttaccaggctccagaaatatcagtatccgcaactgggcccaagcggggccagtactatgccgggtccctgctcaacgtgaaccagatcgggagtggcaccgtggacctgcccttccagacccccttccaatccttgggcctggacaccagcctgactaccaggcaccatgggctggtgaacagggtgtaccgggaatgcggccgactaggctccccgcactgcctgcacctgtcaaaggacaaacacggacagcaggccaacagctgcccatacggcacctgggtcccaggacgtgcaccagaaaaaagtcttactgttaacagtcccaggaatggaagagaccatatcagaggcagacaaaaacctttccaagcaagcgtggggaaaccaagaagacgggatccaggaccaagtcctgcgcggaatcaacgaatcaacatcttcccgtccgccgaccaggaaaacactacagccctgatctccgccattcacaatactgtgggctccctgcaccgcctgaccaacatccacttcccttccccgctcgactccgaggagcccaccttccccgcactcagtagctccagcagcaccgacaacgtctcggccaacctgatgcacctgggcatcagcggcgccggccaaggggatgagtacactcggctcccctccgcagcaccgtccagccggcgtcagccccctgtcccgagcacagagacgaggcatcagcagtcatcgcccactctgtccccgctgtcatacatcactcaggccgtggccttgaatgccctgtctctggagcagcagcccctgttgcccagcaccaacctgaatcgtgggccacagccgcccccgctcgcggtcacggtacctccccacgaagaatcccggcctgccgtcgatggggatcgacatcgcctcggcgccgcctctgcagcagtagcggcactagccccggctcctcggccaaccaggagctccccgcaacacacttccactctgggcagcgtgtttggggacgcgtactatgagcagcagatggcgttcaggcaggccaatgctctgtcccaccagctggagcagttcaacacgatggagaacgccatcagctccctatacaacaggggctccacgctcaactactcgcaggcggtcatgatagccctcacccacagccacgggagcctgctgaactcgcagcagctgggctacaccagccacagtggcatccccaacatcatcctcatagtgacaggacaggtcggcgacctcagcttcgactccgacagccagtttcccctggatgaactcaagatcgaccccctgaccctggacggacagaccctgaacggactgcacatgctcaatgaccccgacgtggttctggcggacccagccaccaagaacaccttccgaatggaccgcctccatcccgacggcgcctccccagcccggggacagccacgctctgtccctctccaa

SEQ ID NO: 122 - DNA, 364 bp, Homo sapiens
atgagcccaatattcacctgcatcacaatcctttgtctgctggctgcaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatccacagtgttaaatatta

SEQ ID NO: 123 - DNA, 2613 bp, Homo sapiens
atgggaaataaagccttagctttggccttaagaatggagcaactggagagtcaaacagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccactgtgctgagatgtgacccttattattgttctagtagccgcatactgagaataaatcagaagaaaattagcattattttgcaagaaaatagcttcagggaccaagaaaatcagacttctgaagtcaccttcatcctcttgggcttctcagaatatccagaccttcagacgcccctgttcctggtgttcctgaccatctacacagtcactgtgctggggaatctgggcatgatcatagtcatcaggatcagccccaaactccacacccccatgtgctttttcctcagccacttgtcctttgttgatttctgttattccaccacaattacacccaaactgctggagaacttggttgtggaagatagaactatctccttcacaggatgcaccatgcagttattctttgtctgcatatttgtagtaacagaaacattcatgctggcagtgatggcctatgaccgatatgtggcggtgtgtaaccctcttctctacacagttgcaatgtaccagaggctttgctccttgattcaaaaaaatcagactgctggagtcaccttcatcctcttgggcttctcagaatttccagaccttcagatacccctgttcctggtcttcctgaccatctacacaatcactgtgatggggaatctgggcatgatcatggtcatcaggatcaaccccaaactccacacccctatgtactttttcctcagccacttgtcctttgttgatttctgttattccaccacaattacaccaaaactgctggagaacttggttgtggaagacagaatcatctccttcacaggatgcatcatgcaattcttctttgcctgtatatttgtggtgacagaaacattcatgctggcagcgatggcttatgacagatttgtggcagtgtgtaaccctctgctttacacagttgcaatgtcccagaggctttgctccttgttagtggctgcatcatactcttggagtttagtttgttccttaacatacacatactttctgttgactttatctttttgtaggactaacttcattaataactttgtctgtgagcacgctgccattgttgctgtgtcctgctctgacccctacatgagccagaaggtcattttagtttctgcaacattcaatgaaataagcagcctggtgatcattctcacttcctatgctttcatttttatcactgtcatgaagatgccttccactggggggcgcaagaaagcgttctccacgtgtgcctcccacctgaccgccattaccattttccatgggactatcctttttctctactgtgttcctaactccaaaagttcatggctcatggtcaaggtggcctctgtcttttacacagtggtcattcccatgctgaaccccttgatctatagcctcaggaacaaagatgtaaaagagacagcgcccctcttcctggtgttcttgaccacctacactgtcgctctggtgggaaacctgggcataattgtggttgtaagaatcaatcctaagctccataccaccatgtactttttcctcagtcatctatcctttttggatacttgttattccaatgtatttacacccaaactgttagagattttggttgtggaagacagaactatctccttcaaaggatgcatggtacaatttttctttggttgtgcatttgtaatcacagaaatgttcatgttagcggtgatggcttatgacttgtttatggctgtttgtaaccccctgctctacacagtggctatgtctcctaagctctgtgctctcctggtagctggaacttacacatggggtggactctgttccctgacactcacttattctcttttggtgttatcctactgtggatctaacatcataaatcactttggctgtgagtactctgccattctttctctatcctgctctgatccctacttcaaccagatggcgtgtttagtcatttctatattcagtgaagcttgtagcctcctggccatccttgccttctatgtcttcatagttgccactgtcatcaagatgctttctacgggtggaccccaaaaggccatctccacctgtgcctcccacctgaccaccgtctccattttccatggggtcatcctgctcctttactgtgtgcccaactccaaaagctcatggctcctggtcaaagtggctactgtactttttacagtcataatccctatgctgaatcccctgatctacagccttaggaacaaagatgtaaaagagaccgtcaggaagttgataaactcccaatcaccttttcactcaaaa

SEQ ID NO: 124 - DNA, 636 bp, Homo sapiens
gcgtcatccattaatgctttggctaggagggggtctatcgccctggttggagtgcagcagtgtaatcatagctcactgctgccatgaacttctgggctcaagcgatcctcccacctcagcctccctgtgtgctgggattaaaagtgtgagccaccgtgcctcatcgtaagggtcttaaaagaaaccctatttcatgtttgctttccatatgctggatgatgtgtgtggattttcagtgtgtgtttcagagtcttaaaagctcatgctagcttgcttaacatacctgccataactcatgatatagaaccctatggagaactgtgttgcaacatggatgcagtgcctatactaaggcacattgccaagctgaagactgtcagagagcatcactaacggagtgatggcagcagcagcccatccagaatggctgctgccaacatacgggctgcagtggggaggcacagccagtcctcccactccacagagcaggcaggagtcccgcccctgggccccaggcctcctgctccaggggacaagtgcaagccctgccccttccgaattggcagggcaggagctcctcatgggcagctgcagtcacccaagcccggctgtggacctgggcatctctgtgctctt

SEQ ID NO: 125 - DNA, 2949 bp, Homo sapiens
atgtttgtattttgcacttgcccggaggtgtttcacgggaagtgagcattttttaaaacaaaaatagaatttagaaaaaaaaaaggcagacacgatggatttctagtgttgtacgtgctgtagaaagcacttgaaaatgcgttttgccaggggccgcaaccagaagctacatgacttctggaatctgttccttacacagtaaattcctgggccagttggtaaacagcaaggagccacaagaaatcactcataggcaaaagccgagtgagcccaggccaagctccactttgtccactttgccctatttttggaattcagggggaaacatcttgggagcaggcccattgcacccctctgcctcctctcgatgccttacagttggtggggtttgacacatggaaaattgtgaaagttagaacacggaacaaaaatgaagcctcaacatagagttaatagaggcaaggggctacagagaatttagatcctaatcaagcacgtcttatgtactagcgcttccctggaaggccaggataactttatgactacaaagaaaacatgttttcctgcttggaagttgccagaacttgtctaatataaaagctgggatttcttgcccgtgggctgtcgcgtacggctacccaggccgcctcgtgaagcctcctcctgggagctcggcgccctcaggtgctccctgagatgccagcacttgaacgacctgctccagggaggctttagccccaagaaggttctggaaagctccaggaagtttagccggcacgcacaaaagccagagacaaatctccagcctgcctggaaatgctgtgggctcagggcaatgggctgaggtcttgtgtccaaaactgctcttgcatctccctggggagcccgggtgggcaggaacaacaaggtcctgtggccatgccctcgccccatgctcacccacactgcctgtgcctgctgggcccatctcagggctgcactggcccctagtggccaagcacgggctctacccctctgcgcctgcctggctgcctgtgcaggtgcccaccacactgtccctgagcagagcagagaccagcctgagccccgggctccgtggctaccatgctgagagtgagccctgtgcatgcacacacacttacgatgctgctggccccgagcagtggccggccacacgggctgctagtcatactgcccgctgctcctgggactcctgagcccctcactctctatagggtgaggatgcccagctctgcaagacacacagcaaacggagcctcagagtgcacagcgtggagatggggctccccccacaggctgcacccccatctagtcccggggaacgagaatgaagggcctacctgagcacacaagccccaggagggcatgggagctgcatttgggggcagtgactgggagggctgctgactccaggctcagattaaaagacagacggcaacactggggttgcagagctcaggagccagtcctggccccctgcctcctccctcatgaggttcccctgatccccaggacatcggcttccacatctgcacatctgggagacaaatgcaccatcagggagggcaaatcatacctgggaagggcctgactccagcagtttcagcagtggctgaaagatcatggctatttttgccatcattacaatggaatgtccactccctccagccacctccacagcaatcaacaccggtgtccagccactctacatggacgtgtggggaacagagcacaggcctcttggcttggctgtggtcaccgggagggagcagggagggacagctgccaagaggatgggggagggagcctgctactcaggaacgctggggcaagacatgagacaaagggctgccttcacccaccagtaggagcctgaccctgagcccaaagaaactgcccacctgtgtgctgaccccagggcctgaggacaggtccccaagtggacgtctcaaagagagtcccacattccagggcacatgggaactatggccttctggcagctggagggcagcaggaagggcacagctgtctgagacccgtgtggcttcccagaaagaggtgccacccctgaggaggcaccggtgctcacggactcctggttgccagtcttgccagggcaaaaaggcaagcgaaggaaaccctctcttcgtggggcactctgccttgcagtgtcaggtgagatcccggggggaaagctggcttgagctcctctggaatgtgcagggaggactccgtcaggcccggctctgcctccaagctgggcagcaggcgagccccagagctccaccagccccactggcagaggagggccctcacgaggcaggagcccatgattcatgccctgctggaatttgtcgagcatgccgagatttgcagctcctccgagatcgggtcctgccctgatcaaaagaaaagaagatggatgaggacactataaataggccagagccacccagctggcctcggggatgcaggcggtatgtgttctgggctctcacgaagctaagaaactctaaatccaaggtgacatcgtggcacaccgccacctgcttcagggggacacaggggacaaggaggagctattggcagagcgctcggttcctgcaagttccaacttctgctaaaattggttaattggttcctttgcatgattcagggcacacaggcttctctgtccacaaaatttgctcgcctgcacacccagagaaatggacttggcttggtttttctgaacttttgcctctgcggaatcagcagtggacgtgtgagctggggcctctgtccctgtcatgtgaggaggtcaggcaggacaagcaggaagcactgggcaatgagtcaggaggcctggtggggagcttgggtgagtctgttttcctctctggacctcagtcttctcctctggttgatgtaataaaatcctacaaactg

SEQ ID NO: 126 - protein, 1306 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 127 - protein, 732 aa, Homo sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 128 - protein, 1353 aa, Homo sapiens
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 129 - protein, 359 aa, Homo sapiens [sequence omitted]

SEQ ID NO: 130 - protein, 359 aa, Homo sapiens [sequence omitted]

SEQ ID NO: 131 - protein, 359 aa, Homo sapiens [sequence omitted]

SEQ ID NO: 132 - protein, 359 aa, Homo sapiens [sequence omitted]

SEQ ID NO: 133 - protein, 359 aa, Homo sapiens [sequence omitted]

SEQ ID NO: 134 - protein, 1880 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 135 - protein, 1856 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEDHTSTPNP

SEQ ID NO: 136 - protein, 1881 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 137 - protein, 1719 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 138 - protein, 722 aa, Homo sapiens
MSQQDAVAALSERLLVAAYKGQTENVVQLINKGARVAVTKHGRTPLHLAANKGHLPVVQILLKAGCDLDVQDDGDQTALHRATVVGNTEIIAALIHEGCALDRQDKDGNTALHEASWHGFSQSAKLLVKAGANVLAKNKAGNTALHLACQNSHSQSTRVLLLAGSRADLKNNAGDTCLHVAARYNHLSIIRLLLTAFCSVHEKNQAGDTALHVAAALNHKKVAKILLEAGADTTIVNNAGQTPLETARYHNNPEVALLLTKAPQVLRFSRGRSLRKKRERLKEERRAQSVPRDEVAQSKGSVSAGDTPSSEQAVARKEEAREEFLSASPEPRAKDDRRRKSRPKVSAFSDPTPPADQQPGHQKNLHAHNHPKKRNRHRCSSPPPPHEFRAYQLYTLYRGKDGKVMQAPINGCRCEPLINKLENQLEATVEEIKAELGSVQDKMNTKLGQMENKTQHQMRVLDKLMVERLSAERTECLNRLQQHSDTEKHEGEKRQISLVDELKTWCMLKIQNLEQKLSGDSRACRAKSTPSTCVDQLVVTAGPAAASDSSPPVVRPKEKALNSTATQRLQQELSSSDCTGSRLRNVKVQTALLPMNEAARSDQQAGPCVNRGTQTKKSGKSGPTRHRAQQPAASSTCGQPPPATGSEQTGPHIRDTSQALELTQYFFEAVSTQMEKWYERKIEEARSQANQKAQQDKATLKEHIKSLEEELAKLRTRVQKEN

SEQ ID NO: 139 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKLPVKKATVVYQGERVKIQEKFKNGMLHGDKVSFFCKNKEKKCSYTEDAQCIDGTIEVPKCFKEHSSLAFWKTDASDVKPC

SEQ ID NO: 140 - protein, 400 aa, Homo sapiens
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVNRELKKLLVASVGDDLQYHFERLAREKNQLILENEALGRNTAQLSEQLERMSIQCDVWRSKFLASRVMADELTNSRAALQRQNRDAHGAIQDLLSEREQFRQEMIATQKLLEELLVSLQWGREQTYSPSVQPHSTAELALTNHKLAKAVNSHLLGNVGINNQKKIPSTVEFCSTPAEKMAETVLRILDPVTCKESSPDNPFFESSPTTLLATKKNIGRFHPYTRYENITFNCCNHCRGELIAL

SEQ ID NO: 141 - protein, 278 aa, Homo sapiens
MQWLRVRESPGEATGHRVTMGTAALGPVWAALLLFLLMCEIPMVELTFDRAVASGCQRCCDSEDPLDPAHVSSASSSGRPHALPEIRPYINITILKGDKGDPGPMGLPGYMGREGPQGEPGPQGSKGDKGEMGSPGAPCQKRFFAFSVGRKTALHSGEDFQTLLFERVFVNLDGCFDMATGQFAAPLRGIYFFSLNVHSWNYKETYVHIMHNQKEAVILYAQPSERSIMQSQSVMLDLAYGDRVWVRLFKRQRENAIYSNDFDTYITFSGHLIKAEDD

SEQ ID NO: 142 - protein, 278 aa, Homo sapiens; identical to SEQ ID NO: 141

SEQ ID NO: 143 - protein, 508 aa, Homo sapiens
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRENRDPQQAFRLWLKKKHEEQMKERQTEELRKQEECLFFLKGTEGRERAFKQWLRRKRMEKMAEQQAVRERTRQLRLEAKRSKQLQHHLYMSEAKPFRFTDHYN

SEQ ID NO: 144 - protein, 767 aa, Homo sapiens
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSPEYVVCQDSIPELLTLATLTWGRGLPAGQAEVEMIERAREKRAWEASLPALSDTSQFEKRRKMMNEMERKEWAFREQEIEKLQEIRLEVLKELLRKREENQNEVNMKHLNARWSKLQEGKEAKMAKIQRTHVSTIRKLVGKRKNIEGKLERRNIIKDYSDYASQVYGPLSRLGCFPDNNSEDFVVKNYYLNTYEGLVELESCLPDFVTQPQIRAPKPKVITTKAGFLKRAARLDYELAEVHKALLDKKNKVLEVKKPPRFLQRNPIPQPRLPTPTLEMTSNEEEEMEMAVIYLQKLLRGRVVQNMMFEGKEKRLELIQELRTCHALQEDEKLVKKAEKQVTLALQRQRNLHEHKVSLVENHLAGLEGRALADMFDFLSKELVRLQEERRIHAFVMLAERQRRVREAEESGRRQVEKQRLREEDEIFKEVVKVHHSTISSYLEDIILNTEANTAEEQARAEIEKMAEKINDIAYEMESRRTYLQSEEIVAELVYSFLIPEVQKYFVKEKVRNAQRKHILAAHQIIHSYTESMVQKKLTEGEQDEASNAAMLLEKETQNENNS

SEQ ID NO: 145 - protein, 1243 aa, Homo sapiens
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKVRSSESLMSDQCPCLCIKELWVLLIHLLDHRSKWFVSESFWNWLNKLLKTLLEKSSDRRRSSMPVIQSRDPLGFSWWIITHVASFYKFDRHGVPDEMRKVESNWNFVEELLKKSISVQGVILEEQLRMYLHCCLTLCDFWEPNIAIVTILWEYYSKNLNSSFSISWLPFKGLANTMKSPLSMLEMVKTCCCDKQDQELYKSSSSYTIFLCILAKVVKKAMKSNGPHPWKQVKGRIYSKFHQKRMEELTEVGLQNFFSLFLLLAAVAEVEDVASHVLDLLNFLKPAFVTSQRALIWKGHMAFLLMYAQKNLDIGVLAEKFSCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSTLCEALSHSGYVSFQALTVRSWIRCVLQMYIKNLSGPDDLLIDKNLEEAVEKEYMKQLVKLTRLLFNLSEVKSIFSKAQVEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 146 - protein, 204 aa, Homo sapiens
MERLTLPLGGAAAVDEYLEYRRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 147 - protein, 262 aa, Homo sapiens
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIVGTSSQVSSLRRPEEDDMAFFERRYQERMKMEKAAKWKGKAPLPSATKPS

SEQ ID NO: 148 - protein, 240 aa, Homo sapiens
MERLTLPLGGAAAVDEYLEYRRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIGVPSVEFLESPITAVDSPFLKAFQASSSSSPETLTDVGTSSQVSSLRRPEEDDMAFFERRYQERMKMEKAAKWKGKAPLPSATKPS

SEQ ID NO: 149 - protein, 261 aa, Homo sapiens
MERLTLPLGGAAAVDEYLEYRRIVGEDDGGKLFTPEEYEEYKRKVLPLRLQNRLFVSWRSPTGMDCKLVGPETLCFCTHRYKQHKTDLEAIPQQCPIDLPCQVTGCQCRAYLYVPLNGSQPIRCRCKHFADQHSAAPGFTCNTCSKCSGFHSCFTCACGQPAYAHDTVVETKQERLAQEKPVGQDIPYAAMGGLTGFSSLAEGYMRLDDSGIGTSSQVSSLRRPEEDDMAFFERRYQERMKMEKAAKWKGKAPLPSATKPS

SEQ ID NO: 150 - protein, 418 aa, Homo sapiens
MFKGILQSGLDNFVINHMLKNNVAGQTSIQTLVPNTDQKSTSVKKDNHKKKTVKMLEYLGKDVLHGVFNYLAKHDVLTLKEEEKKKYYDAKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLAVISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 151 - protein, 538 aa, Homo sapiens
MLQIGEDVDYLLIPREVRLAGGVWRVISKPATKEAEFRERLTQFLEEEGRTLEDVARIMEKSTPHPPQPPKKPKEPRVRRRVQQMVTPPPRLVVGTYDSSNASDSEFSDFETSRDKSRQGPRRGKKVRKMPVSYLGSKFLGSDLESEDDEELVEAFLRRQEKQPSAPPARRRVNLPVPMFEDNLGPQLSKADRWREYVSQVSWGKLKRRVKGWAPRAGPGVGEARLASTAVESAGVSSAPEGTSPGDRLGNAGDVCVPQASPRRWRPKINWASFRRRRKEQTAPTGQGADIEADQGGEAADSQREEAIADQREGAAGNQRAGAPADQGAEAADNQREEAADNQRAGAPAEEGAEAADNQREEAADNQRAEAPADQRSQGTDNHREEAADNQRAEAPADQGSEVTDNQREEAVHDQRERAPAVQGADNQRAQARAGQRAEAAHNQRAGAPGIQEAEVSAAQGTTGTAPGARARKQVKTVRFQTPGRFSWFCKRRRAFWHTPRLPTLPKRVPRAGEVRNLRVLRAEARAEAEQGEQEDQL

SEQ ID NO: 152 - protein, 529 aa, Homo sapiens
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGLPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLNSP

SEQ ID NO: 153 - protein, 569 aa, Homo sapiens
MLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 154 - protein, 339 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 155 - protein, 339 aa, Homo sapiens; identical to SEQ ID NO: 154

SEQ ID NO: 156 - protein, 339 aa, Homo sapiens; identical to SEQ ID NO: 154

SEQ ID NO: 157 - protein, 339 aa, Homo sapiens; identical to SEQ ID NO: 154

SEQ ID NO: 158 - protein, 339 aa, Homo sapiens; identical to SEQ ID NO: 154

SEQ ID NO: 159 - protein, 386 aa, Homo sapiens
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGTGDANPAVSEDALFRDKLKHMGKSTRRKLFELARAFSEKTKMRKSKRKHLLKHQSLGAAASTANLLDDVEGHACDEDFRGRRQEAPKVEEGLREGQ

SEQ ID NO: 160 - protein, 508 aa, Homo sapiens
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 161 - protein, 323 aa, Homo sapiens
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 162 - protein, 323 aa, Homo sapiens; identical to SEQ ID NO: 161

SEQ ID NO: 163 - protein, 1227 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 164 - protein, 330 aa, Homo sapiens
MSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 165 - protein, 563 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 166 - protein, 593 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 167 - protein, 594 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 168 - protein, 625 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 169 - protein, 661 aa, Homo sapiens
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMRYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 170 - protein, 622 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 171 - protein, 615 aa, Homo sapiens
MAHVRGLQLPGCLALAALCSLVHSQHARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 172 - protein, 556 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGKLQA

SEQ ID NO: 173 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 174 - protein, 441 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 175 - protein, 443 aa, Homo sapiens
MQRVNMIMAESPGLITICLLGYLLSAECTVFLDHENANKILNRPKRYNSGKLEEFVQGNLERECMEEKCSFEEAREVFCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 176 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 177 - protein, 866 aa, Homo sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 178 - protein, 644 aa, Homo sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRGIHTSPLGKPSLSP

SEQ ID NO: 179 - protein, 453 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 180 - protein, 1498 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 181 - protein, 620 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGESCPPVLHQGQPGPDMPRGCDPNNPGGVSGRGLAQPEEAPAAQGQGCAEAASAPPAPPADPEITRGSGWRPTGCSQPRVMFMTAEPQARSYPREGSWHGRRLKDWRVWSVEAGGQRLQLWKRGHAASSWCSIREPFGQCLSVCLPLCLRAPSIWDGRNLWRPHPPPCTLWMTWYPGWTTYWPLSSTSLIWAPDGSLRFPALRVDSVPSSVQNPPVLPFGPLCSCLVFPRNSHPHSISHCGLTNLLSSLRTGLAGSLGMSFIFLSVKLARCPLPFTLENKISLCNMVKPHLYQQNKKTQKLARCGGASLYSQQLRGLRWENGLSLGGRGCSELRSHHCTLARVTKPDFVSKNTGMNMSITLI

SEQ ID NO: 182 - protein, 339 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSSVAEFSEATAELTVSFTNKVFTTETSRSITTSPKESDSPAGPARQYYTKGNLVRICLGAVILIILAGFLAEDWHSRRKRLRHRGRAVQRPLPPLPPLPQTRKSHGGQDGGRQDVHSRGLCS

SEQ ID NO: 183 - protein, 375 aa, Homo sapiens
MFPRSGPSNDEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 184 - protein, 370 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 185 - protein, 1159 aa, Homo sapiens
MPRKQPAGCIFLLTFLGLSGLVGTVTRTYYIGIVEEYWNYVPQGKNVITGKSFTEDKLATLFLERGPNRIGSIYKKAVYRRFTDGTYSIEIPKPPWLGFLGPILRAEVGDVIVIHLKNFASRPYSLHPHGVFYNKDSEGALYPDGTSGRNKNDDMVPPGKNYTYVWPVREEYAPTPADANCLTWVYHSHIDAPKDICSGLIGPLLVCKEGILNRYSGTRNDVDREFVIMFTLVDENQSWYLNENIKHFCTNPDSVDKKDAVFQRSNKMHALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGYNKFSGLPLNASGSDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQKGIDKEFYLLFTVFDENLSRYFDENIQKFIWHPFSIDKEDKEFVKSNRMHAVNGYMYGNQPGLNMCKRDRVSWHLIGLGTDTDMHGIVFQGNTIHLRGTHRDSLALFPHMATTAFMQPDHAGIFRVFCATMPHLSRGMGQIYEVSSCDNRDPSEQRYGMIRTFYIAAEEVEWDYAPNKNWEFEKQHVDARGERHGDIFMNRTENWIGSQYKKVVYREYTDGEFVEIKARPPREEHLELLGPMIHAEVGNTVLIIFKNKASRPYSISAQGVEEMDSGKQFQVPMTKPGEVKTYRWNIPKRSGPGPSDPNCIPWVYYSTVNFVKDTYSGLMGPLITCRKGVLNEKGRRSDVDYEFALLFLVFNENESWYLDDNIKKYLNKDPRDFKRTDDFEESNRMHAINGKIFGNLHGLIMNEDTMTNWYLLGIGSEVDIHTIHYHAESFLFKIDKSYREDVYDLFPGTFQTIELFADHPGTWLLHCHVSDHIHAGMETTYTVLRNIDNRIPYSTTSPGVASHPATVPSNERPGKEQLYFFGKNLGPTGAKAALVILFIIGLLLLITTVILSLRLCSAMKQTDYQQVQSCALPTDAL

SEQ ID NO: 186 - protein, 1165 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVGKCQKCTETHGVYPELANLSSDMGFSFFF

SEQ ID NO: 187 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 188 - protein, 221 aa, Homo sapiens [sequence omitted]

SEQ ID NO: 189 - protein, 487 aa, Homo sapiens
MEPPANQEEAPTEPPGPPVEPELSPSEQEQPAQPSGEVESSPAQQETPAQPPEHHEVTVSPPGHHQTQHSDLPNVSVKPPDMQLTIATEPSAEVGTSPVHQEATAQLSGPGNDVEPPTIQHGGPPLPPESPEDAGPLAIQQETSVQSPEPVNNENPSPTQQEAAAEHPQTAEKGKSSLTQQEAPAETPELPNVVVAQSPEHSNLTQATVQPLDLGLTITPESTTEVELSPTMQETPTHPPKKVVPQLPVYQEVTIPTPGQDQAQHPMSPSITVQPLDLGLTITPEPTTEVGHSTPLKKNVVPPKHPKVTLPHPDQVQTQHSNLTQATVQPLDLGLTTTPESTTEIEPSAALTTTAPPPEHPEVTLPPSDKGRAQHSNLTQVTLPPLDLELTITTEPTTEVKPSPTTEETSTQPPDLGLAITPEPTTETGHSTALEKTTAPHPDQVQTLHRKLTEVTGPPTELEPTQDSLVQSESYAQNKALTAPEEQ

SEQ ID NO: 190 - protein, 156 aa, Homo sapiens
MRLGHLRPAEAAAPPHLQQLLQVVLGAGAAGWRHRLLIPRVQACLVSEDAGRCLDDLLLDMCTSPTPTPSPPHRQDPVRPDSQLCPQLAQGGRALSPAVAAREGELTQQVREGLTRPRGLAQQDPGRPGCGSAQAPPSRSLCGSAGSFSTAPKAGC

SEQ ID NO: 191 - protein, 256 aa, Homo sapiens [sequence omitted]

SEQ ID NO: 192 - protein, 1256 aa, Homo sapiens [sequence omitted]

SEQ ID NO: 193 - protein, 1076 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRNKSENEKNRNQEDNKVKDLNQEIEKLKTQIKHFESLEEELKKMKSKNNDLQDNYLSEQNKNKLLASQLEEIKLQIKKQKELENGEVEGEDAFLSSKGRHERTKFRGHGSEASVSKHTARELSPQHKRERLRNREFALNNENYSLSNRQVSSPSFTNRRAAKASHMGVSTDSGTQETKKTEDRFVPSSSKSEGKKSREQPSVLSRYPPAAQEHSKAWKGTSKPGTESGLKGKVEKTTRTFSDTTHGSVPSDPLGRADKASDTSSETVFGKRGHVLGNGSQVTQAANSGCSKAIGALASSRRSSSEGLSKGKKAANGLEADNSCPNSKAPVLSKYPYSCRSQENILQGFSTSHKEGVNQPAAVVMEDSSPHEALRCRVIKSSGREKPDSDDDLDIASLVTAKLVNTTITPEPEPKPQPNSREKAKTRGAPRTSLFENDKDAGMENESVKSVRASTNTMELPDTNGAGVKSQRPFSPREALRSRAIIKPVIVDKDVKKIMGGSGTETTLEKQKPVSKPGPNKVTSSITIYPSDSSSPRAAPGEALRERHTSTSNIQVGLAELTSVSNHVSSPFELSIHKHDITLQLAEAERMADGPLKNRPETVVSRSSIIIKPSDPVERNSHAPPAETIRWKSHSAPSEVGFSDARHVTVRNAWKSRRDLKSLEDPPTRIGKNVESTNSNAYTQRSSTDFSELEQPRSCLFEQGTRRVGPSSGDAPEPSSRRTQSSLTVSEVLTRRNRVGDTITVAAWNHSASMEEEGEDCTLSVYRQLHNSLDPSELPGKQGLPESGRVRAEERLRPTRPCAEEN

SEQ ID NO: 194 - protein, 865 aa, Homo sapiens
MQDIAFLSGGRGKDNAWIITFPENCNFRCIPEEVIAKVLTYLTSIARQNGSDSRFTIILDRRLDTWSSLKISLQKISVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLM

SEQ ID NO: 195 - protein, 985 aa, Homo sapiens
MQDIAFLSGGRGKDNAWIITFPENCNFRCIPEEVIAKVLTYLTSIARQNGSDSRFTIILDRRLDTWSSLKISLQKISASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 196 - protein, 925 aa, Homo sapiens
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 197 - protein, 5596 aa, Homo sapiens
MEHFLLEVAAAPLRLIAAKNEKSRSELGRFLAKQVWTPQDRQCVLSTLAQLLLDKDCTVLVGRQLRPLLLDLLERNAEAIKAGGQINHDLHERLCVSMSKLIGNHPDVLPFALRYFKDTSPVFQRLFLESSDANPVRYGRRRMKLRDLMEAAFKFLQQEQSVFRELWDWSVCVPLLRSHDTLVRWYTANCLALVTCMNEEHKLSFLKKIFNSDELIHFRLRLLEEAQLQDLEKALVLANPEVSLWRKQKELQYLQGHLVSSDLSPRVTAVCGVVLPGQLPAPGELGGNRSSSREQELALRSYVLVESVCKSLQTLAMAVASQNAVLLEGPIGCGKTSLVEYLAAVTGRTKPPQLLKVQLGDQTDSKMLLGMYRCTDVPGEFVWQPGTLTQAATMGHWILLEDIDYAPLDVVSVLIPLLENGELLIPGRGDCLKVAPGFQFFATRRLLSCGGNWYRPLNSHATLLDKYWTKIHLDNLDKRELNEVLQSRYPSLLAVVDHLLDIYIQLTGEKHHSWSDSSVGCEQAPEEVSEARRENKRPTLEGRELSLRDLLNWCNRIAHSFDSSSLSASLNIFQEALDCFTAMLSEHTSKLKMAEVIGSKLNISRKKAEFFCQLYKPEIVINELDLQVGRVRLLRKQSEAVHLQREKFTFAATRPSSVLIEQLAVCVSKGEPVLLVGETGTGKTSTIQYLAHITGHRLRVVNMNQQSDTADLLGGYKPVDHKLIWLPLREAFEELFAQTFSKKQNFTFLGHIQTCYRQKRWHDLLRLMQHVHKSAVNKDGKDSETGLLIKEKWEAFGLRLNHAQQQMKMTENTLLFAFVEGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGTYPVLIQGETSVGKTSLIQWLAAATGNHCVRINNHEHTDIQEYIGCYTSDSSGKLVFKEGVLIDAMRKGYWIILDELNLAPTDVLEALNRLLDDNRELLVTETQEVVKAHPRFMLFATQNPPGLYGGRKVLSRAFRNRFVELHFDELPSSELETILHKRCSLPPSYCSKLVKVMLDLQSYRRSSSVFAGKQGFITLRDLFRWAERYRLAEPTEKEYDWLQHLANDGYMLLAGRVRKQEEIDVIQEVLEKHFKKKLCPQSLFSKENVLKLLGKLSTQISTLECNFGHIVWTEGMRRLAMLVGRALEFGEPVLLVGDTGCGKTTICQVFAALANQKLYSVSCHLHMETSDFLGGLRPVRQKPNDKEEIDTSRLFEWHDGPLVQAMKEDGFFLLDEISLADDSVLERLNSVLEVEKSLVLAEKGSPEDKDSEIELLTAGKKFRILATMNPGGDFGKKELSPALRNRFTEIWCPQSTSREDLIQIISHNLRPGLCLGRIDPKGSDIPEVMLDFIDWLTHQEFGRKCVVSIRDILSWVNFMNKMGEEAALKRPEIISTVTSFVHAACLVYIDGIGSGVTSSGFGTALLARKECLKFLIKRLAKIVRLTEYQKNELKIYDRMKAKEFTGIDNLWGIHPFFIPRGPVLHRNNIADYALSAGTTAMNAQRLLRATKLKKPILLEGSPGVGKTSLVGALAKASGNTLVRINLSEQTDITDLFGADLPVEGGKGGEFAWRDGPLLAALKAGHWVVLDELNLASQSVLEGLNACFDHRGEIYVPELGMSFQVQHEKTKIFGCQNPFRQGGGRKGLPRSFLNRFTQVFVDPLTVIDMEFIASTLFPAIEKNIVKKMVAFNNQIDHEVTVEKKWGQKGGPWEFNLRDLFRWCQLMLVDQSPGCYDPGQHVFLVYGERMRTEEDKKKVIAVFKDVFGSNSNPYMGTRLFRITPYDVQLGYSVLSRGSCVPHPSRHPLLLLHQSFQPLESIMKCVQMSWMVILVGPASVGKTSLVQLLAHLTGHTLKIMAMNSAMDTTELLGGFEQVDLIRPWRRLLEKVEGTVRALLRDSLLISADDAEVVLRAWSHFLLTYKPKCLGEGGKAITMEIVNKLEAVLLLMQRLNNKINSYCKAEFAKLVEEFRSFGVKLTQLASGHSHGTFEWVDSMLVQALKSGDWLLMDNVNFCNPSVLDRLNALLEPGGVLTISERGMIDGSTPTITPNPNFRLFLSMDPVHGDISRAMRNRGLEIYISGEGDASTPDNLDLKVLLHSLGLVGNSVCDILLALHTETRSTVVGSPTSSVSTLIQTAILIVQYLQRGLSLDRAFSEACWEVYVCSQHSPANRKLVQALLEKHVSSLRAHETWGDSILGMGLWPDSVPSALFATEDSHLSTVRRDGQILVYCLNRMSMKTSSWTRSQPFTLQDLEKIMQSPSPENLKFNAVEVNTYWIDEPDVLVMAVKLLIERATNQDWMLRVKWLYHLAKNIPQGLESIQIHLEASAASLRNFYSHSLSGAVSNVFKILQPNTTDEFVIPLDPRWNMQALDMIRNLMDFDPQTDQPDQLFALLESAANKTIIYLDREKRVFTEANLVSVGSKKLRESVLRMSFEFHQDPESYHTLPHEIVVNLAAFFELCDALVLLWVQSSQGMVSDASANEILGSLRWRDRFWTVADTVKVDAPGLALLALHWHWVLKHLVHQIPRLLMNYEDKYYKEVQTVSEHIQNCLGSQTGGFAGIKKLQKFLGRPFPFKDKLVVECFSQLKVLNKVLAIREQMSALGESGWQEDINRLQVVASQWTLKKSLLQAWGLILRANILEDVSLDELKNFVHAQCLELKAKGLSLGFLEKKHDEASSLSHPDLTSVIHLTRSVQLWPAMEYLAMLWRYKVTADFMAQACLRRCSKNQQPQINEEISHLISFCLYHTPVTPQELRDLWSLLHHQKVSPEEITSLWSELFNSMFMSFWSSTVTTNPEYWLMWNPLPGMQQREAPKSVLDSTLKGPGNLNRPIFSKCCFEVLTSSWRASPWDVSGLPILSSSHVTLGEWVERTQQLQDISSMLWTNMAISSVAEFRRTDSQLQGQVLFRHLAGLAELLPESRRQEYMQNCEQLLLGSSQAFQHVGQTLGDMAGQEVLPKELLCQLLTSLHHFVGEGESKRSLPEPAQRGSLWVSLGLLQIQTWLPQARFDPAVKREYKLNYVKEELHQLQCEWKTRNLSSQLQTGRDLEDEVVVSYSHPHVRLLRQRMDRLDNLTCHLLKKQAFRPQLPAYESLVQEIHHYVTSIAKAPAVQDLLTRLLQALHIDGPRSAQVAQSLLKEEASWQQSHHQFRKRLSEEYTFYPDAVSPLQASILQLQHGMRLVASELHTSLHSSMVGADRLGTLATALLAFPSVGPTFPTYYAHADTLCSVKSEEVLRGLGKLILKRSGGKELEGKGQKACPTREQLLMNALLYLRSHVLCKGELDQRALQLFRHVCQEIISEWDEQERIAQEKAEQESGLYRYRSRNSRTALSEEEEEEREFRKQFPLHEKDFADILVQPTLEENKGTSDGQEEEAGTNPALLSQNSMQAVMLIHQQLCLNFARSLWYQQTLPPHEAKHYLSLFLSCYQTGASLVTHFYPLMGVELNDRLLGSQLLACTLSHNTLFGEAPSDLMVKPDGPYDFYQHPNVPEARQCQPVLQGFSEAVSHLLQDWPEHPALEQLLVVMDRIRSFPLSSPISKFLNGLEILLAKAQDWEENASRALSLRKHLDLISQMIIRWRKLELNCWSMSLDNTMKRHTEKSTKHWFSIYQMLEKHMQEQTEEQEDDKQMTLMLLVSTLQAFIEGSSLGEFHVRLQMLLVFHCHVLLMPQVEGKDSLCSVLWNLYHYYKQFFDRVQAKIVELRSPLEKELKEFVKISKWNDVSFWSIKQSVEKTHRTLFKFMKKFEAVLSEPCRSSLVESDKEEQPDFLPRPTDGAASELSSIQNLNRALRETLLAQPAAGQATIPEWCQGAAPSGLEGELLRRLPKLRKRMRKMCLTFMKESPLPRLVEGLDQFTGEVISSVSELQSLKVEPSAEKEKQRSEAKHILMQKQRALSDLFKHLAKIGLSYRKGLAWARSKNPQEMLHLHPLDLQSALSIVSSTQEADSRLLTEISSSWDGCQKYFYRSLARHARLNAALATPAKEMGMGNVERCRGFSAHLMKMLVRQRRSLTTLSEQWIILRNLLSCVQEIHSRLMGPQAYPVAFPPQDGVQQWTERLQHLAMQCQILLEQLSWLLQCCPSVGPAPGHGNVQVLGQPPGPCLEGPELSKGQLCGVVLDLIPSNLSYPSPIPGSQLPSGCRMRKQDHLWQQSTTRLTEMLKTIKTVKADVDKIRQQSCETLFHSWKDFEVCSSALSCLSQVSVHLQGLESLFILPGMEVEQRDSQMALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 198 - protein, 770 aa, Homo sapiens
MVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 199 - protein, 656 aa, Homo sapiens [sequence omitted]

SEQ ID NO: 200 - protein, 1909 aa, Homo sapiens
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRQSSQNWDKRLSIDSSLPSGFASPTNELPPTRIKESHILEGLRKLQKRKVLLEPPSVITKWGYKDCMNSNEGIYSPGIKSSSLKEYPPCKTADLGSPCKEPHKTFVYDLDSHVDADDDPSTLALLQAVPNQSCRPHGSKLTHSVSDSLFGWETNRKHFLEGTSSVYPKERPEKLTSCASSCPLEMKLCPSVQTPQVQRERGPQGQGHGRMALNLQLSDTDDNETFDELHIESSDEKSPSDVSLAADTDKSVENLDVLVGFGKSLCGSPEEEEKQVPIPSETRPKTFSFIKQQRVVKRTSSEECVTVIFDAEDGEPIEFSSHQTGVVTVTRNEISINSTPAGPKAEHTELLPQGIACLQPRAAARDYTFFKRSEEDTEKNIPKDNVDNVPRVSTESFSSRTVTQNPQQQKLVKPTHNISCQSNSRSSAPMGIYQKQNLTKIPPRGKSSPQKSKLMEPEATTLLPSSGLVTLEKSPALAPGKLSRFMKTESSGPLFELRSDPHIPKHSAQLPHSSRMPSRRDWVQCPKSQTPGSRSRPAIESSDSGEPPTRDEHCGSGPEAGVKSPSPPPPPGRSVSLLARPSYDYSPAPSSTKSETRVPSETARTPFKSPLLKGISAPVISSNPATTEVQRKKPSVAFKKPIFTHPMPSPEAVIQTRCPAHAPSSSFTVMALGPPKVSPKRGVPKTSPRQTLGTPQRDIGLQTPRISPSTHEPLEMTSSKSVSPGRKGQLNDSASTPPKPSFLGVNESPSSQVSSSSSSSSPAKSHNSPHGCQSAHEKGLKTRLPVGLKVLMKSPQLLRKSSTVPGKHEKDSLNEASKSSVAVNKSKPEDSKNPASMEITAGERNVTLPDSQAQGSLADGLPLETALQEPLESSIPGSDGRDGVDNRSMRRSLSSSKPHLKPALGMNGAKARSHSFSTHSGDKPSTPPIEGSGKVRTQIITNTAERGNSLTRQNSSTESSPNKAPSAPMLESLPSVGRPSGHPSSGKGSLGSSGSFSSQHGSPSKLPLRIPPKSEGLLIPPGKEDQQAFTQGECPSANVAVLGEPGSDRRSCPPTPTDCPEALQSPGRTQHPSTFETSSTSKLETSGRHPDASATATDAVSSEAPLSPTIEEKVMLCIQENVEKGQVQTKPTSVEAKQKPGPSFASWFGFRKSRLPALSSRKMDISKTKVEKKDAKVLGFGNRQLKSERKKEKKKPELQCETENELIKDTKSADNPDGGLQSKNNRRTPQDIYNQLKIEPRNRHSPVACSTKDTFMTELLNRVDKKAAPQTESGSSNASCRNVLKGSSQGSCLIGSSISTQGNHKKNMKIKADMEVPKDSLVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 201 - protein, 227 aa, Homo sapiens
MAPYHIRKYQESDRKSVVGLLSRGMAEHAPATFRRLLKLPRTLILLLGGALALLLVSGSWILALVFSLSLLPALWFLAKKPWTRYVDIALRTDMSDITKSYLSECGSCFWVGESEEKVVGTVGALPVDDPTLREKRLQLFHLSVDNEHRGQGIAKALVRTVLQFARDQGYSEVVLDTSNIQLSAMGLYQSLGFKKTGQSFFHVWARLVDLHTVHFIYHLPSAQAGRL

SEQ ID NO: 202 - protein, 1062 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 203 - protein, 434 aa, Homo sapiens
MEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 204 - protein, 397 aa, Homo sapiens
MEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 205 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 206 - protein, 777 aa, Homo sapiens; identical to SEQ ID NO: 205

SEQ ID NO: 207 - protein, 777 aa, Homo sapiens; identical to SEQ ID NO: 205

SEQ ID NO: 208 - protein, 777 aa, Homo sapiens; identical to SEQ ID NO: 205

SEQ ID NO: 209 - protein, 777 aa, Homo sapiens; identical to SEQ ID NO: 205

SEQ ID NO: 210 - protein, 742 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHENVMWLKPESTSHTLI

SEQ ID NO: 211 - protein, 778 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGRQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 212 - protein, 318 aa, Homo sapiens
MMSFAPNASHSPVFLLLGFSRANISYTLLFFLFLAIYLTTILGNVTLVLLISWDSRLHSPMYYLLRGLSVIDMGLSTVTLPQLLAHLVSHYPTIPAARCLAQFFFFYAFGVTDTLVIAVMALDRYVAICDPLHYALVMNHQRCACLLALSWVVSILHTMLRVGLVLPLCWTGDAGGNVNLPHFFCDHRPLLRASCSDIHSNELAIFFEGGFLMLGPCALIVLSYVRIGAAILRLPSAAGRRRAVSTCGSHLTMVGFLYGTIICVYFQPPFQNSQYQDMVASVMYTAITPLANPFVYSLHNKDVKGALCRLLEWVKVDP

SEQ ID NO: 213 - protein, 310 aa, Homo sapiens
MQQNNSVTEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGPPFLNPLIYTLRNAEVKNAMRKLWHGKIISENKG

SEQ ID NO: 214 - protein, 333 aa, Homo sapiens
MGPRNQTAVSEFLLMKVTEDPELKLIPFSLFLSMYLVTILGNLLILLAVISDSHLHTPMYFLLFNLSFTDICLTTTTVPKILVNIQAQNQSITYTGCLTQICLVLVFAGLESCFLAVMAYDRYVAICHPLRYTVLMNVHFWGLLILLSMFMSTMDALVQSLMVLQLSFCKNVEIPLFFCEVVQVIKLACSDTLINNILIYFASSVFGAIPLSGIIFSYSQIVTSVLRMPSARGKYKAFSTCGCHLSVFSLFYGTAFGVYISSAVAESSRITAVASVMYTVVPQMMNPFIYSLRNKEMKKALRKLIGWSTVARSRLTANSASRVHAILLPRPPE

SEQ ID NO: 215 - protein, 2852 aa, Homo sapiens [sequence omitted]

SEQ ID NO: 216 - protein, 773 aa, Homo sapiens
MAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 217 - protein, 426 aa, Homo sapiens
MAIAQLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQGMNIDSETKANNGEKNARQRLLDSSC

SEQ ID NO: 218 - protein, 454 aa, Homo sapiens
MYNTVWNMEDLDLEYAKTDINCGTDLMFYIEMDPPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 219 - protein, 724 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 220 - protein, 424 aa, Homo sapiens
MHNLQTLPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 221 - protein, 436 aa, Homo sapiens
MMATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 222 - protein, 1191 aa, Homo sapiens
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGESDTPGVGLVGDPGPSRAMPSGLSPGALDSDPVGLGDPLSEISKLLEAAPSGSGLPKPADCLLAQDLCWELLASGMATLPGTRDVQGRAVLLLCAHSPAWLQSECSSQELIRLLLYLRSIPRPEVQALGLTVLVDARICAPSSSLFSGLSQLQEAAPGAVYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLTAEDSEISSQCPSASGSSGSDSSCVSGQALGRGLEDLPCV

SEQ ID NO: 223 - protein, 1720 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENPDPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENSLQMMVQSGAKGSTVNTMQISCLLGQIELEGRRPPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVGLGTEEDPSLPALLTQPRKPTHSQEPQGPEAMERRVQAVREIHPFIDDYQYDTEESLWCQVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 224 - protein, 674 aa, Homo sapiens
MAPGQAPHQATPWRDAHPFFLLSPVMGLLSRAWSRLRGLGPLEPWLVEAVKGAALVEAGLEGEARTPLAIPHTPWGRRPGEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHEETGKGEAAPGPQSSAPAQRPQLKSWWCQPSDEEESEVKPLGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQSAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRIAQAQEELSPCLTPAARARAWARLRNPPLAPIPALTQTLPSSSVPSSPVQTTPLSQAVATPSRSSAAAAAALDLSGRRG

SEQ ID NO: 225 - protein, 238 aa, Homo sapiens
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 226 - protein, 281 aa, Homo sapiens
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 227 - protein, 192 aa, Homo sapiens
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 228 - protein, 260 aa, Homo sapiens
MEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 229 - protein, 260 aa, Homo sapiens; identical to SEQ ID NO: 228

SEQ ID NO: 230 - protein, 537 aa, Homo sapiens
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQGWPPPQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 231 - protein, 420 aa, Homo sapiens
MAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 232 - protein, 713 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 233 - protein, 1179 aa, Homo sapiens
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCDMLGTRMEQEGSRALTSEARLCYVCSGSVERLVECWAKCHQALSPMALQDLMEKVMVLNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQLQHLPPEKMERKELPPEHQSLKSSFEALLQRCSLSATDLKTKRKLEEAAQRLEYLYEKLCEGTLSPHVVAGLHEVARCVDAGSFEQGLAVHAQVAGCSSFSEVSSFMPILKAVLIIAHKLLV

SEQ ID NO: 234 - protein, 464 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 235 - protein, 1148 aa, Homo sapiens
MTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 236 - protein, 1099 aa, Homo sapiens
MFGSAPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPSASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 237 - protein, 407 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 238 - protein, 588 aa, Homo sapiens
MDLEESEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSETSVCSGSLDGVEYSQRKEKGIVKMTMPQTLAFCYLSLLWQREAITLSDLLRFVEEDHIPYINAFQHFPEQMKLYGRDRGIFGIESWPDYEDIYKKTIEVGTFLDLPRFPDITEDCYLHPNILCMKYLMEVNLPDEMHSLTCHVVKMTGMGEVDFLTFDPIAKMAKTVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 239 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 240 - protein, 1246 aa, Homo sapiens
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPTGGGLSAATGVTVPGLGTGTAALGLENFTLSPSPGYPQGTPAAGQAWTPEPSPRRGGSNVVGYDRNNTGKGVEQELQGNSTMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 241 - protein, 1374 aa, Homo sapiens
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPTGGGLSAATGVTVPGLGTGTAALGLENFTLSPSPGYPQGTPAAGQAWTPEPSPRRGGSNVVGYDRNNTGKGVEQEVPSTAPGLGMDQGSPSQVNPSQGSPSQGSLRQESTSQASPSQRSTSQGSPSQVNPSQGSTSHANSSQGSPSQGSPSQESPSQGSTSQASPSHRNTIGVIGTTSSPKATGSTHSFPPGATDGPLALPGQLQGNSTMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 242 - protein, 814 aa, Homo sapiens
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKRIQASILKAFNNPTTKTADDETRKKVKAYGKEGVKMNFIDRIFIGELTSTVMCEECANISTVKDPFIDISLPIIEERVSKPLLWGRMNKYRSLRETDHDRYSGNVTIENIHQPRAAKKHSSSKDKSQLIHDRKCIRKLSSGETVTYQKNENLEMNGDSLMFASLMNSESRLNESPTDDSEKEASHSESNVDADSEPSESESASKQTGLFRSSSGSGVQPDGPLYPLSAGKLLYTKETDSGDKEMAEAISELRLSSTVTGDQDFDRENQPLNISNNLCFLEGKHLRSYSPQNAFQTLSQSYITTSKECSIQSCLYQFTSMELLMGNNKLLCENCTKNKQKYQEETSFAEKKVEGVYTNARKQLLISAVPAVLILHLKRFHQAGLSLRKVNRHVDFPLMLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 243 - protein, 230 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDVNLP

SEQ ID NO: 244 - protein, 277 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDRVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 245 - protein, 277 aa, Homo sapiens; identical to SEQ ID NO: 244

SEQ ID NO: 246 - protein, 525 aa, Homo sapiens [sequence omitted]

SEQ ID NO: 247 - protein, 122 aa, Homo sapiens
  VARIANT (1)...(122): Xaa = Any Amino Acid
MSPIFTCITILCLLAAGSPGEEVAQTPKHLVRGEGQKAKLYCAPIKGHSYVFWYQQVLKNEFKFLISFQNENVFDETGMPKERFSAKCLPNSPCSLEIQATKLEDSAVYFCASSQSTVLNIX

SEQ ID NO: 248 - protein, 871 aa, Homo sapiens [sequence omitted]

SEQ ID NO: 249 - protein, 79 aa, Homo sapiens
  VARIANT (1)...(79): Xaa = Any Amino Acid
MAAAAHPEWLLPTYGLQWGGTASPPTPQSRQESRPWAPGLLLQGTSASPAPSELAGQELLMGSCSHPSPAVDLGISVLX

SEQ ID NO: 250 - protein, 187 aa, Homo sapiens
DKGLPSPTSRSLTLSPKKLPTCVLTPGPEDRSPSGRLKESPTFQGTWELWPSGSWRAAGRAQLSETRVASQKEVPPLRRHRCSRTPGCQSCQGKKASEGNPLFVGHSALQCQVRSRGESWLELLWNVQGGLRQARLCLQAGQQASPRAPPAPLAEEGPHEAGAHDSCPAGICRACRDLQLLRDRVLP

SEQ ID NO: 251 - DNA, 201 bp, Homo sapiens
cctgttggatatggaaaccacctacagcgtggccactgtgtgccacccgaatggcagctgcctgcagctcgagccagatctgacgaatgtgatggccacgrcccggaaatatgaagacctgttatgggcatgggagggctggcgagacaaggcggggagagccatcctccagttttacccgaaatacgtggaactcatcaa

SEQ ID NO: 252 - DNA, 201 bp, Homo sapiens; identical to SEQ ID NO: 251

SEQ ID NO: 253 - DNA, 201 bp, Homo sapiens
agccctcaaagagaggatgattcattccgtgatgccaagaatcatagccgatgacttaatgaagcagggagatgaggagagtgagaattctgtcaagaggratgccacctcgagccccaagaacaggaagaaaaagtcttccatccaaaaagctcctatagccttccgcccttttaagatgcagcagatcgaagaagtcag

SEQ ID NO: 254 - DNA, 201 bp, Homo sapiens
tttgaggttgagtgacatgttcgaaacctgtccataaagtaattttgtgaaagaaggagcaagagaacattcctctgcagcacttcactaccaaatgagcmttagctacttttcagaattgaaggagaaaatgcattatgtggactgaaccgacttttctaaagctctgaacaaaagcttttctttccttttgcaacaaga

SEQ ID NO: 255 - DNA, 201 bp, Homo sapiens; identical to SEQ ID NO: 254

SEQ ID NO: 256 - DNA, 201 bp, Homo sapiens; identical to SEQ ID NO: 254

SEQ ID NO: 257 - DNA, 201 bp, Homo sapiens; identical to SEQ ID NO: 254

SEQ ID NO: 258 - DNA, 201 bp, Homo sapiens; identical to SEQ ID NO: 254

SEQ ID NO: 259 - DNA, 201 bp, Homo sapiens
agaggaggtcacgcaaggtccacactcattccagggaacaagtaccatgactgaagggctagagcccggtggatctcaggagtacgagaaggtcctggtgrctgtaagtgagcacacgtggacagaacagcccgaggctgagagctcccaggccgacagggaccggaggcagcaaggccaagaagagcaggtgcaggaggc

SEQ ID NO: 260 - DNA, 201 bp, Homo sapiens; identical to SEQ ID NO: 259

SEQ ID NO: 261 - DNA, 201 bp, Homo sapiens; identical to SEQ ID NO: 259

SEQ ID NO: 262 - DNA, 201 bp, Homo sapiens; identical to SEQ ID NO: 259

SEQ ID NO: 263 - DNA, 201 bp, Homo sapiens
tttataacctattcctaatcaaacccaattatatcagaatacctttctgaatttgagatttttgctctacattttataatgaataaggctattttttgaargtatttcattttgaattctgtcattaacctcaaaagctttctactgctttgcggtgaaggcaaaatattcgataactcaacttaggccccactgttcccc

SEQ ID NO: 264 - DNA, 201 bp, Homo sapiens
tgataaagtttctttcttctgcaaaaataaggaaaagaagtgtagctatacagaggatgctcagtgtatagatggcactatcgaagtccccaaatgcttcsaggaacacagttctctggctttttggaaaactgatgcatccgatgtaaagccatgctaaggtggttttcagattccacacaaaatgtcacacttgtttct

SEQ ID NO: 265 - DNA, 201 bp, Homo sapiens
ttttattttaaagtagaaatctgtccgcttttcacttacggaggccttacagtgtgtgttctgtgttacttgagtttatacgcactgcagaatttgtttaycctgctcttttggaaacgtattccggaagcgaaaccctgagtaatcggaagtggttaggagtgagagagctgctggatatgcggagggactgggcgggtc

SEQ ID NO: 266 - DNA, 201 bp, Homo sapiens
cgcctggggaggccacaggacacagggtcaccatggggacagccgccctgggtcccgtctgggcagcgctcctgctctttctcctgatgtgtgagatcccsatggtggagctcacctttgacagagctgtggccagcggctgccaacggtgctgtgactctgaggaccccctggatcctgcccatgtatcctcagcctctt

SEQ ID NO: 267 - DNA, 201 bp, Homo sapiens; identical to SEQ ID NO: 266

SEQ ID NO: 268 - DNA, 201 bp, Homo sapiens
agaatcaagaaccggtgaatgataaaagggagcgaaaacttaagttcaaggaccagttagttgatttggaagttcctccactagaagacactactactttyaaaaattattttgaaaacgaaaggaatatgtttgggaaactgtcacaattatgtatttccaatgattttggacaagaagatgtgctcctgtcacttacta

SEQ ID NO: 269 - DNA, 201 bp, Homo sapiens
tacacaggcaaatatccaagctaccctgattcgcagcagactgagaaaagttcccaggtttaaaaccatgttcagtaacctgatccattatccaagatatyctctatattggagcaagtcagatcctgtcccaccatttatcagtcgggaatggaagggacataaggagaaacacagagaagccctccggcagctcaccac

SEQ ID NO: 270 - DNA, 201 bp, Homo sapiens
gtgtgttcatgcaacagccatagagatggtgctattgaaaggcaatctgcccatcctgtgtattgacaagcatcaggattccaggaggattcttcctgatkcaaagactgtcaaataggaaaaaagaaaacagtaaatgaacaaaaacatcaacatggagtccaagtaatgaatttatagaggaaaatgtatgctactctg

SEQ ID NO: 271 - DNA, 201 bp, Homo sapiens
aagaggcagttgaaaaagagtacatgaaacagttggtcaaactgacaagattactatttaatctctcagaagtaaagagtattttctcaaaggcccaagtygaatatttatccatctcagaagaccctaaaaaagcacttgttcgattctttgaggctgttggtgtaacttacgggaacgtccagacactttctgataaat

SEQ ID NO: 272 - DNA, 201 bp, Homo sapiens
ttgacgttgcctctcggcggcgcggcggcggtggacgagtacctggagtaccggaggtataaacaacataaaactgacttggaagcgattcctcagcagtyccccattgatctgccctgccaagtgactggctgccagtgcagggcttacctttatgtccccttgaatggtagccagcccattcgctgcaggtgcaaacac

SEQ ID NO: 273 - DNA, 201 bp, Homo sapiens
ccggcaatggagcggttgacgttgcctctcggcggcgcggcggcggtggacgagtacctggagtaccggaggtataaacaacataaaactgacttggaagrgattcctcagcagtgccccattgatctgccctgccaagtgactggctgccagtgcagggcttacctttatgtccccttgaatggtagccagcccattcgc

SEQ ID NO: 274 - DNA, 201 bp, Homo sapiens
acagggatggattgtaaacttgtgggcccagagacactgtgtttttgtacacataggtataaacaacataaaactgacttggaagcgattcctcagcagtyccccattgatctgccctgccaagtgactggctgccagtgcagggcttacctttatgtccccttgaatggtagccagcccattcgctgcaggtgcaaacac

SEQ ID NO: 275 - DNA, 201 bp, Homo sapiens
agctggcggtcaccaacagggatggattgtaaacttgtgggcccagagacactgtgtttttgtacacataggtataaacaacataaaactgacttggaagrgattcctcagcagtgccccattgatctgccctgccaagtgactggctgccagtgcagggcttacctttatgtccccttgaatggtagccagcccattcgc

SEQ ID NO: 276 - DNA, 201 bp, Homo sapiens; identical to SEQ ID NO: 272

SEQ ID NO: 277 - DNA, 201 bp, Homo sapiens; identical to SEQ ID NO: 273

SEQ ID NO: 278 - DNA, 201 bp, Homo sapiens; identical to SEQ ID NO: 274

SEQ ID NO: 279 - DNA, 201 bp, Homo sapiens; identical to SEQ ID NO: 275

SEQ ID NO: 280 - DNA, 201 bp, Homo sapiens
agtgtaaaaaaagacaaccacaaaaaaaaaacagttaagatgttggaatacctgggcaaagatgttcttcatggtgtttttaattatttggcaaaacacgrtgttctgacattgaaggaagaggaaaagaaaaaatattatgataccaaaattgaagacaaggccctgatcttggtagactctttgcgaaagaatcgcgtg

SEQ ID NO: 281 - DNA, 201 bp, Homo sapiens
gaggagggggcagaggctgcagataaccagagggaagaggctgcagataatcagagggcagaggccccagctgaccagaggtcacagggcacagataaccycagggaagaggctgcagataatcagagggcggaggccccagctgaccaggggtcagaggttacagataatcaaagggaagaggccgtacatgaccagagg

SEQ ID NO: 282 - DNA, 201 bp, Homo sapiens
ggtggggtccagctctgtggaggcggctccacgggctccaagggaccctgctctccctccagttctcgagtccccagcagttctagcatttccagcagctkcggtttaccctaccatccctgcggcagtgcttcccagagcccctgctccccaccaggcaccggctccttcagcagcagctccagttcccaatccagtggc

SEQ ID NO: 283 - DNA, 190 bp, Homo sapiens
agtacattgaaattcaaagtcatgcttgtaactgttaatgaaagcagatttaaagcaacaccaccatcactggagtatttttagttatayacgattgagactaccaagcatgttgctcttattcagtgtaatcctaatctcatgggtatccactgttgggggagaaggaacactttgtgattttccaaaa

SEQ ID NO: 284 - DNA, 201 bp, Homo sapiens
tggtgtcttggtgatctcacataaccaagatgctaccccgtggggaaccacatccccctggatgccctccagccttggtttgggctggagtcagggcctgkatacagtattttgaatttgtatgccactggtttgcattgctggtcaggaactctagtgctttgcatagccctggtttagaaacatgttatagcagttctt

SEQ ID NO: 285 - DNA, 201 bp, Homo sapiens; identical to SEQ ID NO: 284

SEQ ID NO: 286 - DNA, 201 bp, Homo sapiens; identical to SEQ ID NO: 284

SEQ ID NO: 287 - DNA, 201 bp, Homo sapiens; identical to SEQ ID NO: 284

SEQ ID NO: 288 - DNA, 201 bp, Homo sapiens; identical to SEQ ID NO: 284

SEQ ID NO: 289 - DNA, 201 bp, Homo sapiens
accacatgcacgtgttcgaccgaccctaccctctggctcccccgactccgcctccccgtatcgacgcgctgggctctggagcccctacaagccagagacgrtatcggaactggaacccaccactgctgggcaaccttccggatgactttctccgcatcctgccccagcagctggacagcatacagggtaacgctgggggcc

SEQ ID NO: 290 - DNA, 201 bp, Homo sapiens
tccacaaggcaagagataacacaaagtcaaggtgaagatcagggtagccctttaaaaggcctccttgtgccctagagttgccacagctcttctactccacygctgtctatcttgcctgccggcacccagccaccatgtgggagctcgtggctctcttgctgcttaccctagcttatttgttttggcccaagagaaggtgcc

SEQ ID NO: 291 - DNA, 201 bp, Homo sapiens
gtccctgcccctggtgggcagcctgccattcctccccagacacggccatatgcataacaacttcttcaagctgcagaaaaaatatggccccatctattcgkttcgtatgggcaccaagactacagtgattgtcggccaccaccagctggccaaggaggtgcttattaagaagggcaaggacttctctgggcggcctcaaat

SEQ ID NO: 292 - DNA, 201 bp, Homo sapiens
ttatttgttttggcccaagagaaggtgccctggtgccaagtaccccaagagcctcctgtccctgcccctggtgggcagcctgccattcctccccagacacygccatatgcataacaacttcttcaagctgcagaaaaaatatggccccatctattcggttcgtatgggcaccaagactacagtgattgtcggccaccacca

SEQ ID NO: 293 - DNA, 201 bp, Homo sapiens
acatgttcttaaagggtcatgaaacttactcatattatgggcctctgaatttacttaccttcaatgtgggttatcataatgaacatcatgatttccccaarattcctggaaaaagtcttccactggtgaggaaaatagcagctgaatactatgacaacctccctcactacaattcctggataaaagtactgtatgattttg

SEQ ID NO: 294 - DNA, 201 bp, Homo sapiens; identical to SEQ ID NO: 293

SEQ ID NO: 295 - DNA, 201 bp, Homo sapiens
gacagacattatcggtctgctcgggtagagactccatcccatccgggtggtgtgagcgaagagttttgggaacgcagtcggcagagagagcgggagcggcmggaacatggtgtctatgcctcgtccaaagaagaaaaggattggaagaaggagaaatcgcgggatcgagactatgaccgcaagagggacagagatgagcgg

SEQ ID NO: 296 - DNA, 187 bp, Homo sapiens
ctgggagcgcggcgtaggtggctgccgagtcttttcctgtttagggtcttatcctggcattgagggcgccggactggcgcttttggrcggcttggcattgggtgggcggcttcttgggacccacatgagccagtggcatcatccccgcagtggctggggccggagacgcgacttttcaggacgctcc

SEQ ID NO: 297 - DNA, 201 bp, Homo sapiens
caggcaaagaccagcaggaagaagaaatttgggaaaaaaaacaaggaccagggaggtctcacccaggcacagtacattgactgcttccagaagatcaagcycagcttcaacctcctgggaaggctggccacctggctgaaggagacaagtgcccctgagctcgtacacatcctcttcaagtccctgaacttcatcctggcc

SEQ ID NO: 298 - DNA, 201 bp, Homo sapiens; identical to SEQ ID NO: 297

SEQ ID NO: 299 - DNA, 201 bp, Homo sapiens; identical to SEQ ID NO: 297

SEQ ID NO: 300 - DNA, 201 bp, Homo sapiens
tgtttgagcattcagtctctttgtttttgatcacgcttctatggagtccaagaattaccataaggcaatatttctgaagattactatataggcagatatascagaaaataaccaagtagtggcagtggggatcaggcagaagaactggtaaaagaagccaccataaatagatttgttcgatgaaagatgaaaactggaaga

SEQ ID NO: 301 - DNA, 201 bp, Homo sapiens
ctccagagccaaggtgcttcaaaaaatgcactaagcctgacctgagtaatggttacatctctgatgtaaagttattgtataaaattcaagagaacatgcgrtatggttgcgcttcagggtacaaaaccactggagggaaggatgaagaagtggttcaatgtctctctgatggatggtcttctcaaccaacctgtaggaaag

SEQ ID NO: 302 - DNA, 107 bp, Homo sapiens
gtagggggccactcatattctgggctcctggaaccaatcccgtgaaagaattatttttgtgtttctaaaactatggttcccaataaaagtgactctcagcragcctc

SEQ ID NO: 303 - DNA, 107 bp, Homo sapiens; identical to SEQ ID NO: 302

SEQ ID NO: 304 - DNA, 102 bp, Homo sapiens
gtagggggccactcatattctgggctcctggaaccaatcccgtgaaagaattatttttgtgtttctaaaactatggttcccaataaaagtgactctcagcra

SEQ ID NO: 305 - DNA, 201 bp, Homo sapiens
ctgaagaccctatagaggatcctctacagccagatgtcacagggatacgtctactttcacttggtgctggagaattcaaaagtcaagaacatgctaagcaraagggacccaaggtagaaagagatcaagcagcaaagcacaggttctcctggatgaaattactagcacataaagttgggagacacctaagccaagacactg

SEQ ID NO: 306 - DNA, 201 bp, Homo sapiens
tttagaacctgaagatgaagagagtgatgctgactatgattaccagaacagactggctgcagcattaggaatcaggtcattccgaaactcatcattgaatyaggaagaagaagagttcaatcttactgccctagctctggagaatggcactgaattcgtttcttcaaacacagatataattgttggttcaaattattcttc

SEQ ID NO: 307 - DNA, 201 bp, Homo sapiens
catggctacacggaaaatgcatgatcgtttagaacctgaagatgaagagagtgatgctgactatgattaccagaacagactggctgcagcattaggaatcyggtcattccgaaactcatcattgaatcaggaagaagaagagttcaatcttactgccctagctctggagaatggcactgaattcgtttcttcaaacacaga

SEQ ID NO: 308 - DNA, 201 bp, Homo sapiens
cagagcattccagcccatattctgaagaccctatagaggatcctctacagccagatgtcacagggatacgtctactttcacttggtgctggagaattcaaragtcaagaacatgctaagcataagggacccaaggtagaaagagatcaagcagcaaagcacaggttctcctggatgaaattactagcacataaagttggga

SEQ ID NO: 309 - DNA, 201 bp, Homo sapiens
taacaagaccatactacagtgacgtggacatcatgagagacatcgcctctgggctaataggactacttctaatctgtaagagcagatccctggacaggcgrggaatacagagggcagcagacatcgaacagcaggctgtgtttgctgtgtttgatgagaacaaaagctggtaccttgaggacaacatcaacaagttttgtg

SEQ ID NO: 310 - DNA, 201 bp, Homo sapiens
tgcgagcagttttgtaaaaatagtgctgataacaaggtggtttgctcctgtactgagggatatcgactttcacaaacttctaagctcacccgtgctgagartgtttttcctgatgtggactatgtaaattctactgaagctgaaaccattttggataacatcactcaaagcacccaatcatttaatgacttcactcgggtt

SEQ ID NO: 311 - DNA, 201 bp, Homo sapiens
tatcgacttgcagaaaaccagaagtcctgtgaaccagcagtgccatttccatgtggaagagtttctgtttcacaaacttctaagctcacccgtgctgagartgtttttcctgatgtggactatgtaaattctactgaagctgaaaccattttggataacatcactcaaagcacccaatcatttaatgacttcactcgggtt

SEQ ID NO: 312 - DNA, 201 bp, Homo sapiens; identical to SEQ ID NO: 311

SEQ ID NO: 313 - DNA, 201 bp, Homo sapiens
gggagctctggacctggaagtactggaaaccgaaaccctgggagctctgggactggagggactgcaacctggaaacctgggagctctggacctggaagtartggaagctggaactctgggagctctggaactggaagtactggaaaccaaaaccctgggagccctagacctggtagtaccggaacctggaatcctggcagc

SEQ ID NO: 314 - DNA, 101 bp, Homo sapiens
rgcaatcctttctttcagctggagtgctcctcaggagccagccccacccttagaaaagatgttttccatgaggatcgtctgcctggtcctaagtgtggtgg

SEQ ID NO: 315 - DNA, 201 bp, Homo sapiens; identical to SEQ ID NO: 313

SEQ ID NO: 316 - DNA, 101 bp, Homo sapiens; identical to SEQ ID NO: 314

SEQ ID NO: 317 - DNA, 201 bp, Homo sapiens
ccacctggggggagccaaacaggtcagaccagagcaccctgcggaaacagaatatgactcactttaccctgaggatgatttgtagaaaattaactgctaayttctattgacccacaaagtttcagaaattctctgaaagtttcttccttttttctcttactatatttattgatttcaagtcttctattaaggacatttagc

SEQ ID NO: 318 - DNA, 201 bp, Homo sapiens
tgaaccttcaggtgcaggcagttttgcagcgcaaagaagaggaggatcgccagatgaagcatcttgtccaggccctgcaggcctcactagagaaggagaargagaaggtgaacagcctcaaggagcaggtggctgctgccaaggtggaagccgggcataaccgccgccacttcaaggcggcctccttggagctgagtgagg

SEQ ID NO: 319 - DNA, 201 bp, Homo sapiens
ggaacctctgtgacccccagccggttaccaacagaaccaccttccccggtagcagaattctcagaagccaccgctgaactgaccgtctcattcacaaacgragtcttcacaactgagacttctaggagtatcaccgccagtccaaaggagtcagactctccagctggtgagtcctgcccgccagtactacaccaagggcaa

SEQ ID NO: 320 - DNA, 201 bp, Homo sapiens
agggacccatacctgtggtcagcccccagcgaccccctggagcttgtggtcacaggaacctctgtgacccccagccggttaccaacagaaccaccttcccyggtagcagaattctcagaagccaccgctgaactgaccgtctcattcacaaacgaagtcttcacaactgagacttctaggagtatcaccgccagtccaaag

SEQ ID NO: 321 - DNA, 201 bp, Homo sapiens
ggaacctctgtgacccccagccggttaccaacagaaccaccttccccggtagcagaattctcagaagccaccgctgaactgaccgtctcattcacaaacgragtcttcacaactgagacttctaggagtatcaccgccagtccaaaggagtcagactctccagctggtcctgcccgccagtactacaccaagggcaacctg

SEQ ID NO: 322 - DNA, 201 bp, Homo sapiens; identical to SEQ ID NO: 320

SEQ ID NO: 323 - DNA, 201 bp, Homo sapiens
gagcagagcatgcagtgatggaagaagcaggaaaagcaagaagaaaagacagcagcatcaagaggaggaggacatcttggatgtaagggatgagaaggatrgcggggctagggaagcagagagcagagcacacactggctcaagcagcagaggtaagaggaagaggcagcagcatcccaagaaggaaagagctggagtcag

SEQ ID NO: 324 - DNA, 201 bp, Homo sapiens; identical to SEQ ID NO: 323

SEQ ID NO: 325 - DNA, 201 bp, Homo sapiens
taatcctcaggtataaaacacagaaaaaggagaatgggcatggctgagaatgtcaactcttagtctattctttggttggattcactgaataggagacactstgaaagatatctttatattccatcttttataattcttgaacagtgctttcttagctaaccaccaaagtttctaggtgaacagcttctagaaaaagttaga

SEQ ID NO: 326 - DNA, 201 bp, Homo sapiens
caggaggggaaaagtgctaattaccatgacaagaacattgtattacttaaaaacaaggcagtgctaatgcctaatggtgctacagtttctgcctcttccgrggaacacacacatggtgaactcctggaaaaaacactgtctcaatattatccagattgtgtttccattgcggtgcagaaaaccacatctcacataaatgcc

SEQ ID NO: 327 - DNA, 201 bp, Homo sapiens
cttgccatcgagacatttataaaggagttgatatgagaggagtcaattttaatgtgtctaaggttagcagtgttgaagaatgccaaaaaaggtgcaccagraacattcgctgccagtttttttcatatgccacgcaaacatttcacaaggcagagtaccggaacaattgcctattaaagtacagtcccggaggaacaccta

SEQ ID NO: 328 - DNA, 201 bp, Homo sapiens
agaaaggtgaaatccaaaatattctacaaaaggtaaatattcctttggtaacaaatgaagaatgccagaaaagatatcaagattataaaataacccaacgratggtctgtgctggctataaagaagggggaaaagatgcttgtaagggagattcaggtggtcccttagtttgcaaacacaatggaatgtggcgtttggtgg

SEQ ID NO: 329 - DNA, 201 bp, Homo sapiens
gcaatttttacaacctgagttcaagtcaaattctgagcctggggggtcctcatctgcaaagcatggagagtggcatcttctttgcatcctaaggacgaaaracacagtgcactcagagctgctgaggacaatgtctggctgaagcccgctttcagcacgccgtaaccaggggctgacaatgcgaggtcgcaactgagatct

SEQ ID NO: 330 - DNA, 110 bp, Homo sapiens
gtccacagagagatgaaacagctgcaaccgcttctccctcaaggtgggatcatcaacgggcagagctcctactgtgcccaccaccttctcttcagattcasccacccaga

SEQ ID NO: 331 - DNA, 201 bp, Homo sapiens
cttcccaagcccagcaggaggctccagttcagtttccagaggaggtggaaccttctgcaacccaacagtaggccccaaccgagcctccatgtcatcctacrgagcgtgaactttccattagtgagcaggagcagccagctcagccttctgagtcttctggggaggttgaatcttctcagactcggcaggagaccccagctc

SEQ ID NO: 332 - DNA, 201 bp, Homo sapiens
ggaggggctgacgcgcccgcgtggactcgcacagcaagatcctggacgcccgggatgtggatcagcgcaagcaccaccttcgagaagtctctgcggatcgrcagggagtttcagcaccgcgccaaaggccggatgctgagggtagctgtgctgcgcaaccagatccacgtgaaatcccttccagagaagggagcccgggga

SEQ ID NO: 333 - DNA, 201 bp, Homo sapiens
acgcagcaagtccgggaggggctgacgcgcccgccaagatcctggacgcccgggatgtggatcagcgcaagcaccaccttcgagaagtctctgcggatcgrcagggagtttcagcaccgcgccaaaggccggatgctgagggtagctgtgctgcgcaaccagatccacgtgaaatcccttccagagaagggagcccgggga

SEQ ID NO: 334 - DNA, 201 bp, Homo sapiens
aatcttcaaggcagcaaatggtcccagttcagcttccagagccacctaaggaagttgcagctcaacctccagctcattatgaggtgacagtcccaacactyggccaggatccagctcagaattcaacattgcccagtgtcactgttcaacctttggacctgggacttaccatcattccagaatcaacgacagaggttgaac

SEQ ID NO: 335 - DNA, 201 bp, Homo sapiens
aacaggagggcagcaaaagcttctcacatgggggtgagtacagacagtgggactcaggagacaaagaaaactgaagaccggtttgtacccagctcctccamgagcgaagggaagaagtctagggagcagccctcagtgctgagtcgctaccccccggctgctcaggagcacagtaaagcgtggaaggggacttccaagcca

SEQ ID NO: 336 - DNA, 201 bp, Homo sapiens
ggatttggctagattcaaaccaatgcagcgacaccttttcttgtatgaaaaagccattgttttttgcaaaaggcgtgttgaaagtggagaaggctctgacygatacccgtcatacagttttaaacactgttggaaaatggatgaagttggaatcactgaatatgtaaaaggtgataaccgcaagtttgaaatctggtatgg

SEQ ID NO: 337 - DNA, 201 bp, Homo sapiens; identical to SEQ ID NO: 336

SEQ ID NO: 338 - DNA, 201 bp, Homo sapiens; identical to SEQ ID NO: 336

SEQ ID NO: 339 - DNA, 201 bp, Homo sapiens
acccttgggctttgatgagatggaagtggagatccaaactgttaaaacagaggaagaccaagaccccagaacagacaaagcccataaggagacagaaaatkagaaaccagaaagaagccgagagtctaccattcatacagctcatcaattcctcatggacacgatcttccagccctttttaaaagatgtcaatgagctaag

SEQ ID NO: 340 - DNA, 201 bp, Homo sapiens
agctgggctggatggacgaggagtccaagaagaaggcgcaggagaaggccatgagcatccgggagcagatcgggcaccctgactacatcctggaggagatyaacaggcgcctggacgaggagtactccaatctgaacttctcagaggacctgtactttgagaacagtctgcagaacctcaaggtgggcgcccagcggagcc

SEQ ID NO: 341 - DNA, 201 bp, Homo sapiens
acaggaggagaggacctttgtaaaacgaaaaccccgagggatcccagaggcccaagaggtgagcgaggtctgcaccacccctggctgcgtgatagcagccyccaggatcctccagaacatggacccgaccacggaaccgtgtgacgacttctaccagtttgcatgcggaggctggctgcggcgccacgtgatccctgagac

SEQ ID NO: 342 - DNA, 201 bp, Homo sapiens
actttgacatctgtgtggcaggttaccccaaaggccaccccgaagcagggagctttgaggctgacctgaagcacttgaaggagaaggtgtctgcgggagcygatttcatcatcacgcagcttttctttgaggctgacacattcttccgctttgtgaaggcatgcaccgacatgggcatcacttgccccatcgtccccggga

SEQ ID NO: 343 - DNA, 201 bp, Homo sapiens
ggccgcatggctctcaacctccagctttcagacactgatgacaatgaaacgtttgatgagctgcacatagagagcagtgatgagaaaagtccttcagacgrgtcattggctgccgacaccgataagtccgtggagaacctggatgtccttgtggggtttggaaaatctctatgtgggtctcctgaagaggaggaaaaacaa

SEQ ID NO: 344 - DNA, 201 bp, Homo sapiens
aaaaaccctggacgcggtatgtagacatagcattgcgcacagacatgtctgacatcaccaaatcctacctgagtgagtgtggctcctgcttctgggtgggsgaatctgaagagaaggtggtgggcacagtaggagctctgcccgttgatgatcccaccttgagggagaagcggttgcagctgtttcatctctctgtggaca

SEQ ID NO: 345 - DNA, 201 bp, Homo sapiens
ggccacacctgggacattggggacgtacagaagctgctttccggagtagaaagactcaggaaccccgacctgatccaagcaggctactactcctttggccycgctaacgagaagagagccaaggagttggaggccacttttggctgccggatgtcaccggacatcaaacaggaattgctgcgatgcgacataagttgtaag

SEQ ID NO: 346 - DNA, 201 bp, Homo sapiens
ctgggtcagaatcccttggggtctagtggagtgaagatgctgtttgaaaccttgacatgttccagtggcaccctccggacactcaggttgaaaatagatgmctttaatgatgaactcaataagctgctggaagaaatagaagaaaaaaacccacaactgattattgatactgagaaacatcatccctgggcagaaaggcct

SEQ ID NO: 347 - DNA, 201 bp, Homo sapiens
ggctgccggatgtcaccggacatcaaacaggaattgctgcgatgcgacataagttgtaagggtggacattcaacggtgacagacctgcaggagctcctcgsctgtctgtacgagtctcaggaggaggagctggtgaaggaggtgatggctcagttcaaagaaatatccctgcacttaaatgcagtagacgttgtgccatct

SEQ ID NO: 348 - DNA, 201 bp, Homo sapiens
aagcactgcctttacttcagtgggaatctcggcctcagcctgcaagccaagtgttcacagtgagaaaagcaagagaataagctaatactcctgtcctgaamaaggcagcggctccttggtaaagctactccttgatcgatcctttgcaccggattgttcaaagtggaccccaggggagaagtcggagcaaagaacttacca

SEQ ID NO: 349 - DNA, 201 bp, Homo sapiens
gcaggccccagatatagccccatgctgtcctcctaccccagagcacactgttcaggctacttccactggtactgaaatccagtatttcacttactcttttyctttccaatatcctcatgacattcaatatttcacttactctaggtcctccctgcctaaggcccaagtcaactttctgtccagtgggatttgtaatccaat

SEQ ID NO: 350 - DNA, 201 bp, Homo sapiens
gtacttcaaaataataacaacttaagtcaataaataaatgtaaggaagtccaaatgttcacctgaagacaactgtggtcattttttggcaatcccaggttytcttttctacctgtttgctcaatcgtggtctccctctccctctcttgttggggcccatgcccctgctttactgttgccagaggcttgtacttgtttgcct

SEQ ID NO: 351 - DNA, 201 bp, Homo sapiens; identical to SEQ ID NO: 348

SEQ ID NO: 352 - DNA, 201 bp, Homo sapiens; identical to SEQ ID NO: 349

SEQ ID NO: 353 - DNA, 201 bp, Homo sapiens; identical to SEQ ID NO: 350

SEQ ID NO: 354 - DNA, 201 bp, Homo sapiens
agcggctcctctgccagagttgatattcactgatggactccaaagaatcattaactcctggtagagaagaaaaccccagcagtgtgcttgctcaggagagrggagatgtgatggacttctataaaaccctaagaggaggagctactgtgaaggtttctgcgtcttcaccctcactggctgtcgcttctcaatcagactcca

SEQ ID NO: 355 - DNA, 201 bp, Homo sapiens
gaatagaaacagaaagaggttgatattcactgatggactccaaagaatcattaactcctggtagagaagaaaaccccagcagtgtgcttgctcaggagagrggagatgtgatggacttctataaaaccctaagaggaggagctactgtgaaggtttctgcgtcttcaccctcactggctgtcgcttctcaatcagactcca

SEQ ID NO: 356 - DNA, 201 bp, Homo sapiens
aatcactggaccttagaagttgatattcactgatggactccaaagaatcattaactcctggtagagaagaaaaccccagcagtgtgcttgctcaggagagrggagatgtgatggacttctataaaaccctaagaggaggagctactgtgaaggtttctgcgtcttcaccctcactggctgtcgcttctcaatcagactcca

SEQ ID NO: 357 - DNA, 201 bp, Homo sapiens
gactccccccgggcccaaattgatattcactgatggactccaaagaatcattaactcctggtagagaagaaaaccccagcagtgtgcttgctcaggagagrggagatgtgatggacttctataaaaccctaagaggaggagctactgtgaaggtttctgcgtcttcaccctcactggctgtcgcttctcaatcagactcca

SEQ ID NO: 358 - DNA, 201 bp, Homo sapiens
aaagtgtctgagaaggaagttgatattcactgatggactccaaagaatcattaactcctggtagagaagaaaaccccagcagtgtgcttgctcaggagagrggagatgtgatggacttctataaaaccctaagaggaggagctactgtgaaggtttctgcgtcttcaccctcactggctgtcgcttctcaatcagactcca

SEQ ID NO: 359 - DNA, 201 bp, Homo sapiens; identical to SEQ ID NO: 354

SEQ ID NO: 360 - DNA, 201 bp, Homo sapiens; identical to SEQ ID NO: 354

SEQ ID NO: 361 - DNA, 201 bp, Homo sapiens
tcattgctgtcatggctctggatcgctatgtggccatctgtgaccccctgcactatgctttggtaatgaatcaccaacggtgtgcctgcttactagccttyagctgggtggtgtccatactgcacaccatgttgcgtgtgggactcgtcctgcctctttgctggactggggatgctgggggcaacgttaaccttcctcact

SEQ ID NO: 362 - DNA, 123 bp, Homo sapiens
atgcagcaaaataacagtgtgamtgaattcatactgttaggattaacacaggatcccttgaggcagaaaatagtgtttgtaatcttcttaattttctatatgggaactgtggtggggaatatg

SEQ ID NO: 363 - DNA, 201 bp, Homo sapiens
tggcttggaaagttgctttcttgcagtcatggcctacgaccgctatgtggccatttgccacccactgaggtacacagtcctcatgaatgtccatttctggsgcttgctgattcttctctccatgttcatgagcactatggatgccctggttcagagtctgatggtattgcagctgtccttctgcaaaaacgttgaaatccc

SEQ ID NO: 364 - DNA, 201 bp, Homo sapiens
gcaggccaggtcttcgtgaactgcagcgacctgcacacggacctggagctgagcagggagaggacgtgtgagcagcaactgctgaacctgagcgtgtcagrccgtggcccctgcctctcgggctgcgcctgtccccagggtctgctcagacacggggatgcatgtttcctgccagaggagtgcccctgcacttggaagggg

SEQ ID NO: 365 - DNA, 201 bp, Homo sapiens
tgaacgagttcaacttcccggatccctactccaaagtgaagcagcgggagaatggcgtggcgctgaggtgcttccccggggtcgtgcgctccctggacgcyctgggctgggaggaacggcagctggcgctggtgaaaggcctcctggcggggaatgtcttcgactggggggccaaagccgtgtctgctgtccttgaatccg

SEQ ID NO: 366 - DNA, 201 bp, Homo sapiens
gccggtgactgggtgaaggcgccgcgcagctttcccgacgccggctgtacccggacctcctggtcgagcctggcgcgccgcagccatggccatcgctcaamtggccacggagtacgtgttctcggatttcttgctgaaggagcccacggagcccaagttcaaggggctgcgactggagctggctgtggacaagatggtcac

SEQ ID NO: 367 - DNA, 201 bp, Homo sapiens
gccttatttttgcatctcacaaacataagtgcaatagatcttttcattgaacagcaaagtaggattcatcattccatatgacttgagttacaccagacctrttctgcccaatgcctttttgattacagtgtagcttgcccaccgcatttgtcgttttagatactttgctagccggccactttggatttcatcagacagtcc

SEQ ID NO: 368 - DNA, 201 bp, Homo sapiens; identical to SEQ ID NO: 367

SEQ ID NO: 369 - DNA, 201 bp, Homo sapiens; identical to SEQ ID NO: 367

SEQ ID NO: 370 - DNA, 201 bp, Homo sapiens
ggacattttaagctagtgaagagttttttctggaattgatttttcccaaaagaatatattaattgaggttaagaagtcagtgggaaacacacagaaatttrttttaaaatctttcaggagctttactgaaagacttggttatcaagtcttttggggagagaatgacattttttttttgagacagagttttgctcttgttgc

SEQ ID NO: 371 - DNA, 201 bp, Homo sapiens
tggaggcttgcacccggcacccaccacgagtggcctatgccttcctgcgccatagggtgcagtttgggatgtacgcgctctacagcaagaataagcctcgrtccgatgccctgatgtcaagctatgggcacaccttcttcaaggacaagcagcaagcactgggggaccacctggacctggcctcctacctgctaaagccca

SEQ ID NO: 372 - DNA, 201 bp, Homo sapiens
agaggactgtgccgccctgttcttggccgtccacgtttcctctccctctagcaccagcaatacatttccctggcatggacagaaaagacagagaggacttrtacaaaggctttgtaaaaccagaggctagcttctatctttgtctactgttatttcagctcagggcgggtaattaacatcattggaactagctattaggaa

SEQ ID NO: 373 - DNA, 201 bp, Homo sapiens
aaaaggcacacaaagaaactgggaaaggagaagctgccccagggccgcaatcctcagccccagcccagaggccccagctcaagtcctggtggtgccaaccsagtgatgaagaggagggtgaggtcaaggctttgggggcagctgagaaggatggagaagctgagtgtcctccctgcatccccccaccaagtgccttcctga

SEQ ID NO: 374 - DNA, 201 bp, Homo sapiens
tgtgtgcagtatgtgcagaaacatatttccgcggaaaacacgaaagggagccaaacaagccgctcctacacttcgctggtcctgggcgtcctggtgggcartttcatcattgctggtgtggctgtaggcatcttcctgtgcacaggtggacggcgatgttaattactctccagccccctcagaaggggctggattgatgga

SEQ ID NO: 375 - DNA, 201 bp, Homo sapiens
ggtcctgggcgtcctggtgggcagtttcatcattgctggtgtggctgtaggcatcttcctgtgcacaggtggacggcgatgttaattactctccagccccstcagaaggggctggattgatggaggctggcaagggaaagtttcagctcactgtgaagccagactccccaactgaaacaccagaaggtttggagtgacagc

SEQ ID NO: 376 - DNA, 201 bp, Homo sapiens
gccttcacctatggcccttccccagcaacggatggcacctggaccaacttggcccatctctccctgccttctgaggagctggcatcctgggagcctttggrctgccacactgggcctggggctgagggtcacagcaggagtacacagcccatgcatctgtcaggagaggcttctacagccaggacctgcccccaggagcct

SEQ ID NO: 377 - DNA, 201 bp, Homo sapiens
cataaaacaaatttaattttctacgcctctggggatatctgctcagccaatggaaaatctgggttcaaccagcccctgccatttcttaagactttctgctscactcacaggatcctgagctgcacttacctgtgagagtcttcaaacttttaaaccttgccagtcaggacttttgctattgcaaatagaaaacccaactca

SEQ ID NO: 378 - DNA, 201 bp, Homo sapiens
cacatagactttgacgacttgaactggcagacgaggaagtataacaccaaagccgcctactgccagagcaagctcgccatcgtcctcttcaccaaggagcygagccggcggctgcaaggctctggtgtgactgtcaacgccctgcaccccggcgtggccaggacagagctgggcagacacacgggcatccatggctccacc

SEQ ID NO: 379 - DNA, 201 bp, Homo sapiens; identical to SEQ ID NO: 378

SEQ ID NO: 380 - DNA, 201 bp, Homo sapiens
tcctcggaccctgactcggaccctgactgaggatggcagctcttctgctcccccatcaggactggtgctgcttccagagacttccttggggttgcaacctsgggaagccacatcccactggatccacacccgcccccacttctccatcttagaaaccccttctcttgactcccgttctgttcatgatttgcctctggtcca

SEQ ID NO: 381 - DNA, 201 bp, Homo sapiens
tgcgaccgttgctgcaggtggtccaggcttgggaccttgacgcgaggcgctgggtccgggcgctgcggcggagcccagtgaaagtggtgtttccttccggrgaggtggtggaacagaagcgcgctcctgggaagcagccccgcaaggcaccatctgaggccagtgcccaggagcaacgagagaaacaaccgctcgaggagt

SEQ ID NO: 382 - DNA, 201 bp, Homo sapiens
agatagcattcagcagagctttagcaaggaagcaaaggcccaagcccttcaggcccagcaaagagagcaggagctgacacagaagatacagcaaatggagrcccagcatgacaaaactgaaaatgaacagtatttgttgctgacctcccagaatacatttttgacaaagttaaaggaagaatgctgtacattagccaagaa

SEQ ID NO: 383 - DNA, 201 bp, Homo sapiens
acttgaaacacagaggagtcctttctgccttgagcaggtttcacaagctggtctgggggagctttggcagtgggcttctggaaagctccggggttattgtyggcggcggggacaatggcatgcttattctatacaatgtgacccacatcctgtcttcggggaaggagcctgtgattgctcagaaacagaagcacacggggg

SEQ ID NO: 384 - DNA, 201 bp, Homo sapiens
gcccttcaaaggtgatgacatcaccatggtcctcatcttgcccaagcctgagaagagcctggccaaggtagagaaggaactcaccccagaggtgctgcaaragtggctggatgaattggaggagatgatgctggtggtccacatgccccgcttccgcattgaggacggcttcagtttgaaggagcagctgcaagacatggg

SEQ ID NO: 385 - DNA, 201 bp, Homo sapiens
gacaatctgttaagagcccagaggttcaattgcttgggcatgttgaaactgaagatgtagaaataattgcaacatgtgatacttttgggaatgaagatttwaataatattcaagactctgaaaataacttactaaaaaataatcttctgaacaccaaattggaaaaatctttagaagaaaagaatgaatcgctgaccgaac

SEQ ID NO: 386 - DNA, 201 bp, Homo sapiens
cctaagctgattaatcacacaatacatacttttcctgcattttctttcagtgacatttgagaattgggtgacattttaaaatgtgttttataccatttagyttttgcaaacaagttctaaagttttggagaaaaagtgatgtggtcaagagttgaagtctcatatatctttagtagcactcccatgaattatttccgtgac

SEQ ID NO: 387 - DNA, 201 bp, Homo sapiens
ctaactgtggtagtgaccacgtggttctcctcgctgtgtctcggggaacccccaacagggagcggaaacagggagagcagtctctggctccttctccgtcygccagccctgtctgccaccctcctggccatggtgaccaccttgacagggccaagaacagcccacctcaggcaccgagcacccgtgaccatggtagttgga

SEQ ID NO: 388 - DNA, 201 bp, Homo sapiens
cactgcctttgacctgcctcccttcatgcatggaaattcccttcatctggaaccatcagaaacaccctcacactgggacttgcaaaaagggtcagtatggsttagggaaaacattccatccttgagtcaaaaaatctcaattcttccctatctttgccaccctcatgctgtgtgactcaaaccaaatcactgaactttgct

SEQ ID NO: 389 - DNA, 201 bp, Homo sapiens
cctgatgaaatgcatagcttaacttgccacgtggtaaaaatgactggaatgggagaagtggattttctgacatttgatcctatagctaaaatggcaaaaartgttaagtacgatgtacaagctgtagctatcattgtggtggtattgaaactgctctttctattggatgacagtttcgagtggtctttgtctaatcttgct

SEQ ID NO: 390 - DNA, 201 bp, Homo sapiens
attgcccacctcaatggcctaagcaagtgtctgcagtgccaaatgtgtgacccagccatgggcctgcgcgcgagccggaactgctccaggacagagaacgrcgtgtgtggctgcagcccaggccacttctgcatcgtccaggacggggaccactgcgccgcgtgccgcgcttacgccacctccagcccgggccagagggtg

SEQ ID NO: 391 - DNA, 201 bp, Homo sapiens
cgggaaacacttctgaatcccacgtggctgcgaaatgaggacagtggaccctccggttctgtagacctgccattgacctccaccctcacagctctgaagamccccgcctgtgttcctgtctccattgggaggatcatggtctccaatgtgaccagcaccggcttccacctggcatgggaggcggatcttgctatggactcc

SEQ ID NO: 392 - DNA, 201 bp, Homo sapiens; identical to SEQ ID NO: 391

SEQ ID NO: 393 - DNA, 201 bp, Homo sapiens
ctccatccaccgcttactggctttgggacctctgcaagtcacttcacttctctttctcagtttcaagtgtaaaatgcggaaaataatagcaacttatctcstaagtaaataacagatgcgggtgaaagatccaactaaagctttacctgagaaagccaaaagaagtaaaaggcctactgtacctcatgatgaagactcttc

SEQ ID NO: 394 - DNA, 148 bp, Homo sapiens
gattgtgggaaggcagctgaactcggcgcctggaaagatggaggcagkggagacagaggcggaagctgcagccctagaggtcctggctgaggtggcaggcatcttggaacctgtaggcctgcaggaggaggcagaactgccagccaag

SEQ ID NO: 395 - DNA, 148 bp, Homo sapiens; identical to SEQ ID NO: 394

SEQ ID NO: 396 - DNA, 148 bp, Homo sapiens; identical to SEQ ID NO: 394

SEQ ID NO: 397 - DNA, 201 bp, Homo sapiens
ccaacagctgcccatacggcacctgggtcccaggacgtgcaccagaaaaaagtcttactgttaacagtcccaggaatggaagagaccatatcagaggcagrcaaaaacctttccaagcaagcgtggggaaaccaagaagacgggatccaggaccaagtcctgcgcggaatcaacgaatcaacatcttcccgtccgccgacc

SEQ ID NO: 398 - DNA, 201 bp, Homo sapiens
ttctcctggtgaagaagtcgcccagactccaaaacatcttgtcagaggggaaggacagaaagcaaaattatattgtgccccaataaaaggacacagttatkttttttggtaccaacaggtcctgaaaaacgagttcaagttcttgatttccttccagaatgaaaatgtctttgatgaaacaggtatgcccaaggaaagatt

SEQ ID NO: 399 - DNA, 112 bp, Homo sapiens
tcagctaagtgcctcccaaattcaccctgtagccttgagatccaggctacgaagcttgaggattcagcagtgtatttttgtgccagcagccaatccacagrgttaaatatta

SEQ ID NO: 400 - DNA, 201 bp, Homo sapiens
tcaatcctaagctccataccaccatgtactttttcctcagtcatctatcctttttggatacttgttattccaatgtatttacacccaaactgttagagatyttggttgtggaagacagaactatctccttcaaaggatgcatggtacaatttttctttggttgtgcatttgtaatcacagaaatgttcatgttagcggtga

SEQ ID NO: 401 - DNA, 201 bp, Homo sapiens
catctatcctttttggatacttgttattccaatgtatttacacccaaactgttagagattttggttgtggaagacagaactatctccttcaaaggatgcawggtacaatttttctttggttgtgcatttgtaatcacagaaatgttcatgttagcggtgatggcttatgacttgtttatggctgtttgtaaccccctgctc

SEQ ID NO: 402 - DNA, 201 bp, Homo sapiens
gctgccaacatacgggctgcagtggggaggcacagccagtcctcccactccacagagcaggcaggagtcccgcccctgggccccaggcctcctgctccagrggacaagtgcaagccctgccccttccgaattggcagggcaggagctcctcatgggcagctgcagtcacccaagcccggctgtggacctgggcatctctgt

SEQ ID NO: 403 - DNA, 201 bp, Homo sapiens
accccagggcctgaggacaggtccccaagtggacgtctcaaagagagtcccacattccagggcacatgggaactatggccttctggcagctggagggcagsaggaagggcacagctgtctgagacccgtgtggcttcccagaaagaggtgccacccctgaggaggcaccggtgctcacggactcctggttgccagtcttgc

SEQ ID NO: 404 - DNA, 64770 bp, Homo sapiens
ctgcactccaggctgggcgacagagcaagactccatctcaaaataataataataataataaggcattttaaaaaatgaaagcctgtctccaacgccctaacaaccaaggtttctactgcagcgacagtgtgaccactgcactaactcctacagggctctcaaaggcccaggcactgcaacgggtgccggtgcctggcctgaaaatcccagtcccagagatctgcgggggtcctccatgcttccccgggggccttgcttcccaccgaccacccttagaacaaacagcccatctgtgcacccttctccctcctctccctgaccccctcgcctggtgtactcttccacgaagcagcatcatcccggattcacatttatttgttgtctgttgccacccagatgcgtgtgcagaatatggctctatgggagctggaccctggctgggtcatggcccaagccccgacgtgcacatgcctggcggcaagggggctcaggaaatactgcagagttaacagaagcagccgggggcctgtgatgtggatggagagaactggggctatcaacctgagctgctctcttgacagctgaaagcataggctatgttgctgtttttaccctgggtagacacgcctctggtaaatgtatgatttgttagatattttgaggtctggaaaacagtcatcagaccctcataagcaccttcaaggactctgatatggtttggccatggccccattcaaatctcatcttgaattgtagttcccataagccccacgtatcatgggagggacccagtgggaggtaattgaatcatgggggcaggtttttaccatgctgttctcatgatagtaagtctcaagagatctgatggttttttttttttttttagatggagtcttgctctgtcgcccaggctggagtgcagtggcgccatctcggctgactgcaagctctgcctccttggtttatgccattctcctcagcctcagcctcctgagtagctgggattacaggtgcctgccaccacatctggctaattctttgtatttttagtagagacggtttcaccatgttattcaggatggtcttgatctcctgacctcatgatccacccatctcagcctcccaaagtgctgggattacaggcgtcagccaccgcgcctggcccaatctgatggttttataaagggcagttcccctgcatacactctcttgcctgctgccatgtaagacatgcctttgctcgtccctcaccttccaccatgattgtgaggcctccccagccatgtggaactgtgagctcattaaacctttttttctttatgaattacccagtctcaggtatttcctcatagcagtatgaaaacggactaatacagacccctaggggtccaggatcccagctggaggtaaccattcctaggtgagccttaaagtactttgcaaagttaggattccgcatttccacggcagggtgacctcctggggtctagggctcttcatcaccctcattggcatcatcaccgtcataatccagaccccagacagatgtgtctgaaggcagttgggtgtgagccaggagcccagcggggactgggctggaggtgtgaatagagaaactgccttcagcttcagcctcaaaacctaccacaggatcttaaccccaggtctgcactgagcagccagcactagtggctacttaacgtctgaaatacggccagtgtgacttaggaactaaattttaattttacttaacttttattttgagacaaggtctcattctgtcacccaggctgggtgcagtggtgcaatctcagctcactgcaacctatgactcccaggctcaaataattctcccatctcagtctcccgagtagctggaactacagacacccaccatcacacccagctaattttagtatttttttgatagagacaggtttcaccatgttggccaggctggtctcgaactcccgacctcaagtgatctgccagccttgatctcccaaagtgctgggattacaggtgtgagccactgcgcctggtcttaattttaattaatataaaattttaaaatggaagcagtgtaaatgtttttatattaaacacaactttattgctatagtaagactacatttcactctgttgaaaattgagcctctgaattgagatgtgtaaaatacacaccagattttaagacttggcacatacaagaaggtaaaatatctcattaataatttttgagctgtgtgtggggtggctgcacccttgtagtcccagttacgcaggaggctgaggtgggaggatcactggagcccagaagttggaagctacaatgagctgtgatcacaccactgcactccagcatgggcgacagggaaagaccccatctcttaaaaaagggggtggaggggttaaagaaataataattttgatattgattacatgttaaaaatggtactattttggatatattgggttaaataaaatatattaaaatgaatattacacctttttcactttttctaatatggctactagaaaatataaaattatatatgcagctctcattatatttatgttagacagacatttccatcatgatatggcttggctttgtgtccccactcaaatctcatctcaaattgtaatccccacgtgtagagggagggatctggtgggaagtaattgaatcatgggggcggacttccccttgctgttcttgtgatagtgagggagttctcacgagatccaatggttgtttttttgtttgtttgttttctgttttttgtttttttttttttttgagacagagtttcactcgtttcccaggctggagtgcaatggcacaatctcggctcactgcaacctccgcctcccgggttcaagtgattttcctgcctcagtctcccgaatagctagggttacaggtgcgccaccacacccggctaattttttgtatttttagtagagacagggtttcaccatgttggccaggctggtctcgaactcctgacctcaggtgatctgccctccttggcctcccaaagtgctgggattacaggtgtgagccatcgcaccaggtctaaacctcttttctttataaattaccctgtctaagatggttcttcgtagcagtgagaaaacagactaatacacatcgtaaccgaaaggtccactagacagcgctggtctagagtctaaacaaaccattctcacctccaagcaacccggttcctcccacatccacttttgatttaagctccctgcctgggggccctaaccctctgattctctgaagctaagccctgccttcctccatgtgaagctgtcttgcctgtcctttcctgctggtaggaaccatcttcctcccttaatatccactatttataccagacttcagcacttaggcttggagaactaatttcctcttcagctcaatttttacattaaaggcagttaatacccttctctcttaattgagcgccttgcatataaggaatggtaactgatgattctaacagtattaatagcacctttttttctgtggtgctttacagctcaaaaaggatctgtcatctccccacaaccttaagagggaagacaggtagagattttcatagccattgtacacatgaggaaactgaggctctttgaggttattttgcacagatcataaggcttgttaatgtggcccccatttttccactgtaggccagtgctgtttcccctccatgtgcttttggtgcccacgtgaaaatgcagacagttaaaactgaatatagagctgggcgcggtggctcacgcctgtaatcccagcactttgggaggccgaggcgggcggatcacgaggtcaggagatcaagaccatcccggctaacacgatgaaaccccatctctactaaaaatacaaaaaattagccgggcgtagtggcgggcgcctgtagtcccagctactcgggaggctgaggcaggagaatggcgtgaacccgggaggcggagcttgcagtgagccgagatcacaccactgcactccagcctgggcgacagagccagactctgtctcaaaaaaaaaaacaaaaaaactgaatatagaaagaaaagactagcatggttggggaaactagggctgcttcgtgttagaggcaagacttgaactgaactttgaggaatgggcaagctttggccaaacaaagaggagtatgcggacttttggggacagaaccacagcttctgtgaaaaccaatccataaacagaattcttgattaacaaagaatgatggaattaaacatttggactttttttttaaaacaacagttttatcaagatatagttcatataccataaaatccccccttttaaagtatacaactgagtggcttttagaatattcagagttgtacaaccatcactactaatgtcagaacatttcactacccctaaaagaaaccccataccacagattccgatgccgccgggagccctgccatgccatgtcacatatattatagtatatctatgcccagccatggtcaacccaccgtgttctttgacatcaccatcaacagcaagcccttgggccacgtctccttcaagctgtttgcagacaagtttccaaagacggcagaaaactttcctgctctgagcactggagagaaagggtttggttataagagttcctgctttcacagaattattccagggtttatgtgtcagggtggtgacttcacacaccataatggcactggtgtcaagtccatctatggggagaaatttgatgatgagaacttcattctgaagcatacaggtcctggcatcttttccatggcaaatgctggacccaacacaaatggttcccagttttgcaactgcactgccaagactgcgtggttggatggcatgcatgtggtccttggcaaagtgaaagaaggcatgaatattgcggaggctatggagcgctttgggtccaggaatggcaagaccagcaagaagatcaccattgccgactgtggacaactctactaagtttgacttgtgttttatcttaaccaccagatcattccttttgtagctcaggagagcaccctccacctcatttgctcacagtagcctctaatctttgtgctatctctcagttccctttgggttccatgtttgccttattctcctccatgcctagctggatttcagagttaagtttatgattatgagataaaaactaaataacaattgcaaaaaaataaaataaaaagaaagaagaggctgggagcggtggctcactcctctaatcccagcactttgggaggccgaggtgggcctaccaaaggtcaggagatcgagaccaccctggctaacacggtgaaatcccatgtctactaaaaatacaaaaaaaattagccaggcgtcgtggcgtgcacctgcggtcccagctactcggaaggctgaggcagaggaatggcgtgaacccaggaggtggagcttgcagtgagccgagatcgcaccactgcactccagcctgggcaacagagcaagactctatctcaaaaaaaaaaaaaaaaaaaaaaaagacggaaaaggcattatatatttgtgaagacatggacagaaatgtgtcctgattgtggtgccacaaagcactgagcctactagaagacgtcagcaaaagatcccctgaaaagtgactccaagccattcactgcaagggatggttacacagatgcagaatacagaaggtcaatagtagcttaatgctacatcacagcttaacactacatcatccacctcacttcatctcaccccatcgtatcgtgtcactgtgctcaccatcacaagaacagggaggatagcacaggaagatattctgacagagaaagagagagaccacatttacataacttttattacagtatattgttataattgttctattttattattagttattgctaatctcttactgcacctaatttataaattaaaccttgttattggtatgtatgtataggaaaaaatatagtgtatatagggcttggtactttcttcaatttcaggcatccattgagagtcttggaatgtacccactgaggataagggggggctgctgtacatactttgcaaatatcttctctcatcccatgggttgtcttttcattttctttctttttttttttgagacggagttttgctcttgttgcccaggctggagtgcagtggcacaatctcggctcaccacaatctctgcctcccgggttcaagcgattctcctgcctcagcctcccgagtagctgggattacaggcatgaaccaccacgcctggctaatttttgtatttttagtagagatggggtttctccatattggccagcctggtctcgaactcccgacctcaggcgatctacccacctcggcctcccaaagtgctgggattacaggtgtgagccactgtgcctggccgtcttttcattttcttgatggtgtcattgaagcacaaaagttttaaattttgatgaagaccaatttatctgttttttctttcatcacttatgcttttggtgtcatatctaagaaaccattgactaatccaaggtcacaaagatttattgcctatgttttcttctaaaagttttatgattttagttcttacatcaaggtctattttaagtcttttgttttgttttttgttttttgttttgagacagggtcttactctgtcacccaggctggagtgcagaggcacaatcatggctcactgcagcctcaacctcttggcctcaagcaatcctcccacttcagcctcccaagtagctggtattatagacatgcgcaaccatgcccagctaatttttttgtagagatagggtttcaccatattgcccagactggtctcaaactcctaagctccagtgatccgcccacctcagcttcccaaagttctgggattataggcatgagccactgcacccagccccaaattttgtatatggtattagaaaggggtccaacttcattcttttacatgtggaaatccaattgccccagcaccatttgttaaaaatattttctttcccatttaattgtcctagtgttcttgtcaaaaacaattgaacataattgtatgggttcatttctggactctcaattctattccattgttgagcatatttttaagggctgtttttctctcctgtggtaactggtgacctgtacttcctggaagagagatgaaaagattcccaagccaactgagttacctcacgtgggtcaggtctctgtggctctctgcactggcctattcataatgatatcctcctgcaggatttgagccttctcctttgttgtgacggcagccgaggaggtggctgactgcccagacagccttatctctttcctacctttcaaggttattgtaaataccaaattagattgtttatacacaagaatttagcactaaagcactatacaaatgtaagctatttatttctatttatccttctccttcatgaataagaccctaaaaatagaagatatttttaatttttactcactgggctcaaggttgcagtgtctgtattattgcaaattccaaattaatgaagtctggctcttcttatattattcctgcaaaaggctgtgtgctcaccccccggagtgtgaatacgagtgtgggtcatttcctctttcctctgcacccttccttcgatgaggttttgccctgtgctaggcaccatgctaaactctgagaaaaccacagagaacaaggcagacgccatccctgccctccagtaacatacaatttagtgatgaagctgggggatttaacaagccattctaataaagcgttacagtgagggaggtgcagggtgatgcctccagcagccctggtgtcagctgctccaggtccaggggaagacttccattatcttccaaccctgtcggaagtggaggcggaggctgtttattgctgacacagtccctaacccagggtctatagacattgtggaaatgccttggagtcagacgggagaatgaaccagcagaagcaatgcccgccctccaccctcctgaagagggttctcaggaactctttggaggcgaggccagcctctggctgagggcctctggatacaggttaggcctcaggctcttctcctctctactcatctctcctcccttggcccctccttcagaggctgacagagccccactctcatctcttccccacccaagcctctttccacagaaagactgcttcctcccaggagacagcagctcatttgcacacagacacccacagccctcaaagcctggaaggccaagctgttaggacccctgagagcagggtggctcctgggaggagagcccaggccaccaccttgccctccctggcccctggccttcgatggggctgctctgatcacaaacgtccaccaacgtagccggcccagaagtgcacccatgtcctctggtatccactggctctccaagccaaactgggcagggaggagttgtgagggaaaactgcaggtcaggagggaggctggcaaagcgggccagggccaggcctgaccccagctctcctctcccggccccactgccggccagtgtttaacaaggccctgccttctccctctagtgctagggacagccaccttcttcctctccccaccgccccctctcccctgcaacacgtcatctgacaagtcagtgcgatctcactggaggtgcatctcacaggaacgcggggtcacagcctcctgcacacactccatgctgcacagcaaggtgcacgtgtccctcagagccccagacaccatcccccactcacccagaagcccaagtgattcccaacagcccccagcagcctaatgggttggggtcttgggagcagctgtccctggctccttccctgatcccaccgcccagcctcaccccacggttcctccattgccccacctcccactgcgccgccgggcctctgccagggtcaaggggcttcccccctctggcagcagacgccatggtgccgaggtggcctccacaaccgccctgtgcgccaataggacaagactgtcctccctcccccacacttgtcactttgagggacacgtggatgagacaggaaaacacaggggagtgtggagacctgaggtgacttggagcaagcctctcaacctgagcggcaatttcttcatctgtaaaatgagggggttgttctcatctctgaggctttgtgtcgctctcaaagcctgctagcctcgggttctaggactctgttgggatcgtgtgtgatgttttctgctgagcgactggcagcctgtgtcctcggggggaaagagggcaggcgctccaaagctcctgcgctctgtggctccccctccctcgcagccccaagccccaggtgtgccggccgccctgagcccctccagcacctcccggaggcgcctgcaagacacctaaggtccccgcctccctcctctcccccccgccacacccctacccccggcaggcgacgtccccgcccctcgaccatggcctggtgaagaagccggccaggcccgatcagccccatccccgccgcacgagcggcgcctgcggacagctcctggggccccggccttgtcactccggaggcgggaggctccggggggtcgggctgggaagatcgagccggaggccgctaggctcccaggccccggccgaggctgcgcggccgcacggtgggcaggctcgggtgttccggcaaactgccgggtccccatcttctaaagagaggaggccctttctccagcttcctctgcgggagcccgacccagccccatcccgccacccccgggctgcacctcggcccctccccggcccgcgcccctgcccggggcgggccaggaacctcggcccgcgccgctggggactctggagcggaggaggaagcgcggcggggcgggggcgggggtgtgtcgggttttataacccgcagggcggccgcggcgcaggagaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggtgggcgcccgggcccgggcgggggcggggcggggccgcggcggccaatcacagcacgcggccggcttgtggggcgggcaggctggcgcccccgacccgaaccccaccccgaccccggaccctcgccccgacagtcagccgcggggcccgagcgccgggctgcgcgcacggcctgcgctcccagcatgcacgagttggatggatgagggtggctgctcccaggccgcgcccgccttcgccgaaggtgctgggcttggctctggggcccccgcgctctcgggcagctgccttctcacctccggacgctgtcgctgtcaccgtcaccgcactgcactgtccatccaccctccactcgcccggcctcttttctggtcccaatttctgctccaccattcccatgaggcagattccctccagaaggaggaagcgcggcttccgcaaactaaggtctcccgcagggatctccccagggcccgggctctggaagcccttggccttcctcccctcccccagcaccgtggcttctcctttatggcctgcatctaagcagggtcctacaccctccctgccctcctggtgcccaataggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcaggtgggctgagggctgaggcagagctcgggggcggcctcctagtgccccatcgtgggggtcgggggagagcagcccatcagggagggaggaaccctgggatccacatgggccctgacagaagggaaagcccaggtaagcacagaatggctttctgagcattgatttttcttggagatggggtggggagttactttctgttaaaggaagcattctggagtaggaagccaaattcaaatacacttctccctaggctggtttatgagcttctttggaagagttgagaagggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagagtgagacctccccccaaaaaaaagagagagagaaaaggttgagaaagactgggaagtcaccaaagccagagaatgggagggatctgccctcactgcagggtggtgccaagctgggacttgaccctgaccctgactttcaggactcctgtcccccactccacaggctgcctccactggcaggggactcagaagtgatccggtcacactaagtgacacttagtgatcagaagtgccccggtgccactgagtggccttgtccaagctacatccactctgtgggctcctccttctagcagcgaggggagggcagatgtcccaggggctggtcactggagcattcctcccctctgactccccagtacaacgccctgctaagcaacatgagcaggatctactccaccgccaaggtctgcctccccaacaagactgccacctgctggtccctggacccaggtacggcccttgcagctcccctctcggcggtgccctagtgttcccacattgccctgctgcactccagaccatgcagttgtgtagggtctgtggagacagcaggtaaacccaaaggtgttgccctccaactggggctggacggtgcagatacccccacgccctgcttctcttggcaagtggacttccggaatctccagctgcagcccccacttctgtgtgtacctcggcctctcccatcacccctaggccttcctcctggctgcctggtttcccctttcgtgggtcctctcatgttccccaagagccctcaggccagggacccctcgtggcttccccttaaaccccgctccagccccctttatgagcagcttcgaggaaggcactccatccaataggccgctaagtgtctgtctgggttttggcctttgggtgtccccttggtgtcagccaccttaggtggtcatgtctctggggcaggggccctgcctgggtgtttctgtagctcccagccccctcccaccaggcctgtaggtggcccctgtctctgggggcaccgtgatgttcaggaagctggtgggagcagtaaggactggtgcaggctctggtgaaggccgttgaagacttcaacgtggaggcctcctcaccgaccctgcctgcctgtgtctcagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggtgagcaggcctctccctgtccaggaaccacgccaggtgtcctctctcagctgtctccccagagtcccagcccagagtcaggcagagcagctggtatgacaattccagcaggccctgagtttcccagaaagtggaggtgggaccggcctgcacccagtgtgcctggactttgctgctggcctgccccacgtggccatcctgctgtcactcctggccctgatgctcctctttgcctctgggaacctccaggatctgtttagctggctgtagctaattagaaattgtagagtggcaacccccaagccaattttccagctagctgcagatccacgggcctcgagccagtggaagagccgacttacagctgagaggctgaggtccgagcctttggcctgagctacatacctcacccccacgcccccaggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggtaaggacctggcctcgcctccacatgagtcccacggaagtgtgggtcccgaggtaggggtgggggatgtccagggtaagggaaggtgggttgtgaccctcacatctcacatgtgtggggcatcatactgtttgcttcacatgcaggagaccattcgtgttcccactttacaggtggggaccctgaggcttagggtcgtgagggacttagtggtcagagagctaggggccaaaccaaaggctctggccctgggtccagtgggggagccatcagcctagctcatgcccaaggaaacaagcactgtggccctgcctcaggattgagtggctggggcctggcacagccagaaatgacagtggcagcatcttgcagccccaggacatgtggccctcggaggagtgtgggtgggactgatgtgtgagatttctggccctaagccaggcctgcagcccttgagggccccagggtacaggtgccggccccagggtgccactcagcgatgcatgaagaagcaggcacagccaggcagggagccaagctgtccccttccttccttatctaggagacatgtgggcccagagctgggaaaacatctacgacatggtggtgcctttcccagacaagcccaacctcgatgtcaccagtactatgctgcagcaggtaagctctgggctcaagcctggggtggtgggggtcgggggtggggcgcaaaaaaagggagtcacagatgggcacaggggcgggaaggtttcgggtactgagcagcagcctggtgtgtctgtaggagcagtgagctggggtcggccccctcagtgaggtgccagctcctccctccaggctccacagtggcaggatgagagcaacaacgcactttcactcatctgctgtgggagtgagggccctgcctctgggaatggtggccacagagcagagaagctttcatgcacagggagttgacccgagatggggaccccagccctgtccccaggccagccagagtgggctccccctgacctggctccacacccctcctccagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggttcagacatgggaagagcacgttctggggttccccggttctggggcccggggaaaggcaggcagcccaggcgcagggaagctggttcccaggcctgcctctaccctaccccagcactggttggaggctgggtctgttccagggctagggggtataggaggcctattagtccaccttctctggcagctttgacaaatagtcacttctataccttggaatggaggaagaaggcccaagtggtggtgagccagggcagggtaaagaatttgcttgtttctgccaggcacggtggtcacacctgtaatcccagcactttgggaggtcaaggcgggtggatcacctgaggccaggagttcgagaccagcctggccaacatggcgaaaccccgtctctactaaaaatacaaaaataaattagccaggggtgatggcgggcgcctgtaatcccagctactcaggaggctgaggcaggagaatctcttgaacccgggaggcggaggttgcagtgagctgagattgtgccactacaggccagcctgtgcaaaagagtgagacgctgtctcaaaaaaaaaaaagaaaaaaagaagttacttgtttctactgcggcttcatgccccagggcagctccctcctcattcctgtctttcaggtgccaatctgccctgtgccctggccctgccctgttctgtccatccgtcactctcaccctcgccctctctacgccccaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacgggtatgggagggctgagaggcccccacccagcctcacctaaaccccgctccaccccacagcaggacctcacttgccccactcagctctgcccttctttctgcctcccggccccaggtcaggcagggttcgggatcctcctagagcctcacggtgcacactgcgcccagctcagcacacctgggggtcctcttccaagcagggcccagggtctcgagggccagccataccttctctgcatctccctggcctcactttctgctgccccgccagcccacactcttaggggaccctcttctccctctgacctcttccctctcctttcatctcatctcccaacagaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcggtgagaggagggatagaaaagccttcgccccagctagccctccccagcctcctggacagccaggcgcctcctgccccagccagttctagcctctcctctctaatgatgtcccccgctgtgacccaccgccttctcctttcctgcctgaaactccctcttccaggaagtcttccccagttcctcaggatggggaagggttgccgggtggaaatgccttttctacaaaagttaaatccatctgtttgcaacctctaggccctaagacaatttaaccatccttttccagaaccaagtatcaggggatctgtcctcctgttacccgaaacgaaacccactttgatgctggagctaagtttcatgttccaaatgtgacaccatacatcaggtattagcgcccccaccccacccacccccagtactgtcacaccctcaatccacttctcctcctgtgatcctagctgcctcatccccagggcttgtccccatgctcctccagacctcaaaggcctggagttagagtggcccactctcctgagcctgtcttgggtctcccttctcccccaagatagcttctggtccagcctctgccctgcaggaagctggatggtgcctgggtaaggaacccctgttcctggccccccatgatcttccctgactcccaccctgtgcctgcaggtactttgtgagttttgtcctgcagttccagttccatgaagccctgtgcaaggaggcaggctatgagggcccactgcaccagtgtgacatctaccggtccaccaaggcaggggccaagctccggtgtgtggtgggaagccgggggaagtgggaggcagagaggagcggctggcaaagggtgtggcaggaggtgtctggctgctctgatggggtggggggcaccaaccacagagctggactgatgtggatgcctgtctcctcgctatgtcatcaaatatttattgagtgggccttctggctggcatggggcgacacaaatgccccctgccaccatcagagagatcccaggccccagggtcttattgccacagtttctgcagtccattggggggcggaagtggccaggggcatgtgggccggggtccaggagcagactccagcctgagtcccctgtgcccatggtacccactctgcccaccaggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcataggtaaagccctgagtgaggatggtgtggggctaaggtgggtcctcaactctgggcttggcccaggccccaggttcctggtcagctcctaccagctgagccctggtaccctgtcctggagggccaggcagccccccaagctcatcagcagggcctgcgagtggggacaggcatgtctttcccccagcatcctagagagggtgtgctcagacctgagggcccctccccttccagaggaagccagacacaaggctctgtgaggtcacactgcgggctccgctcttattggccaggggacggtagctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaagtgggaccatgcaggggaggggcagggtgccaggggtgggagaggcggggccgggtagggacagggcagggtacaagggagtgcgagagggataatggcttctggtgagaccacaaacctggagaggggaggcagaggtttgtctgtttccctgcactctgtcccacagacctggtgactgatgaggctgaggccagcaagtttgtggaggaatatgaccggacatcccaggtggtgtggaacgagtatgccgaggccaactggaactacaacaccaacatcaccacagagaccagcaagattctggtgggagccacctccccacccccaaacctgagcatgtgcatacacacagagatgctgtcccgctcaccacacagtggggctgccaccacattttaaattgaatatttaaaacaatactcaatttcgggccgggcgcggtggctcacgcctgtaatcccagcactttgggagggggaggcgggcggatcacgaggtcagatcaagaccatcctggctaacacggtgaaaccccatctctagtaaaaatacaaaaattagccgggtgtggtggcgagcacctgtagtcccagtactcaggaggctgaggcaggagaatggcatgaacccgggaggcagagcttgcagtgagccgagatggcaccactgcactccagcctgggcgacagagcgagactccatcaaaaaaaaaaaaaaaaaaaactcaatttcagattttgatgaacatttactcaatgcctgagcaattcttctttccttaaaaatcagtctctgggaggcctaggtgggaggatcacttgaagccaggagttggagactagcctgggcaacatagcaagatcccatctctattcaaacaaacaaataaacaaaaatcaatctctagtaacagaataatttgtacataaataagtggtgctcaagtcgttttttaaaagattgaaagcctctgtttgtctcctctacaaaaggggctacacttcctctttaccctcattccctgcctatttggctgagcacaaattatgccactgagccacacactgttactgttccttggcactttgatctgttgcctcatctttttctcaacagccttgcaaaattggtgagcttattcccattttacagatgggatttgatattaactctgaggttcagaaaggccacagagctaataccaagctggctccttcctaagggcctttacgacacttgggggtcttctcttctctgcccctgcctggatatgtgttgcttgaccgcaggcatccagggagggtgagtactgcatccaggacgttatcagcgtccagcttgcagagagtcttataggcaaaggttgcaacttaattccactgccccctcaccaccacctccagccctcagctcccacttggggcctcccgctcagaggctgctctggagctcctgggccctgtgacaccatccccctgtgccctcagctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggaggtgtgtggctcgcaaggtacagggagaggggaatcctggggcagtgagcccaacacagggtctggcctggccttcacgctgcttcctcttcctcgttgtatcaagtcatggcatctgccatgcgatgtgcacctcagaactgctgagagggcagcgctccccagctccctggctccccacctgccagcccatggggcctgggggtagtgcaggccccagagagaccaagtgcaaaggagtacagctcattgcctctccttcctcctgcagtacaacaagatcctgttggatatggaaaccacctacagcgtggccactgtgtgccacccgaatggcagctgcctgcagctcgagccaggtgagagctcatgtgcaggctgagtgagaggcgagggctgggactggcatggggcccgggggtgctgggtgagagcacagagttgggttcccctcgctcttggggtcagcgtgcccaggaaatgccctttcttgttttccacgaggggggcttctctgccccactgagagccggcacctacttcataccatgccccgatcagctgcccctccctcagaaccgccctctgcttaagggtgtccactctctcctgtcctctctgcatgccgcccctcagagcagcgggatctcaaagttatatttcatgggcttggactccaaatggggggaactcggggacactagctccccccggcctcctttcgtgaccctgcccttgacttcctcaccttctctgtctttcctgagcccctctcccagcatgtgactgataaggaaattgagtcacacagcccctgaaagcgccagactagaacctgagcctctgattcctctcacttccctcacctaccctgccacttcctactggatagaagtagacagctcttgactgtcctcttttctccccactggctggtccttcttaccccggcccgtttgaaagagctcacccccgacacaaggacccgcacacagatacctcccagctccctctcaacccaccctttccagggttggagaacttgaggcataaacttgcttccatgaggaatctccacccagaaatgggtctttctggcccccagcccagctcccacattagaacaatgacaaatagaaggggaaatggaaaataaacaggagaaacggttttcccaggacagggtttggcctacaagttgtggatgtgggtacccatgccaagtgtgaggggaggctggccgggtgtggtggctcatgcctctaatcccagcactttgggaggccaaggtgagtagatcacttgaggccgggagtttgagaccagcctggccaacatggtgaaaccccatctgtactaaaaatacaaaagttagctgggcgtggtggtagatgcctgtagtcccagctacttgggaggctgaggcatgagaatcgcttgagcccagcctgggcaatacagcaagaccccgtctctacaaataaaatacaaaaaattagttggatgtggtggtgcatgcctgtagtcctagctgctagggaggctgagatggaaggattgcttgagcctgggaggtcaaggctgcagtgagccgagatggcgccactgcactccagcctgggcaacagagtgagaccctgtctcagaaaaaaaaaaaaaaaaaaaaaggagaggagagagactcaagcacgcccctcacaggactgctgaggccctgcaggtgtctgcagcatgtggccccaggccggggactctgtaagccactgctggagagccactcccatcctttctcccatttctctagacctgctgcctatacagtcacttttatgtggtttcgccaattttattccagctctgaaattctctgagctccccttacaagcagaggtgagctaagggctggagctcaaggcattcaaacccctaccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggtgagtccctgctgccaacatcactggcacttgggtcccttcattttcctcaaagaggtgctgtgaaaccccaagcctaggaaaaggtagatccctggaggaggcaggtaatgtggtgttgggagagcctggctgtgtcccctctgtaggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctgggtaagggcacatgtcgggccttgaggagggtaaagacggaccacagtgtgagtgagggttgggacagggctgactagagggtagggagcaggctggggactgagagactccagccctgtgggggatggttgcccaggctggaggggggtgggcgctgggagtggggagccccccacttgcatctggtgccacattcactgcagatctatgtcgggcaagtcaccatggatgggggaagaagttaataatcttgtccaggagaccacggcacccatcacaacattgtgtgatcttagagggcgaggaagaggctgtgagtgggagctggggaggctttgccaagaggtggcctgtgagcagggcctcggaagatgacagggtttgacagatgggaagtgggggatgagaggacagacgcagtgttcaggccaagggaactggaacaaagaagaacctgagaatgtaaatctacttcaaccctggaccctcctttgccaagggctgcaatctcagatgccctgaatgtgtgaagtaggcggtgaggacagtaagggatggtagggagtaaggcaaagcagaggctactggttctctgtccctgatgggctgttaggaacactttcctggagcagagagaccagacaggccctcagaccatttagaaactataagggaggccccagaggacggcctggctgtgggtctagctcccacacaggctgggagtccagccctcttcagcccctctctggtgagaccaaagaacatctggtgatgtcacagtggacgtcagttcaccaactgggagacacaggccccgggaagaaaagcaacatgcccagcgtggcctgggagctggggcagagctggccttagaactcagcccctgacaattggtaaaaggggaaaggggagcaacctaacactgatgcgctctctgtctctctctctggctctctccctggctctctccctcttctctctcatgttctctccatcactcatcgctctaaccctctctcactggtttgcactttagacttcatctgatgtcagccgaagcttcacctcacttggctaggaaagagccttgagtccaaatctgtttctgagccttccattcatcctgagtttcttccttttcctctgtcgtggagaactaggctcttttcttacactaaactcagaggcatcagcctctcctgaaggagacggctggttcctgtcagagttgctgagctgcagacaccgacctcaggtggtgcggaggggacatggcagagtggctggtgaagagagcagcctgccagcctttcaatcccagccctgccacttaggagccgtgggcccccggcgaggggggcggtcacttaactctccagcctgtttcctttactagccaatgggaatcgtgacagtacctgggtgcagacaggattgaaagtgaattcacacaatgttcttggtgcagagccaataagaggtggccaccggggtgtaggtgttctggggacctgtaatgtcctcacatgtcagcagttgctagtcacattggtctccactgctcacggacagtgaagaccacctggattccctgataaccagcaaggcccccacctagagccaggcagtaatgacctactgggctggatatgcacaccaaagatgatgtgtgcctcaaagcttgcaaacagtaggtgctcaagaaatgccactatgattagcaggactgggatctggagcgctcttcctgcaggagggcattgagcctaagtaacatttgtctttcctctctctgccgtcccccacactcgcctccagggaacatgtgggcgcagacctggtccaacatctatgacttggtggtgcccttcccttcagccccctcgatggacaccacagaggctatgctaaagcaggtccgcaccagcccaggggcagggaggccccgccgggatgggagggaccctctgattcaggagttccctccagtttagccctcccccgggatccccacggcagcacgcagtctgtccccggaacccccagtttgggcagaactccctctgcttgcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggtacatccagctagggctcaggtctcgttcctgagccccacgggcaagggaaatgaaccaagcaaagggtccactactgtcccccagctggagccagcagggcaggatggggacagggccagagtttgggactgagtgtctagagaggtgttggcttctggcaggaaaaccccatccgcctgatggggacttctgaagcacgcaacagctctgtcagcctggccgctgggaagtgctcaaggtcccagtcctgggtttgagcatggtaggctgccccgcgtccctccttgggagcagcccctgcatggagctggcctctccctgggggcacatgctgtgacacagggaggcacacgaggatgttgggtgctctgtacagatccactctcacccctgacaggctcagaagctgccttccttggaggatggcgttttagttacctattgctgtgcaaccaagcaccccagagcttagccttacgaaacaaccagttgattttgcttatgattttatgtgccaggaattcaggcagtacacagtggaaatggcctttctctacagggccccctctgttgggggcagctctcacagccgggatggctcaatgggggccatacgtccagagccccagttctggctgtcggttgaggtcctcggtttttcccatgtggcagatgctggggcacatgttcccagtggcctcttggctcacatgttgggtgcttggggtgagatggctggaacggctggaggtgggtcaggcatctctccaggctagctcgggcgccctcccagcgtggaatctgaggtgggcagatttacctggcagccagcatcccccacagcaactactgacgcagccagttctcaaggctaggtccaaaactggcccagagtcacttctgccatgttttattggctagaacaagtcacaagttcacccagattcaagagaagagaaaaaagtccctcccacttgggagaagtggcaaagaccatctgtcacagctgaagaagtgtctcttacaaggagaacagacacggggagcctgaaacaaaacccgatgggattccctgggctgtgcaggcccttccaggcatgaggactcagccacagggctgagaggagacaggatctgggggatgagagcccttgtggggtcttcccttttatggggagtcagaggagaagctggatagatccccagccttgtggccaggatgctgggcagctcttccttccccctccccgatgagaatgacagaaaaacaggattcacctgagccaaaaggcttccagttagatccaagagagaatttcccgcagtttgaattggtttgctaaacaacaaggaagggctgggtgcggtggctcacacctgtaatctcagcactttgggaagccgaggcaggaggtctgcttgagctcaggggttcgagaccatcctgggcaacatagcgagaccccatttcataaaaaataaataagtaaatgagaacaaggaaggactgacgagagacggtagaaccttctggtttgggcagctctgcagctgccattcatcctggccataagaattcttggggtgaataagtttgtcgctgttgggccgcatgagatgcagaatcgcccactctcacccctgacagaaacagttgtttccttcagggagcctccatcttgggagataaagcatgtgtacatgggaacccactggccacacattctctagaaagtacacaatgtcccagtgcctctagagcaagcactttgtacagtcagaaagcaacaggtggtgggggctggagtcattcaggaaaatgggaggcagaggaatggcctgaacggcccgatgctaggggcttctgcccccagattccctcttacgcacactcagtggttgcccttcccctccctccccacagtgctgtgtcccctgcatgctgcagtgctggggtctgccctgggtatagcaaggcccactgttcccttatgcccagggcttctcactgtcctctcccaacaccctctcccccactccactattcctaggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacggtgagagagaagcgggaggccctggtgggctgaggaccaagaaagggtggtgagcttgggaggtgggaaaggggcacttagtggcccatgggcagaggtgtggggcagagcaatcggaaggaagggagccacccagaccatcccaggaggcaggtcacagggcccaaaaggtacagcacccccacccctccaccatcacaggcacaccagggccaagccgctaggaccctgggtctgacagctgggctcccttcccttgcagagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggttctggaacactcccacgggatgcgggctgggggatctctgcgagtgtctgcatgtgcctgggtgtctggatgggccagggtaggggagtgtgtgtgtgtgtgtacactattgtgtctgtgcatatgatgtgtgtggtgtaagtgatggggaaaacggggtgattgtgcacagaggcccagcacgcaggagaatggggtgcccagtatagccccaagtgcagggaccctccctcaagtcaaaaatgccacccccagcctggttctccccaaactcatcttccaacatatattcccactcgacaggctgaagtaccagggcctctgccccccagtgcccaggactcaaggtgactttgacccaggggccaagttccacattccttctagcgtgccttacatcaggtaacgggaaaggcaggagggcacattgtgaggggcagtacccacagctttgtgtttcaactgcggccactgcccggtccacaagctctgtcagtcagggcagacccgggggagccggccgcacggtgcaggtgcctgggcccactcacactgccaaggctgatgggttttttcttgaacattcttttgatgagagtctgtaccatccaaacagttgaacacagaaactcaacctaataattggctaatggttaccagaccttggttaagtagttaacattaaccacgactcatggctggatcatgagctctgcactgttttgttttgcttttaaaacaagactgtgattcttttactattattgaacattgtctgcgatacaatttgaattgtacctggaagcccttctagacactaaaatgtaggattggagatcggttaaggtgggaggcagggttgctggggcaagttacagtcacaggctggggtcagacagaactgggttcaaactccgtctccattactttgtttccttgagaaaattcctcaatttctgtgagcttccatttcctgacctgtgaaccccatttcacaggatgcacgatggctaacttcttagcattctgtctcatacacagcctcctcagggaggggtggccaggaccccactattcatcactctctagtggaatgtagctgcacactaggtctgcaggtcacatggccacagatgagtgtgcccaatgcagcccctctccttctgtgtgccccgggagagcacttgctgagggctagcaaggctgtttgtgatccgggaggctccctgggaggctgggggctagagagacctcaggctggagttccaggtgcccccgggctacaggtagcccaggccacccccagagggctgtggctgcctctggccctggcctcccgtggttcctggaagcccagcaagggcagggcccatgcccaccttgcctcctggcacctgggatgatgccagcacatcatcaagtgctaataactgattgtgggatggatgaagtctgtccccagagtccaggaagagggcatccctggagcacctcagataggcctgacctagacggtgctccagagatgacacttaggacagggctcccgcctgcctgctggagtggtccctggggttcccagccggcgctggctctcacccgggagccagctggtgtgatggctagcttcccagcttaatgcagacaattctccaaacaggggtgggcaaaggagacttggctgctctagaaaaacattccggattctggccagcagccttcacaaagcacttttaggaaagaccagggaactaggtggtacatgcttgcacccagcattcaaagtgagaggcctgtgccactggctcaggacatttaaaacctcttcagactttaagctggggagaatcctccagccttgactggcagatttctaccagggaattcgtgatgctttggataagatcatgtaggactggcttccctgcccagaccaccctagtagatccacacggcccatttggccacaccttgcctctacttgcatataccccagggatggagacctcactgcctccaaagccacctgccagatctctgaaggctctgccctgaccccatggagcaggccctcctgagttgtggaggcagctctgtgggtgggaggcatctacacaggcacggctaggaagaggctcagacaatgctaagagctggggtgggggagctcaccctgatagctgtgggcagagttggggggccttggctctgctgtgcgcatgtgacttagcacacatcacatgtgatgtgcagaagggcctggggcccagtggcacaaggccctcaaccaactccgccccgggccacggcctcgctctgctccaggtactttgtcagcttcatcatccagttccagttccacgaggcactgtgccaggcagctggccacacgggccccctgcacaagtgtgacatctaccagtccaaggaggccgggcagcgcctggcgtgagtgtcctccagccctcctttgtttccatgctctggcctgcgcccctgggccttgaggggtctgtccactggagcttttgtgggaacacttgccattttgagccgggaactcccacctgcagcgtgggccaggcctgattgccatctccttaggcacctggagccctggggccctgggacaagtttcagctgggagtgggtatggagagtggatgtcaggtgggggcaagaggggccatgtccttctgactctgcctccctgtctcatgcctccccaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccggtaccgccacccaccccacctccagccttgggtcttaaccccctccccaggctgggcagccatgcggctgacctcggagcctggccctgccccgcacccttgccctgccctgccctgccctgcccatgctgtctccttgcttcccgctcagctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttaagggacatttttatgacttttatgtgtatgtttatgtagaaatttggaaaatacagaaaactgtaaagaaaataaaagccctttatatcaacgtcaagagataagccctgttgacgttttggtgtacaacttgccggacttcttctcagcacatgtgtattttaaatgggatcacaccatatttacagtcatacatccttttatcacttcatacaactagatctgtttttctgatatttaaatgccagacttcgaacttggccaatagaagttggtccatttgctggggccaggggctccccagccacccgggcccctctgtcaaaccctcagccctgagtctcttctgggctttgctgatgtcttcaccctagctaggtccatctcccaatatctgtcccccttagtccacagcttttgccccccaatccaggtgccgtgcgtgtctctgtgtgtccgtgtctgtgtgtgtgttgtacacaggcttggctgttacaggcccattctgtaaggcaggatgtggggctgaggtattttaggattgaaagagggtggaagtttatgattacataggacaatggaatttataaacatgtcctctaaatggttccgagtcatctaccaatgaagacttcttgaattatccccccttttcccagcctgttttgaaagctctttgtttaccagacaaaggtcatcatcatatgaccccctttgccttttttttttttttaagatggagtctcgctcttgttgcccaggctagagtgcagtggtgtgatctcggctcactgtaacctccacctcctggctttcaagcgattctcctgcctcagccttccgagtagctgggattacaggcgcccaccaccatgcctggctaaatttttgtatttttagtagagatggggtttaatcatgttggccaggctggtctcgaattcctgacctcaggtgatccacccacctcggcctcccaaagtgctggaattacaggcatgagccaccatgcctggcccccgtttcctatttttatgaaccacagcggttcatgctgcctgtcagagcttctgggccgcgtgaggtcaccagctttcaacacgcaaaggactgcactgcagctgggggaagagaaactccacactgcattggcctggccagccttaccctctgggcttttgaaatagtatcttttttctgtttgttttcaaacagagtctcgctctgtcgcccaggctggagtgctggagtgcagtggcctgatctcggctcactgcaacctccacctcccaagttcaagcgattctcctgcctcagcctcccgagtagttgggctactacttcaggcgcacgccgccatgcccagctaatttcttttgtattttagtagagatggggtttcaccatgttgcccaggctggtcttgaactcctgagctcaggcaatccgcccgcctcagcctctcaaagtgctaggattacaggcatgagccaccgcgcccggcccaatagtatcattctttagatgcctgcctctgcctccttgggtgagtggggagaggcaggggatacctggaaggtagcagaggaagaggaggcggtaacagcaggaagaggggccaccccagtgttttctactggtggccctgaaggctgagcccatccccgtgccatgcctgccaatgccgctcttgggagaccagctctcacctacgctagccacaggtggtggctgccagacagtttctctgatccccacagccctccccaccctctaccttcctctgtctgcctaacccccttcccacccaccctggcttttaacataagtgaaaaagtggctaaccccacctctgcacttatcacctgtgtgaccttgggcagtttgtttttgcagtctgcattttcttttcttttctttttttttttttttttttgagatggagtctcgctctgtcacccaggctggagtgcagtggcgtgatctcggctcaccgcaagcttggcctcctgggttcacgccattctcctgcctcagcctcccgagtagctgggactacaggcgccagccaccacgcccggttaattttttgtatttttagtagagacagggtttcaccgtgttagccaggatggtctcaatctcctgacctcgtgatttgcctgcctcggcctcccagagtgctgggattacaggcgtgagccaccgcgcccagcctgcattttctttcttacggttcttatcaaccctctcagcgttgccatgaagatgaaatgagatgatgtacaaagtcctagtagagtgtcttctctttataatgaatgcatcgtctcctgagaaagctagtttcataacaaccccagatcagccaagtccagatcagccctctcacttgagacaggaagaggactcggggcaactgggtgccggagctggactgaaaactcccatctcccagctgccttccaggaacttccccaccacacgtccttgcacagccagtcaactgtcttcttactgggagcacacagagctcgtccactgggggcccacagcttgcctcagttccgggagtactcagccatctccctgtgtcgcctctccctcatcatccctccccatgtcacatctccctcagcctctccgtgttacctctccctcatcctccctccccatgttgcctctccctcatcctctctctcatcctccctgcccgtgtcgcctcttcctcatcctctccctcatcctctccctcttcctctctccccatctctcctctccctcatcctccctccccatgtcacttctccctcatcgtctccctcatcctccctccctgtgtcgcttccgcctcatctcccctccccatgtcacctctgccttatcctctctctcatcctctctccccatctctcctctctctcatcctccctccccatgtcgcctcttcctcatcctctctccctatgtcacctctccctcatcctctccctcatcctctctccctatgtcatctctccctcatcctctctccctgtgtcacctctccctcatcctctccctcatcctctctccctatgtcacctctccctcatcctctctccctatgtcacctctccctcatcctctccctcatcctctctccctatgtcatctctccctcatcctctctccctgtgtcacctctccctcatcctctccctcatcctctctccctatgtcacctctccctcatcctctctcccaatgtcatctctccctcatgctccctccccgtgttgcctcttcttcatcctctccctcatcctctccctcatcctccctccctgtgtcgcttctgcctcatcctctctccccatgtctcctctccctcatcatctcccctcaccttcgaggatccccataagaccctgcctggggatttctatcttgccctctgtctcctaactcttgctcatagtgctcaccccatttcctgtcctgtgtgcctggcgattccccacctgtgtcctccaggcccggtgcttctgatttttagcctactgtttaatctggctgtcgagagttttgtcgttccaatttaatccctatatttttcattttagcatccctgcttctttcaaacctcctgggttttcataaacgcctgtttttgcctcacagattctgttctctgaatcactttaaagacctggtttttttaattgtggcaaaatatacataatgtaaactcaccatcttaaccatttttaagtgtacaattcagtggcactaagtacattcacattgttaattgttgtgcagccatcaccactgtccatctccagaacagtttcatttttctgtgtgtgacaaggtgcccccaaaaagtgtgcttactctgttgtccaggctcactgcagcttcaaccttctgggctcaagcaatcctcccacctcaagctccacagtagctgggagcacaggcatgaaccaccacactcagataattttttttaagtttttagtagaggccaaagcacggtggctcacgcctgtaatcccagtacttgggaggccaaggcgatcggatcacttgaggtcaggagtttgagaccagcctggccaacaatggcaaaacctcatctctgctaaaaatataaaaattagccaggtgtggtgggggtcgcctgtaatcccagctatttgggaggctgaggcaggagaagcacttgcacccgggaggcagaggttgcagtgagccaggatcatcccattgtactccagcctaggcgacagagcaagactctgtctcaaaaaagaaaaaaaaaaatttttttttggtagagatgggatctccttatgttgtccaggctggtctcgaacttctgggctaaagtgatccacctgcctcggcctcccaaagtgctgggattacaggtgtgagccacagtacccagcctctgtacccattaaacagtaaaatcatacagtatttgttttgtctctggcttgtctcagcataatgttttcagtgtttatccatgttataggatgtgtcagaatttccttccctcttaaggctgagtaatattacattacatgtatataccacattttgtttatccattcattcatccatgaacatatgggtttccaccttttggttatggtgaataatgttactatgaactgtaaaaaaaagtaattcaaaatcaaagctgttgaaactttaaattattctgagccttgaaggaaagtaattttgggacctgagtcacttacgggcagctatgaactttgtttccttgattatagattactccttttccccttagctacatcattttgtaaaatgttataaaagactgaagggtgccatagaagttccctttcctcttttctgttgaacttcattatagatgattaacttccctcttccttctcctacgcaaagacctcacgactgtcacattgtccaagatgtgttaaatgtactcttttaaactgaaaaaaagaaaataagctattactaatcaaattgctgtacctcataaaccaaacttatatgggaaatgttgtgattctacctaatttcttagttttctgactataaagtaagaccttaaacttttcagcttcagagcactgaccccatttctttggagcctgtgagaatggccgtcctcagcttcacgctcgaataaacctgttaaactggattctgatcttttttattatttcaggttgacagaacactgtgtgcaaatatctgtttgagtcccagctttcagttcttttgtgtatatacccaggaggattgcccgatcatatggtaattctatgcttcattttttttgaggacccaccagactgttttccgcagcggctctgccattttcccccagcaatgcacaaggtttccaatttctccacacgttgaccgactcttgttttctgtttttttgataacagccatcctaatgggtgtgaagtggtggctttgatttgcctttccctaataattagtgatattgagcatattttcctgtgctgatgagcagctcatgtattttctttagagagatgtctacccgagtcctttgcccatctttgtttttgttgtcgttgtttgtttgtgtttgtttgtttgttttgaggtggagtctcactctgtcacccaggctggagtgcggcgaggcaatctcggctcactgcaacttctgcctcctgggttcaagcaattctcctgtctcagcctcctgagtagctgggactgcaggcgcccaccaccatgcccgactaatttttgtatttttttagtagagacggggtttcaccgtattggtcaggctggtcttgaactcctgacctcaggtgatccacccacctcagcctcccaaagtgctgggattataggtgtgagccaccacgcctggccctttgcccatctctgaatgtttgagtttgaggagttctttatgcgttctgggtattaattccttagcagatctgagagtaacagatattttctcccattccatggattgcctttttgctctgttacagtgttttttgatatgcaaaagtttaaaattttgatgaggttcaatttgcttattttttcttttgttgcctgtgcttttgatgtcatatccaagcaatcattgccaaatccaatgtcatgaaacttccctctgtgttctaagaattttgtagactttgctcttttgttccctctttcttctcctacacaaagatctcatgactgtcacattgtccaagataaggtgttaaatgtactattttattatttttattttatttatttattttttgagacagagtttcattctgtcacccaggctggagtgtagtggtgtgatcttggctcactgcaacctctgcctcccaggttgaagcgattctccagcctcagcctcccgagtagctgggattagaggcatgtgccaccatgcctggctaatttttgtatttttagtagagacaggatttcaccatgttggtcaggctggtcttgaactcctgacctcaagtgatccacctgcctcagcctcccaaagtgctgggattacagacatgagccattgtgcccagccttaaatgtactcttttaaattgaaaaaagaaaataagctgtgatccatttttgagttaatttttatacatggcataaagacctgcattttaagtcccttttggattgctctgctacttgtccttcctccattgcagtctgcttcattcattgtgtctgcagtttagcacaagctctggaaccaaccatatgaatttgagtcccacttccaccatccgctggctgtgtgactatgagcaaattcctcaaccgttctgtacctctctttcctcatctgtaaaatgggagcgttgatcacagtacttacctcatgggtttcttgtgaggattcatatgttgaaagcccccagatggtccctggcacctggaaccaacccacagtgagggttggtaattattattgtccctcctaaaactggattttctcttatacttggtaaactgtacctatcagccatcttcagttgggttggaatggcctgcacaatcccatgcatgcacctgacgcttgcaggggctcccagcttggcagagacgccatttccatcgggatcagctatccccccacaccaatgctgcagctctctggatggatgcaccctgacctcccctgtgttagaggagaggtgggcgtgttgaatcatggaggcagacttcccctttgccgttctcgtgatagtgactgagttctcaggatctggttgtttaaaagtgtgtagcgcctcccccttctctctctctcctgccaccatgtgaagatgtgcctgcttccctttcgccttccaccatgattgtaagtttcctgaggcttccccagccgtgcttcctgtacagcctgtggaactgtagagccaactaaacctcttttctttataaattacccagtctcaggtagttctctatagcaatgtgagaatggactgtctacatgcttgaagcaggaagggagactttcctgtgagctcagtcgatcagcttaaccagaagtgtcactatttttttctttctttcctcatgttataaatatattttacccataatggatcatattggggggttatttggtcagtttctctagtcgtggtatcagcccatgtgtagaggtagggcctttttgaagatgtgagccattgtgggctgagagtgatggaaggcaacccagggtacagggattctgagtgtggagggaagtgagtctgaggagaaatccaaggtgagacagatggagctggcctccacagacctcagtgcaagagtactgggggtgaccacaggcctacagagagctggtgtcttgccagctggttttcagatcaggctcaggtactcatgggcatgcaccctggatggagggtgcccgcctcacctctccacaccccacccagtccctaccttgtgtgccctctcctaattgcaaactcataacatcagggtctccctggagaaacaggtatgatggggagggccctgcacagccctggggttgattgcacagcccataagagagaaaaagcccaaacacgtgaacataagaggtcaagttagaagaacctagagagataacctggcttccagagacccagatatatcacatccatccatccatccatccatccatccatccatccatcatcccatccacctgctcagaagtggtcccagcctatggagggagggcctcatcaatccctggccataacccaagggtggctcaagccccagggaaaagtggccgaggagagcagaacaagttctggcctaaaagtcaagacccctggttcctctttttggctcgccattagctaactacatgaaccagatcatttggcttgactttctggacctcagtctccccacctgtaaaatggggacagttggaccaggaggtggatggggatttccagttctaacattctgtagctgagcctctggcctctgacgtcacaatatggagctggcctcacccagctctgctgctctgttggtcatgggagcaaggtggacttgccctggaccttccctacttgtgctcctctgttatgggcagctcttgccttggctcaggatcaagggtgaacacagtttaggtgtggctgggaccccaagaagcatgggaccagacaaagggactgggtgcggacaggaccttctcagcacatgatgcccatatccttccctgcagatgacttctacaatgagaccgagaccaagatcttcctgcagttttatgaccaaacaggtgaagttgtgttgaacaagttcatggaggccacttggaactatgtcaccaatatcaccaggaaaaatcaggaggagatgatgtgataccacctccaccccagcctctcctctctttgctctttttagggatttgggaccatggggcaccacatctcctgcccccatcccaagcaagaggaacaagggaagccccagtgtacatgtcaaagagggctgcaagctctgggcctcctggaagccctaaacttcctccaggcaagaatctcttgcttcttgtcctttgtaaatctcacctccttgcttttagagatccaggtttctgccctctccctctcagcaaatcttgctccctaagccaatgggattagggagtcagttagggtgccatggccctggaggtcaagtgggacccttcccctgtcccccaaccttggtggctctctttgcagctgcacaaggacatggagaggtcccagttcatgatttactttggcacccaggcccacctgtttaaagtcacccagttcaaggacccggatgtgaatggcatgctgagtaagctgcagaacatagacaaggcggctctgtccaaggacgagctgcgggaggtgatggatggaacccccaggcctttaggcacatgctccctggtcctaggggtctggtaggggagacagagtgcctggggcaggagggaggcagggagtggaggaagggcaggatcagaacttcctctggagaaggagaggagtagaggtgggggtaccgatctctcctggctggtggggcgagcactggggggggacctggggcaccagcctaccctgggtaacacctgtccccccagtataacgagcttctggcctacctggagatgacatacagtatggcccaggtgtgcctgaatgaggggccctgcctgtccctggagtctggtgaacacccaagccctgtcccacccaaccacagaatctccagcactcagtcccttccaggggcccctcccagcccccaaccaccctcccttattgccaggagggtgagggaagaggcaagtgggagtgggtcccccatggctccttttctgggcatagaactcgaagtcatggccacctccagggacaaagaggagctgctgtgggcctggcagggctggcaggatgccgtgggccgccagatctgcaccaccttcgagcactatgtggagctcagcaacaaggctgcacagctcaacggtgagcagatgggatgccacagagcttggagtgatggcaaggaaggggcaaagctgagctttcccagagtgaaggtggccgtagggccctggagacaggacctatgagccctgcagctgggctctccaaatattcatagagcacctaggtgctaggtgctggggaggttctgacgacacataggtgaaaagacaggcacctgccctcatgcacctacggtcctgcagggagacagaccatattcagtaaacacctgtctctcactaccatctggggtgatgcggaataggaagaggctgctgagaaagagaatgagaagaggctgctgcagacaagtggacagggaaggcctctgacatttatccaagacctgaaagatgggcaaaagacgggaagcaagatgtgaaagaagagcagcctaggcagaggctccgcggcaggaggagccggtgctctggaagacctgaaagaagcccaggtggccacagggctaaggatgaggtgggataagaggggactcagggccttgcaggcatggtggggagctcggatcatggactttgctcagtgcctttctgaaatgggcaggtattctccccgttttgccaaagaagacccagacggtcagcgaggttgagtggcttccctagaaggcgtctgggtatcctgtcagctaggccatggctaaagggtgagatggtgagctcctggtgagtcctctctcctgtcctaggttacaaagacatgggggccttgtggcactccaagtatgagtcggataccctggagcaagacctggagcggctattccaggagctgcggccactctacctgaacctgcacacctacgtgcgcagggccctccaccgccactatgggcccgagctcatcgacctgagggggcccatccctgcccacctcctgggtaaaggccctgctggtggccaaggtgagtgccagataagggcagagactgtctccagcctcctcttagcccctctcctcctcttccagagaacacgttggctcagtcctgggtcaacatcttagacccggtcctgcccttcctgaagaagatcccagaggatgtcacaaagatcatgaaagtccaggttagtgcttggcctgtctgtccctgcccctccccactggcatccttggacaaacagggcagcgccccccacaccccctcttctcccatagcactggaagccagagaaaatgttggaagaggctgagacattcttcacctccttggcgctgccacctgccccacccagtttctggaaaaagttgatgctaatgaggccaaccgatgggcgagaggtggagtgtcacatctctgcctggaacttctaccaggacgacgatttcaggtgctcacagcggcaccacacacccggtcctctcctctgccctgtctggctgtcttaggtatgggcaggggaaagccagggcagaggagggagaaggcaagtgagaaacacagaaggaaaggtgacgtgagaggaaagggcttggttgctgggtggatatggggcctggagtaagaaagaacaattgccggccgggcatggtggctcacgcctgtaatcctagcactttgggaggccaaggcagtggatcacgtgaggtcaggagttcgagaccagcctggccaacatggtgaaaccctgtctctactaaaaatacaaaaattagccaggcatggtgacatgtgcctgtaatcccagctaggaggctgaggcaggagaatcactggaacctgggagccggaggctgcagtgagccaagatcgcaccattgcactccagctgggagacacagcaagactccgtctcaaaagaaaaaaaaaaaaaagaacaactgccaaggcctgtctgggctccaacccgaccacccaatccctcaaggagtctgaatggggaaactccctttctccatgctccttgacccatgccctttgcttgtagaataaagaagtgcgcggaagtgaccacagaagacccgctctccatcttccacgaaatgggccattccagtacttcctgcagtacaagaacctctccatcatcttccgcgcaggtgccaacccagcctttgaagaggctgtggggtctgtgatcaccctctcggcctcctcccacaagcacctgctcaacataggcctgctcagcctctagcaccaggactcaggtgatgaggatcaagggcccagcaggagggcagcacaagcctgggaccgcagctagggcttggtggggtcagggctctcgggcaaagctacgggaaggagatcccaggggttgcctcttgactgccctcaccctcttcccagaggatgaggtcaatttcctgatgcatattgccctggagaagatcgccttcatcccctttggctacctgatggacctccttcgctggaaggtctttgacggcaccatctggaaggacatctacaatcaggagtggtggaacctcaggtgggttgggcaccatcttccaccagatgggccatttccaggactttctgcagcacaagaacctctctaatcttccacacaggcactgagcaggtcttttagcctttctaggcttcagtctcctcatctgtgaaaaatggaccctggtgatggccccacctgctccctgggtagctgggaagctcacacaatgattgcaactgagcttctctaatcacagaacactgaccaccaggcaggccctcccaaacctccctcccttcctggtgccaggcaatggagtgtgcgggggcctgagcactttcctttctggggaaagactccccatgggagagaggcaggcccctaaaatgcacgcatgcctgcctcgggcttaacatccccaagctgccatgggaacccaccagcagttgggaggcatcactctcgagtgagggacccccgtgttacacctcatcactgacccctggccatttgatgggataataaatgcctgtgaccagggctcctccatatgtggcaggccgcggactgaccagcttcagtctgctggtcatagtgtgattcggggttgccagggggtgctcctggctctgcaacaggctcttactttttttgtttgttttttgagacagggcctcgctctgtcactcaggctggagtatagtggtatgatcacggctcactgcagccctgacctcccagcctcaaccaatcctccttcctcagcctcctgagtagctgggactataggtgtgcgccactatactggctagttttgtgtaatttttttttaagagatggggttcgccatgttgcccaggtttaaactcctgggctcaagggatctgcctgcctaggcctcccaaaatgcggggattacaggcatgagccactgtgcccggcctcttatgtttaatttgaacatttacaaccaccttgcgttgtgatcacttcaaagcgctcagctcacagaagcaacagctgaagctcacagaggtcacaaaccagcccgaggtcacacagcaaacgagcaggtgacagagctgggagctcctccccttgtcctcttactcccacccttgacttcaggagcaggtctccctggtgggcttggcagagtcttgacctcgtgcctctctaaggtcaccctcataggccatctgaggcacctgcaggaggcctctgtcagccctgcccatcaccccagctgatggaaccctggggctaagcaggaggggtggcaactccctgggccttgaataaggccctgtcaactgggagggaagctcctgacactctgttgaccttggagatggttcagaggctccagtgagccaatgatgaagccttgtttttgagacagggtctcactctgttgcccaggctggagtgcagtggtgcaatcatggctcactgcagccctgacctcctgggctcaagcgatcctcctgcctcagcacctgagtagctgggactacagttgcgcaccagaacacctggctcatttttgtattttttgtggggacagggtctcactttgttgcccaggctggtctcgaactcctgggctcaagcaatcctcccacatcagcctctcaaagtgctgggattacaggtgtgagccaccacacctggcctacttccttccattttatagacattttacaacaagactcggagacaatcagcaactttcccacagtcgcacatctcagaggggcaaaaacagaccttcaggttatcagggtgtgactgtgactggctctgtgtcctgaggccaattccctgatctccaaaccttggtttcctcatctgcaaaatgggaataatagtagtactgccccacagtgatgttactcttttttcttctcaagacttcttactagatgaaatgaccttgtttattggtctataatctgtcccccactgttaggatgcaagcaggggccttgcctcccccgctcccccactggtccctcccccagagaccaggacggtgttgagtgcatgatgcgtgagtctatgtggagagccagacatggttctgagcatagaggaagtgttcagtcagtgttaactgctattgttttactctgattcccaatcccatgtgttttcatttatttaatcaataaaaatgcattaggtatcctcagcctgccaagtccagttttgatagacacgtaggtgctttgaaaagaaaaaggcaggccaggtgcggtggctcacgcctataatcccagctacttgggaagctgagacaagagactcacttgaacccagggtggggaggttacagtgagctgagatcacgccactgaacttcagcctgggcaacagggcaagactctgaaaaaaaaaaaaaaagaaagaagaaaagaaggaaaggaagaaaggagggagggagggagggagggagggaaggaaggaaggaaggaaggaaggaaggaaggaaggaaggaaggaaggaaggaaggaaggaaaagaaagaggctctgagaacctgccagacaccaccaccaagccctctgccttttccctgccaggttgaaataccagggcttgtgccccgctattcctcactcagaggaagactttgatccaggtgccaagttccacttttctgcaggtgtgccctacatacggtaaaggtctgggccctgttagcagtgccagtcctaggagttgaggggcatgggaactggggtgaggatttgcaggaaggccctaggtccaaatgtcaccctgtacccgtgcccatctcttcctgttgggctgtgcagccttctgaggcctctgacctagaatcctttgagcttttgcatcaggtccagtgtagagggcagagctgatgagaatattctagaccatccctgctgtcccttggaggagagcaggtcagaggggggcaagggttggggtgactgctggttcagaaagctagagaaggagagccccccagcactctagggtcagcccaagactgggccctgcccaaggagcctccgctcaggcagtgactgctgacatggggccctcgtggccactgcatgtcagagctgcctggtcccaagtggctctgagtttcccactcctggtctccactccccagcctgccctcacgtttctcaaccaggtacttcctcagtctggtgctccagttccagttccacgaaacactgtgcaaagcctcgggccacatgggtccactgcaccagtgtgacatctacaactccaagattgccgggaagctcctggggtgagtgccctctccttcatttgttctgggctcccccatctccctttaaggaagtcctgctccaggctccctctccacacctgactacactagacaccttgagcagagcttcattaagcttatattctagcggaatttcttcctcatgtcagactgcagtctttcctacattaatcagagcccatttcctcttgtgtagccttctgtgttcagagacactgcttaggctgggcgcagtggctcatgcatgtaatcccagcactttgggaagtcgaggcaggcggatcacctgagggcaggagtttgaaaccagcctggccaacatagtgaaaccccgtctctaccaaaaatacaaaaattagccgggcgtgatggcaggcacttgtaatcccagctacttgagaggctgaggcaggagaatcacttgaatgtgggaggtggatgttgcagtgagccgagactgcaccattgcactccagcctgggcaacaaggtgaaactccatctcaaaaaaaaaaaaagaaagaaagaaaagacaatgtttagcccctcccactaacacacacacacacacacatgcacacacatatgccagtaagccaaactgtcccagataggaagccagcactggggttctacctcaggcttcagccttccgtccgaatcccccttatcctttccttacaaggtgctgacctaccctctcagcagcacttggcacacccttcagtgcagtctgtttctcccacctcttcttggaggtgcccaaatccagttcccaggctgatccaggttactttcacagtagcctcttggcatgcttctggtcagcctgtggtccactttgacccttgagtctttttctctgcacttggtgtttagcttattctttccatgcttacctatgtggcagtggtttttagtcccaaagcaaaccctgagggagtaggggactgaactgaaaatgtgaagcatttactactacaggaggtgctctctgatgagtactcttacagtgtttcatattataataatagctcttaactttgcaaagtggatattattatctgccttttacaaattatgaaactgaaggcaagagaggtggtgtcgttgtgcatcattcatctagcaagaagcaaagtcatgctttgaaaccagaactgactccagaacacattatctttcaccctgttcgcctccatcattcaaagaatacagcccctggtgagcttagatccaggtctaactggttccaagatcagcactccaaccttggagatgtggagctcacccaccgacttgatcattttcctgttgaatttcaacggatttcaataggtccatttccctaattggtcaaggtcatcttgagctttattcctgtctcctagaggattaacactgccacaaatttagtatcctttgcaaatttaatgagcatatttttgattccaccatgcaatttatctgtagccaccaggccagatggggtttcaggactgatcccctgggctttgctcctagggagggctgcaccttgcatgactgttgtctccctagtagatttgctcttccatcctttcacgtctcagggctttattctagctgattgcccagctttgagcttttctgaacatgttgaacataagggcacctctctgctctttgcattcctatctctggctgcctgtcatttattcattcagtaaacatttacttgtcctcatgcagaccagctgctctgcatccaacaggggtagatgaaccacaggataaataaatttcatggccgggcatggtggctcacacctgtaatcccagcactttgggaggctgaggctggcggatcacctgaggttaggagttcgagaccagcctgcccaacatggaaaaaccccgtctctactaaaaatacaaaaaattagctgagagtggtgatggttgcctgtaatcgcagctacttggaaggctgaggcaggagaattgcttgaacctgggaggcggaggttgcagtgagccgagatcatgccactgcactccagcctgggcgacaagagggaaactccatctcaaataaataaataaataaataagtaaataaataaatttcataataccaggcaatggaaaggggctttcgtgaacatagaaagaggattaggaggtcatgctgggggaccaaggagggagttttgtcctcaaatgcaagtgtgcaagaaatagcagaaagcaggcatggtggctcatacctataacctcaaaactttggaaaagccaagatgggaggatcccttaaacctaggagtttgagaccagagtgggcaacatggttagatcctgtatctacaaaaaatgaacaaaatttggccaggcatggtggcacgcacttgtagtcccaactactcaggaggctgaggtaggaggatcacttaagcctgggaggtcgaggctgcagtgaactgagatcacaccactgtgcttcaccctcggcaacagagcgagacccccgtttaaaaaaaaaaaaaaaaaaggagaagaagaaagagaaaaaaatagcagatatctgttttcttttcttttcttttcctctcttcttttcttttctgtttttgagacagtctcactctgtcacccaggctggactgcggtggtatgatctcgactcactacaacctccacctcctgggatcaagcaattctcgtgcctcagcctccagagtagctgggattacaggcacacaccaccacgcctggttaatttttgcatttttagtagagacggggttctaccatgctggccaggctggtctcgaacgtctggcctcaagggatccacccacctcagcctccaaaagtgctgggattacaggtgtgagccaccacgcctggccaagatatctgttttcttttacatcaactcacctctttcatcccacctgattggtgggatgtttgacctcagtcattttcaccacttcccacgctcaccccactcaaggtgcacagggctctcagggtctgacttggcaccaaagcatgtggccagtgagtcatctcttgtcattgctcaccagtccctgtgtgtccctggccagactcctgctcagggaaaatcctgattccaggcttaggacttcacataccattttgtgagccgtgggcagaggaaaggtttctgagtaaggaggatatcatgacctttgcagatgatgaaatagcagcagagccgaatatggtttgtggaggggagaggggatgtgagtgcttgcagggggaaaagagaaagattcttggctgctcttttgcctaattgatcttaaaacttggttttgctacttttgattcatcctcctaaatgtgatggccctgagtcaggctctgggctgcttctgttgggaatggagggttgaattgggcctggtcaaagttctcaaagtcacccagcttcaccccaccagccatggtgcgcctgaccttgtccatggggtgtgttgttgtcactttggagttgaaagctccaggcagcatctagttgtcatctctgctgctctctggtctcatgtcctgtccacatgggctgttggctgccctttggtcaaacatcttgtcccacccagcctgaaggactgtttctaaatgggtagattctcaatggttgaagcttttcccctactaggttcttcctcttactcaggagccagcatcagaacctcttacctagagttagttgtggtttttcttctccagtggtatctgccaaggccccactgacctttggtttccctaactctttcttttccagttgtttattaagtgatgcgcataagcctttgcaagctacaaaccctccttcatcattgtgggacttagtcctcatcacaatgagggcaggtattcatggctcccattttactgatgaggaaactgaggccgagagaggctaagttgtctgcttaaggttatgcagtccataagtagcactgctaggtcaggtttaagcctgggccctgttagtctagactctagatcgtgacctctgggcctctgggtcccaagtctgtcctgagagttggatcaaggaacaacaggttgtgaaggataaacatctgcccaccactgcctctcctggggactctggagtggagaagcctggagccctggcttcagcacaccttatactcccattgtgagcccaagggacctagcataaagttcaaccacctgcccctaaggaccgggtgtgccgtgaaacacagctgacatttgtgcagcactacaggtggtgtgcggagcacctcccatgctcatgatgtttctaatcctcccaaaccctccctgaaaccagaaaggggtgaagagctgccactatctaccaacaccgagcacctcacgggaaacagtgtctcaggactttatgcctatttgagtccaggagaataataatcatcacagtattaccagtagtactaggaatcatcatcatcatcagtagttaacgtgtattgcctgcatgctatgctcccagcaccgtgtttatttaatcattacaatggctcttcgaggtagataccattatcatctccgttttatggatatggaaactgaggctcagaaaggttacttgcccaaggccccacagctactaaatggcagagctgagattcaaacccagattaatcttctttcaaacttgtgattgtatccactatgccaagctctgcgggaaagttctggctggccaatcgctggggctgggattgggtgcactgggggtctcagctgcaccagctgatgccctcacacagcctcacagctgcacccactcccctagggatgctctaaagctgggctcaagcaagccctggccagaggtcctaaagatgctgactggggagtctgaggtgtctacaaatgtcttcatgacctacttcaaacccctactgacctggctggtgacagaacatgcagcaaggggacatcttaggctggccagacttcagctgttcctttgaaggtttgataatctgaccctggttccagctctgggccagccccaggctccaccttaccctgctctgtcctagtacctacccctacccagccttaacccctggctcattcatgacctggcttgaatcaacagcactgctgctgtgggaccctgtctgtaccaggcctgatgcagcttcagccaagaccaccgctcccaccacagcccctggctcagttgcttccttgcacactgtccagctaggttgccaggctgacatctgagcaaaggatcagcatcttgcctctggtcccttgcatgcaggggcatgtagtccaatcagatctcctctgacagccacaggagaccccaggggtccctctccagttctacccaccctatgagactcctatgtcttccacagaaaaagacacagacaaagtgacattcctgagtctgaagctggaccccaaccaggctaaatttgggtactgggtgctgttggccctgggctttgtcatgtctctggtggtgctggggctggcctgcaggctgcagtccctggaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcacacagtaaagcaggaagcctccaagggtaagagctgaatggtgaagttgggactagacaccagtgaactggtgaggctggggggcaggaggagggaggctgagccagagagttggggggcagaggaggggacagcctgcatgcatagtgcccaattataattgggttcagctgtggcagatctgggtacatgtgatattgtaattgtgtgtttgcaaactcatgtatgtgaggctgtgtgcacaaacaactggctctatgtgattctatgtgtgtcctgggtttcaggccaaactccttcccctggtggctcaggacctaaggttttattgacccagtggctgtgtccctgcaaaccagcccccaccccaagtcatgcccagaattggttctgcacacagccttgtttttttcagtaacccggctatgggactgcagtgcccaaggaatttctgctctggttagaaaaaggactctgcttcagtccacttctgctctggttagaaaaaggactctgcttcagtccacagtacataaaatgtactcaggtaggacaggacattcctttacgaatcaccagtgcccagtttatgagcactgtgcttttataccaaccagcacatctttctgctaatccttgggccagccctgtgttggactacataatccagcccccaaaagctctttgttgaccagttgagatgtaagtagcctcacaaactgccccatggctctctctgccccagcccaagcccttccaaatggagacagtgggttgctgggcattgagccaggcttgattaatgattgacttctttaatatttaaacaaagctcatctccaaccactctgctctggagatggccttgttcaacacacacacacctgctgcctggcccgttgccctggggagcgagcataggacaaacagcaccttttcaggctcagtgggggatggggaggacaggaaggagggaactgtaggagaatacttgggaaattagtgctctagaaacaagcctggggaaagaacgggaaggcctctgcctctgcctttcctagttcattatcctcagcctgggtctgcctgccatgaggatcctacattcaatattggggattcagagcgtctggatggaggttgcatgggctcctggggaggctgggagtcagtgtctgtcagagaatagggaaaacttgaggggaaagggcattatagccagtaactacagagaaggggtaccccggctgcaactgagctggtgggagggtggccaaaagaggagaccaggtctctctgaattaagaatctgagccccaaactcaggtgttcaggggacagagatactaggctgagatctccatggaccctgcccctgtccaggtttcaaaaggtctttctgagatctggctgagcccaagcacttgctccagccccaggctccacagcacccttgtttgatgactctgtccctgctcttacttttctgtgccataatgtccttatttgtccctattactagctatcagctctataagagctggatgcacatcaggagtgtgcccctctgtaacaactctagtcagcacaggccatggtgcacaaaagggacttggaaaatgatggaatgagtaagtgaatgaatgaatgaatgaatgtcccactgcccaagtccctcctcagagctcagcaccccatgtactgagctcatgagaaatagccccttcttttcctccacagccagcctgtccaacagaggggcagccaggacatctctgccctcttctcatcccccagccacagtggccaaagaggcccccactaggcactgtggctctgcatgacaaacacacatccagcccaggactctaagcctctcacctggactccagtaaaaaccttgctgagcctccttgtctatccttcctcccccacccaccattgtaaagtttatgtcaccagaatatttctttcatgtctaattgcttaagaacttggttgttcatcaattaaatctagatgttcaaaatggcatctgagggtctttattaattacctccttcctccaaactcacctctcccacacccccttgttccccccaccccagcccctctgcactgacatcacctttggcctttgcctaaggtgcatgccccatttgaatgcttgccctccaagatcaggctcaaaattgctcaccaaaccctctgcagcactacaagcccacccagatgctcagtgaacagtagtccccttctccccttcctctccaggaagcctctttcaataaacctattcccacccccatttgctttttctagtgtgttcattttcagtcagtactcagtactcagacacttttatcagtggtcacttgctaataggtggttttaaatctgttctccttccaagatgtacctgtatgctaagagctctcaggcctctgaagaaggcatcttattgcatacttctttctttctttctttttattttcagatggagtctcgcgtctcgctctgtctaccaggctggagtacagtggcgcaatctcggctcactgcaacctccgcctcccgggtacaagcgattctcccacttcagcctcccaagtagctgggattataggtttgcgccaccactcagctaatttttgttttttcagtagagacagggcttcgccatgttggccaggctggtctcaaactcctgacctcaggtaatctgcccacctctgcctcccaaagtgctgggattacaggcgtgagccaccgcgcctggcccttattgcatatttcttgcacgtcttcatgtgtactcctaccccctcctctcaggaccaggccctggctggacttggcggcaggagctctgcatgggacctaggtctcagctgagctggagatcacttgctataagagcaggccagaggcctaatggtatcattgccagggtcgggcccagtggtcagacccggaagaaagctttcagccaaagaccacctgaggcccctaacaaccccatctgtagcccccctcctgcctgggaaactccctgcactgggaggggagactgccctttggtactgggagggaatcggagaggtgctgaggccattggcccttaggacaggaacagaagcagctcctcagagaacacctgccctattccagggccaggaccccagccccgccccgccccgccccgccccgccccgtaggatgcaaggccccgccccagccccgtcgggtcccagagaaactgccccgcccagcggccccctccccgccgccggcgcgcggcttctttcagcaccaaggcgtggacagctcccgggccggcgcagaggagaggaggccaggagggcgcgggccagggaggcgaggggagggcaggggagcgcaggaaaggaaaggagaggtggggcaggggtggggaggggagggcagacgcaggctggcgggcggggcgcggagcccggcggccctccccgggggcggcgcccaccggagccggacgctgctgagcccgaggacagacggagacgccgggagccagtggcgcctgtggctccgggcaggggccgcggccgaaagatgccggtccgcaggggccacgtcgctccccaaaacacttacctggacaccatcatccgcaagttcgagggccaaagtgagtgtgtgtatgttggggcggggggacgatctggagtcctggttccgtgaaagggggggctggacccctttactaacttctaaccgggcaaggtggtgagtgccgggtgctgaatgaaaaatccttcttttgatgtccccaacaccttctcctccagggggacccgcttgccttaaatgctgtcctcttttctggaacacaaggagcagcgtgcaggccttccctccctactgccagctgtttccttggtgccccaagttcgaacctccccttccagccactgcctgccccctcatccgcgtcctccagaggcttctctgagtccttcttttccttccttttcatatcctggttctggtcttcccaggagctttcccaggcctgacccccatctggtcacatccctgcctcccttccccacacttttcctgtttccaggaggccttgggccttccttccacctcaagaccctcactgccctagtcttcccacaatccccaggcctgactccctccctcattccggtcactgccctgctcctctgcctaaattccccttactgccaccaagagtccttatgatctttccctcccagccgctggatcctggctcccatggactttttgcctcccacctcccaccccaggtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatggtgaggcatactcaggccagaggctttgcagggcaggcttggccctctgtcttgtccagccagggtggccttggggaaggcactgacccagggtccaaagggcctgaacaaaccctgtttcttctaggggccttggttcctccacaggcattggatatgatgccttctgaggtcctttgcaggagctagggatcaggctgggccacccactggttctggcctggggcagggcctcctgctctgccatccctctgctgtgtccctggtctcctggctctccactatcttactgtcagccccagcggtcaggcagctgggatggaaattaaccttccctcctctccgtctgctccaaggattagaggaggagtcacctcctgaagacctctgtggccaggcaaggcatgggggcttttggctggcaaagtggggtgggcctgccttatccagtctcagctctttggggagacagggtctggagttttccctgaccaagaagctcattcagatggagtttgggttgttactgccagctggagcatactgcaagcagaacagaagcgtaagtcaggagctgaagacagatctcagcagcccttggaaatcctcccccaccccccaggaccacagggtcctcactggacctggcagcatgggtgggaacgaggaaaagagcctgaatgtcctgggaaatctcttgaatcaatggcccccaacctggttctgcatcagaattacccagagcatgttttccaaaacatgctttctctacagagaggctgactcagaaggtgtgagatgaggccaagcgggtgtatttggaaatatctccctggtggttctgatgtcctgcttactttaggaaccactggcttaggtaaatcccttcatttcatagatgtggaagggatttgcccaagatcccactgctagagtccaacctgggactggaacccaagtctctggattcctccctcggagatttcttttgagtaatcccaagaggagagaaaggaccccagctgcctttgtgtttacaggcaggatttctggggaaggaggtgctcaggggagagaagtccccagggaaggcaggcatgaggccacctgagtggagataaagaatggatgtctctggatcgggaccgaggagtgctgagagaccaggtttcaggggcctggagtgtgtgaaacatgagcatgtgtgtgcttgcatgtgtgtgcctctgtgtgtgagtgtgtgcttgcaagttcacgcctgtgtgtgtgtgtttgcaggcttctcagagttacagcttctcgggtaggtcctggttgttcctgctgctgccacttgagtgagtggcagtgggaagtgcaacaggcagcggcagccaggaagggactgggaagaatctggcttagtgtggcagtactcacagggttaatgaactcagaatatttttaaaagctgtgacctcacctcctcacatcattgcagaggagaggtggcagtcaggggagtgagaagggtcctggggaacaggatgggacagcaggaaatgggggttacagcaggtcctttcttttcctctccttgacactagagctatacctgatcccagattcctagggatgtcaggtgatggctcttgaggtcccctcagcaccctgaaggtgtctgggcagagggcagaagtcaaagcctggccttggccccctgagatcaggactcagatcagaatcctgtgggagtcctcaggtctcagaagggaacctaggaaccttgtcttgggggctgaccctcggtgaaaatgggaaattgcccacatacctggtgccccataagtcccaatctactcccatcccaccctcggcccttccctatcttattgcccaaggctttgatttacctggaccttcctgaaattgtcctgaaacccagaaaggggagcttcctggcctgcattacactaagggaaggatattgtgctcagataactgatgttcaccttaaggtccactctgacctcatataatcctttttttttttttttttttgagacagggtcttgctctgtcacgcaggctggcaagaacatagctcactgcagcctcccatcccagcctcctgagtagctgagactacaggcgcgcaccctcacacccgactaattttttaattttttgtagggatgggggtctcactatgttgcccaggctggcacatgatccatttttgaccatattcatgtacacttacagtcctgctgaggggcatcctaatggtgatttctttcctcctcgggtcagtacctcccttccccccaacccccaactccagggaggtgggaaggggtcctgagcagatctctagctgatttatgtataatcctcttttcctctaaaggggtaatccactgaaaattctcgaagtcaaagtggagggtttgtgttcacatagctccacgttgtgcagctacagacatttgggctcaaagaggccagggcacttggcaaaaataccccgggagacatctcagagacccctgggaaactggctcttcctctatttgcctttgctaggagtggtgagaacctaacagataaggaggaatggggatgtggcaggactagaactggtgagagtttggcaggaagaaaggagagcactcagatccccccactgtcacccacgcctgccccgcactggcacctgcccgggagcccaccccagcctgcctttcctgggtcctcttctctgaggatcccgaaccagagagtcccctaatccccaagccagatcagaggagtcctgggacttctccagtcctcagctcttgatgaggaggatgggacaaggggctgctgtctgcccccaccctcctcccatgtttaccatatgcacatctgtgaatgccaggaggaccaagctaggaggcagcatgcagcggccaccctctcagtggcagctttttggctttttgtagcaccagcctctccctggggactcaccacagtgctggatggggtgtgcatcgggagacagaggtgaagacaacaaggaggttgtgagtgctgggaaactgaacgaaggagcacattcaagagggagagaagaggagagagaattggggtctcccaggggagagaagtggggtgcctttgctaagaaaagtaagaacctagcatataagaaggaatgggaattcccagggggcagacaaacctgctgcccttggtcagaaaggtgggtgctgggaggagctcctgcaaggaagaagcaggcagagactgtggctcctcctccagggccctggtgagggcacaggaacaccatccctcctgggcataacctgagatggtacagttacccacttttggtcacctagatgtgggcttttgttgtgtgggggctctgagccacgggtaagcaaggacaacctggggcagggggagagagaatgctctggactcttccaaatcctcctagcctcctgtctgcctacccaacaggccacaggcatgggggcagggcatggggtaccacgcactggcaccccaccccagccccagacctcactgctataacgggctggtctttggtccattcccagccgcagttttccaattgcatcaattttccagtaacatcaattgctgggtgcagccacgccaagactgtgtattgacagcccccagcagcttagagagccctggaggccttctgcccctctgcccagctctgccctctccctgccccctgccaggacagatctctgcagtgccagagagattgacaatataatctggccttaggagcagtgtccgaggccactggccaaggaggctccctgtctaggtcccagcgtccacgtgtcaccatgccccaggctgactggagttatgggcttgggcctgggagtctgggcctatagcactatgtgcccaggagtgggtgaagcaggcaggcgcctctccccagtgtgggtgtctcccctgggcccaggcagcagatggtagatggctgcctggtgcctgggagtccagaaatccaatacgagagattcctactccccagggaggaaagcgagagggaggatatgggtggctcagctgcaccccagctctgatggctgtgaggaggggctgaggacgaaacaaggagtctggtggagagtcattccagtgagctccacagcagtgatactcccaccagcggccggcctgcgtcccccacacgtgggcttccatacattcagtcaacaaacaacacctgggacaggtgaaacagagcctaacctgccctcagggagtgcagctctgccttctcatctgcgtggtcacctgaggcccctgccccctgaggatcctgccctttgggcctgacatctgccaacagtttgagttgagggacataggactcccatggagagggtgctcgtggggtgcctggcctggggctcttgggtatggggtattttgtttgtttgtttgtttgtttgagacagagtctcgctctgtcacccaggctggagtgcagtggcatgatcttggttcactgcaaccttggcctcctgggttcaagcgattctcctgcctcagcctcctgagtagctgggactacaggtgcgcaccaccacgcctggctaatttttgtatttttagtacagacggggtttcaccatgttggccaggctggtcttgaattcctggcctcaagtgattcgcctgcctcagcctcccaaagtgctgggattacaggcatgagccaccacgcccggccaggcatggggcattttagctggtattgttccatccaccaaagggggctgcagccagaccctggaggggcagagtctacgacctgagaggcacagagcagccagccgctgggtgtgggctgcccaagataatggggaaggtggccagaggggcctgccctgcccccacagggccatcctcctccctctgtggtgcccaggccactactctgcctgctccctgggcccagccctgccttgggaccccacactcctcctaggcccagagcagcagcctggttctggccccagcactctcctcccaaacaagtcccttcccttttccaagctattgtgtcctgcaaacccagggatcctctctccatgctccctcccagcccttgaaagtcagtttctgagaacctcaggctctcttctgcagaatgggggtccatgcctgccccccaaggacctcctgaggccaaatgttccaactggccccatgcccagcacttagtgtactttcaacaacaaattcctccctgcatcacaggagcagggcatctttgcaggatgggaatatgggaagagcgcccagggccaacccagctccatggggtagaatgcccagcctcacctccccacttaatccacccccatctgctcagctttaattacagcagaagcagacctcgaggttaagctctgagctgatggccgagcgtggacttgggcctgatctgatgctaccttatctcctaataagcagcttaaccgctctccccacctctgccctgtgggtggagcaccagctgagcagcctcacccaccctctgcccagtatctctggtcactgtccaagcctcttcacccgtggctgcccttcacttgaccttcactcagccccttccctagccaggccactgcaggaggggaccccttcagggcccaccccccatcctcccaatggtgttcgcagcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccggtgaggcagagtgagggtggtggtgggagggacgcatgagggtcccctggccgtggctgctctgactcctggccctggtttcagagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtgcgggcctgcagagcagggtgtgcagagctgtgccaggcctccagggtcccctcccaggctctgggcccaggcccttctggggccttggccgataaagagatcctgcctgtccagcctctaatatctggtttgagccccgggcctcctgtcctgtttgagacctaaagacctgaaggcctgccctgaggtcacagcccttgtgcccagctcctagagccagaggaggctggggtcagtagggcctgtgaatgatgccacctcctaggcctggagaagccagggcaggggatggacatggaggccaccatgggggcctgaccaaggctcagcccgtcacagggaaggagaggcagagaggagacatgccaaggccatactgagaggagagctggtgtgggggggggtcccagccctgtgccagccctttgcctttgagacaaaagccaccctccctacttccttccaatgtgaacacaggatcctcctgcatgccaggcagggcaggatgaggctggcacctccagctatctttaatcagcttcctgggggccaggccctgaaggaccccggcagctcctccttggccaccccaaggcaggcttccctgggttctctgctccagctcaccctgctgtcccttctcatgaggccggaagccctgaccattccagagggaaatgcgaggagccctgcccgaggctccagtgaccacagtcctggcactgactccctgtgtgaccttggccaggggaactatcagccccctttctaggcctcagggctttcatctgcaggagagagatggactaaatggtctctggggacccatttgacattgagtagttctggccccaggaggcagacaaagctgtaagtcatagccaggggcccaggccaaggttgagcaatgcagagcatggaggggcctgctcccagctttcctggggctgtccctgtgttggggctggaggcagctcttttccccctgcctgttttcacctaaagcacagttgctgctggaaccaggtgtggggaagaccactcagcacctcactgacctcaaggatcctgaggagggtgggacgccaggctgcaggactgtgtcctctgaggtcaggcagagtggcccaaaggcctgaccctgggaagccccccagctgcttactccaggacatcttaggttgatgccactgttggtggctaccacggagggggctgttagactggagagtggtcggtaaagacagccaggcctggctgggcccatagtcccggcacctgcccaacctgcctaccc

SEQ ID NO: 405 - DNA, 173535 bp, Homo sapiens
ctcctaaagcactgggattatagacgtgaaccaccacagctaccccgtggttcttaaaaaggggtctccttaaaaaggaagcttcaccttcctttttggtgtgagggagacagaccgtcagggagagggcactttgttcttctaattgcctttctgcagaggttcctgctcaaggaacgggacgcctaaacctcaaatccccagtggcattcaaggctgctcgcaggcacagggcgtgttctggccaatcctgttcgagcaaggggagctgacattggcccagcacaggcaggctgcacagagctgcagcccattcttcctggaagcgcctgcatcagagccaaggacaggccacctagtagcagtgtccctggagcctggtgcttggctcagtacattaaaatgcaacaaccaggccgggtacagcagttcatgcctgtaatcccagcattttgggaggctgaggtgggcggatcacttgaggtcaggagttcgagaccagcctggccaacatggcgaaatcccatctctactaaaaatacaaaaattagctgggcgtggtggcctgtgcctatagtcccagctacttgggaggctgaggcaggagaatcacttgaacctgggaggcagaggttgcagtgagccgagatcgcgccactacactccagcctgggcgacagagcggggctccatctcaaaaaatatatacgtatttcacagatacagtccttcctcgttttggtaattgacagagcataagcagtttttaattttttcaaatttacaattaggctcctgcacggcaactctcttcctgtgaactgaagggaaacttggagtctccctctccacagggttctcgtcttctggaaaagagaagatgggaaaatgcggataagaagagggttagaggggaggaaagaaataaaaaccgagcaatttctagaaaacatgatgattaaaaaaaaaccatccacgcttttggaatggacggattctttaacacctgtggatttccttattctgtgactagcaagctcccaagcccacaggtaggaagcttcagccagtgtgtgtggaaaaaacgccggttttgggatacgacggacaagtcagaagcctgcttgaaccgccgtcacccctttgcagccatccaacaccacgaacagcaaaaacatcaggttctggcaacctgtggggacaaagtgaccatcagcacggggaggtcgctgtcagagccgcgtcacagctcttacgcctcccagaatggtttttggtgtgaggattgctgcatggattgagaaggtggaatttgattggaataactggatcatctcacggatggctgaatcctaaaatgcctacaaagcgtgaaactgactcaggatttcacagaggatggtaaggctctgatttttccacttggcactcatctgggtgttatcattagcactttggtttaatgctgcagggtgaggaggatgtacccagaggccccactgacgcaccccgtccagtggcttctgacatgcagagctgcaggacgggcgtcgctgagctggccggggcaggctgggagctgagctttgcagacactgggtcctggtgaacgacgatgcttcgacatccactcttctgggcattcccagcctgtcctctgctctgtccctgccctcccctaattccaattggtgggattgggtggggctctctgggccccacactggtctgagagcctggcgtgctgctgctgggccagcccaggagcgaatggatgaagttcctctttctgagccgggatcaggcccagaactcccagctcgcagctcgggcagctgcctggtgctgaaaccagaagggacctccgggacttagtggcagcttacagggaatggctaggagtgtctccctctgggccagtgagtagggtccagaccaggaaaagcgtcagaaacggaacacgaggttcaccaagaagccaagggggccggctgagggccagcatcgcacgttgatgctgggaggttgctgctttgcaggagtaagggaaggaagaggccatctcagagcagccgcaacactggagtccacacaggggagctcttggcagagccatccacagcgatgattactgtggacacagatggggaggccctgtgtgtgaggcagtgacagagccattggttgggaacacagccaactcttttggagttttgttaactatcccgaggtagaggctgagggggacacgcctacatgtcatgccacaaacttagcgtactagaacatgctagattttctctcaaagcacgcaggtctgagcctgtcatcattctgccagtataacagacaggtgaatgaagagacgggggaacttggaaatgaggggctgaaaagaagagaaagtggaccctggtactggctgtgtaagaaaagtaaatagtgacccagaagaatttgggtcacggtctgattcatacaataaattcattttgtctcatttgaaatattttaggaaaaaggcatgcttttatccaaaattacgtcaaaaattgcctcaaatgtctctcattaaaaaaaaaaaagtagttggaccaggcgaggtggctcacgcctgtcatcccagcactttgggaggtggaggagagaggaccacctgaggccaggagtttaggactagcctgagcaacatagtgagacctcatctctataaaataaatacataaaacagttgcaccttatcttcttagctcttaattgaattaatgtcctgaaagttcacataaatgacattcttcaatattcaaaaagaagccaaaacaaaacccagtctccaggcatcaggttggatgaggactttagaagtctacggatgtccttcatttaggtttgtttgtttgtttgtttgttttagacggagtcttgctctgttgcccaggctggagtgcagtggcgcgatctcagggctcactgcaacctctgcctcccagaggttccaagcacttttcctgtctcagcctccagagtaactgggattataggcgcatgccaccacgcccagctaatttttttgtatttttagtagagatggggtttcaccatattggccaggctggtctcaaactcctgaccctgtgattcacctgcctcagcctcccaaagtgctgggattacaggggtgagccaccacacctggccaaaatttaggtttttttaaagcttaaaaaaaatgttttggggtcttgctctgttgcctaggctggagtgcagtagtgagatcatagctcactgcagcttcacctcctgcgctcaagcgatcctcccaacgcagcctcccaagtagctgggatcatatgtgtacaccaccgtgcctggctaattttgaaaaatttttcgtagaaaaaatttctacaagattttttgtagaaaaatttgtagaaacgaggtctcactatgttgcccaggtctcaaacttctgggctcaagtgatcttcccgtctcaaccccacaaagtgctgggattacaggaatgagcaactgcacccaggcaaagtcatattttttttcacctgagagctccaattgccacgaaaatctcaaattatattctatgataattcaagttaaatgggcaagtaatatttcttttctttccttctaagtgcctgaaatactagaaatacacaataatggcttttaaaaaactacctaacacaataaaaaattgtgatagaatttattgtgtaatcaacaagttagggaaaactgattttgcattaaaggaacatcttctgtttctgttaaacagcaggaaggacaagacaccagcgcaatgagctttttttttttttttggggggggatggagtctccctctgtctcccaggctggagtgcagtggcatgatcttggctcactgaaacctctgtctcccaggttcaagcgattctcctgcctcagcctcccaagtagctgggattacaggtgcatgccaccacacctggctaatttttttttttttttctagtagaagctggatttcaccatgttggccaggctggactcgaactgctgacctcaagtgatccgcccgccttggcctcccaaagtgctgagactacaggcgtgagccaccgtgcccggccagcaatctgtcttttctatggaggcacaaatgtgcagcaaaccttgcctctcccctatgaccatttggataatttggttactctgtagacaccgagttgaggattttcagagatcaggcttatttgagcaattaaacatttctccattctaagcatacactagataataaatattccacacataatttaagcaatgaatcttatgaaaagagcgacggagggagaagggggaaaatacatttttcctcgtggtcactttctgaactactgtctaagcctgacattaaactcacaccctccccctccatctgggttcttcgttctttccttgaaaaggaggaggaaggaaaagaaaccgtttggctgtaataccgcgctctgtttctggctgttaccagcaaaaacactgtggccaatgatgcccagttagaacctgggctttctaacctgataaacagaaaagccttctgccaacacttcaatggggcatcctgaggccagaggaggctccaggggttttcagctcgttggcagaaaagcatagcataacagcagactatcttccaggtagaggcatatttgcgtatgtgaaaacagaatttactggcggaaaagtcattctcttgaagtcaaagcagtgcctggtgatcttgttgctgaaggtttatctacagtcctagagtcagggagggggagggtgatggcggaatgggggtggaggccacaggcggagtgcagaaccgtggcatcctggggcttgaggaaggcaggtgtgtccttggagaagaataaatgtcctagagacgcagaaccaaagctggagctgggctgagctgagacccgagggttcccacaggccagttctggaggagatagagaaggctagaaagccgtggagaatacgggatgggggtcctgggagggcagggctagggggcggttcaggtgcgtcttggcacaagcatgtctgtgcccccgggcgtcctgagcagagcggggtgtcagggcggggcgcgggcatttcgctcctctctccctgaaccctttcacatccttcccgatcctgttttgcgttatcccaggatcacacgcacaaatccaaacaaacttttctggtcccgttcatctccctctcatcctagagggcacggattttgtttgatgagaaaataaagaaggtcagagggagacaggacacagaaacagcagctctcgggagggcagctggaggccgggctagggctgcctccactgtgccagggctgggggggattggcagagacgtctgggtccccaaccatcggctcttccctcaaagagcagcgggggctctgcgggaggatacactaccctgaaagactctcaccagccaacccaagccagtgtttgttctgcctggctctgggaccctcccgccaggaccccaaacactgccgagggaggaattttaaaaataaaatggatgggccgggcacggtagctcacgcctgtaaccccagcactctggtagcctgaggcgggcagatcacctgagatcaggagttcaagaccagcccagccatggtgaaactccatctctactaaaaatacaaaaaattagccgggtgtggtggtgtgcacctgtaatcccaactactggggaggctgaggcagaagaatcacttgaacctgggaggtggaggttgcagtgagccgagatcgcgccattgcacttccagcctgggcaacaagagtgaaactccgtctcaaaaaaaaaaaaaaaaaaaaagaaaaacaaaaaaagatgatcttatgggcagcagctgccatgagctccttcatcaaggaaccaacacagaagtggtgcagttgttttctctgaatctttctcgtcggttacttttttttttttttttttgagagaatcttgctctgtcgcccaggctggagtgcagtggtgcaatcctggctcactgcaacctctgcctcctgggttcaagcgattctcgtgccttagcctccaagtagctgagaccacaggcacccaccactacgcctggctgatttgatttttgtatttttagtagagacagggtttcaccatgttggccaggctagtcttgactcctgacctcaggtgatcctcccgcctcggcctcccaaagtgctgggaccacaggcgggagccaccatgccctgcctcggttgctttttattcagaggttgaactctccataaagccatggacaaaaaaatcatcttgcatgcgttagggttgacgttaacagccctatttaaaaatgttggccaggcacggtggctcacatctgtaatcccagcactttgggaggctgaggtggatggatcacttgagcccaggaatttgagaccagcctgagcaacatggtgaaaccccatctccacaaaaaatacaaaaaccagcagggcgtagtggcacgcacttgtagtccttgctacttaggaggcagagacaggaggatggcttgaggccagggaggttgaggttgcagtgagctgtgattgagccactgcattccagcttggatgacagagtgagactcttatctcaaaaaaaaaaaaaaaaaaaatgtccgtacttgattcctcatatctggaaagtcccttcagtttataagtggaattcacagtggtaaagccactgggacaagcacagcttctaatcacagctgtttctcaaatgctctcatgtattgcagaaaatttaacaacctaggtaaattaaaaaacctaagtaaagggagtttagggcattatatggcacacagtagtcgcttgacaaatactggctggatgttacttatctgttggaaataattcaactaacatatttgtgtactgaaacgttttttaagcagctcttcaaatatatttagataactcacacattaaattctaaaatataattttgattaaaaatgcatgtatcaacgctgggcacagtggctcatggctgtaatcctagcactctgtgaggccaaggcaggtggatcacctgaagtcaggagttcgagaccagcctggccaacatggtgaaaccctatctctattaaaaatccaaaatttagctaggcgtggtggcgcatgcctgtaatcccagctactcaggaggctgaggcaggagaattgtttgaacccaggaggtggaggttgtggtgagctgagatcgtgccactgcactctagcctgggcaacagagtgagactctgtctcaaaaaaaataaataaataaaataaaaacgcatgtaacaatgagtagcattaacatgccaaatcaggtttccagcggagagtccagaaacgctaggaaacctcatctgcagagagttggaatgaaaagtcatctctcctctggttaccgtggatcaggggcactctatttgcattcgtggactcctgaaattatatataaaatcaaaagatttggccgggcacggtggctcacttctgtaatcccagcacttagggaggctgaggcaagtggatcacctgaggtctggagtttgagaccagcctggccaacgtggtgaaactctgtctctactaaaaatacaaaagttagccaggcatggtggcacgagcacctgtaatcccagctactcaggtaactgaggcagaagaatcacttgaacctgggaggcggaggttgcagtgagctgagatcgcaccactgcactccagcctgggcgagagagccagactctgtctcaaaaaaaccaagcaacgaaacaacaacaacaaaaaatcaaaagttgtttttatgtgcattttttctggacaaagtaaccataaccttcatcaaactatcaaagcctttgcgagccaaacctgtccccaccccggaaaaaaaacaatgaagaatccccgctgttgactgagactctaacaggcacgcggattacttaactcacatctccttcagactttcagggccagcagggatacgagaattccctaagcttaaattactctaatattcattaacaactctttagagtcatgatatttaaaaaaacaatttttaaaaaggaactgtataaaaatagacacttgggaagattttaaatgtacatgtccattgcgtgcaagtgtgtactttttcttaatcgcttcctcttggctttctccggttagtttcactttcccagtacgcgggatctattccaggtggccacagccatagattcccacagtgggggaaaagcaaccatgtgaacaagatttcagatgaaagagaaaccacaaatgatcagttctggggctgattgcaaaaattagaggctgcctttcttggctgtttgagaaatcctctaagtcactgggtgccctttctagtagaaagacccacgttctggctgggcgcggtggctcatgcctgtaatcccagcactttgggaggctgaggaggacggatcacttgaacccaggagttcgagaacagcctggccaacatggcaagaccccgtctctgcaaaaaaatacaaaaattagctgggcatggtgttgcgcacctgtagtcccagctactcaggaggctgaggtgggaggatcacctgagtcagggcaggtcaaggctgcagtgagccctgatggtcactgcactccagcctgggtgacaaaatgagaccctgtctccaaaaaaaaaaaaaccgaacaaaacctccattcttacaagaccctcaaggcagcaaggacgggttattccctaagctggaaaggtgaccagggaggcctgcagtggcgactcgggaggagagtgacctcatcaaacagcaacctcattggccccgggctccagcagagaatcagctggaggctgcacccccgcaagtccatgagcaaccaccagaagccatgaattcagctccctttgtggagtctacaaaagaatctttgtgccctgaagttggtcataaatacttaacttaccaggccgggcacagtggctcatgcctgtaatcccagcacttcgggaggctgaggcgcacggatcacttgaggccaggagttcgagaccagtctggccaacatggtgaaaccctgtctctactaaaaatatgaaaattacccgggtgtggtggtatatgcctgtaatcccagctgctagggaggctgaggcacgagaattgattgaacccaggaggcagaggttgcagtgagctgagatcgcaccacggcactccagcctgggtgacagagtgagactctgtctaaataaataaaaattaaaaaaaaaataactcatcaggaaaacccctacaggggaaggggctctaacccctggaagatccatagtttggcctcagatgcgggagtgtggtgaactcccaagaagtgtagaaaatggcatgtgtgtttttctgggaagaggctctatgactttaaacagattctgaaggggctttgtgacttcctcaaaacacctgggaccccagtgatctgtgtacctgcaatcactctttccttttcagaaaacctactttttccccctcaattccttctctaaggatgttgcagaaaactatttaggaggcctgacagggaaaatctcacaagcaaaacttgtcctgcaaccttacttttattgtttaaaaaattctgtgtaaaaataaatacttttcaactcaagttaactggagcaaatagatccaattaaaaaaataacataaacacaaacagggttttctacttgccctgtttctgaagtcatgacgtgaaagaaaggcaaacccacccaggtgagccacagatcgcagaaaacacgagctgtccaaggaagaccgccctcctctctgaagcagtgctcatcttttcaataagaaaacaccaggcatcatatatttaaattttagaatattttaatgtccatttcttcagtgaatgcattttgaaattattagaattaacaatttaaaaagagcagataaaaggatatatggaaaatgcaaacagtcggttcttgctaattcaatttcagattctaggcatgatgtgattttccaaacaaccaattaaaaaaaactccttacctcgaaaatctagaaattcaaatgcagacgtgtctttggaaactacaaatgattacagcccatgtgacaggaagcacgcggccttcggctctccggatcgtgtgcaaatgtgcagggggagcccccgcgggtgacgtcagtgtggatgaagtcacgggtgtggcagagcctgtggggctctcaagctattcgagggttttgtaactgatgctctacatttgtttgcattggataaaattgtgtgtgcttgtttaccatatatatatatatatatatatatatatatatatatatatatatatggatatataattcgatctgagctgggactgagaagaaaatagcaattgcaactcaaagcaactatttacacacattcaatgctgaagtattgcttcctgccctaagttcctaagaggtattgccaccctgaagcacgacccatgccgtcagcagccctcgtgccagctgcttagaaactcgtgtctccagcacgatgtgctcgctgccaacagacaagagatgcacggcgtttccgctgcagagattctgtggttctgcactgaggtatgcatcggagcaggggacggggaggacccgaggggcttcgtggcccagagagaacgtctgcactggctgtttaggaaggctcagggtgtttgaaagacaacgttaagctctgggtgagtctgcacggggctgaaccagactccactttgcagctccttggtttcccggggtgaggaatcacaaacacctttgtggttggggaaggaaatgggcttgatggggaagaagtgtgtgcggagaactttgcggagcatgttctgagcgagacagcaaggtcgtgagcaaacgcccagcccctcaaagctacacagcctggaggggaaaggggaggggaggacattcaaatatacaccttaatactgatgcagaaagagcttcatgtgaccacaatccccacgaacaaggaaagcatcaggtagtgttttttaaggaaaaaaaaaaatctgcggtgttttataatacattctttagaagcaagaggtattgtcacaaccaccctttcttcggtattggaagaccagcaaactgacagtcacacctgacaggaaaccttacagctaatggggggaggtgccctggactctcaggacgccgggaccctggctctggctgtcctgatgggtggccatcccaggcaccgcccctggagaggtggcgggtcagaattgtgacttcttcatgccggggagggcaatctgtatgtctctggggaggagtagtgatgatggggactgatgcggtgtgaaaacgagacagtgagatttgacagcggaaagcaaaatgcacagggacaacgggcaagactgacaaggagtgcaccctgggcctcatcagcgtcccggggtcccctgaaagactggctacaactccgaccggacaactcgggcgagctcacttccacacaaacttcagactcaatatggcaaaacataatcagacaggaccagcagccaactgcccggacggagctcccccacaccaccctcgggattccgcccctaacaaaccccgcgtttgcatccagatgcctctgtccctagatacggtgtgagaactccatttcagagctggaatttgctccccagattaaatcctgccactgataggccctgtgccatctgagagcgggaggcagccaagaaacttctggaatttgtggaagccaagatggcaccggtgctgccggcacagacccccgtggttctgagctggaccccggcagggaggagcccccgtgggtggcaggggcagctggtgggcttctcctattcccctagcctcagaattgcactggccatgctttgaggtcccactcagacccctcttggggtggggaggttgggggcggccccaggtggccaaaacacaaaagagacatctggttaccttcctgggaactgccctcccctgtggctatgaccccccaccctgaggacccagcacccctcccgggagcgcacatgcttccgggtaaataaataaataaataaatgcaacctcggatgtttatttggtatttccctctccgatgagtcagcttccaggaccaacacctccactcccgatggggagacccctgggtggagggtcgggggtgagaggcggctctgagacccccgaggcctgggcacacgggcgtcgtgcccggctggcatttgctgtcttggcctgcatgcatgtgggcgagcccctaaacccgctcagtgcagggagcgcggctcacccacagcccacggggcgcggtgctcgggaaagtgcgggtgggcaatggggggtggcggagctgtcgtgacatgcccccttcgcaccccctcttggcggattactggcactttatatcagattcatgaatgcaagtgtgtgtgcgcatgtgtgcttacatagagaggtcgggtcgtagaggaacactgtgacatagacagaaacaaaataaactcaaaaacagggtattagccagagaaccgaaaatagtgtctcgtgggacgtgggaaaaagcaataaaaatgagatcttaaccacagcttttgttctaaaagtcaaataatacccaaagccatgatctccactggcggcctctgtcccgagactcgaggccgaggccagccctgaaggcacttgttctccaccacgtgctgaacggatgacccagaggcagcggggtttccagggaagggagcgaaagggaagaatggatgaaaatgaaccctgaataactgtgatccacacagaagttagggctgaaatgaccacataacaccacgtccggggagggcaactgtggcgcttggaaagcacaacagccaaatacaaatattactgtgtttcgacaaacagagcacctcgggcagcgggtgggcgccgcctcacacactctttgaaacgttgagcttggtgagttcgttggcttcttctattcctgtttcgtcacagtcgtctttctctatggctttgccaaatcgacccctttcttcggctttgacgggctccttccacggtctcttgggggacaggtgggcatccttggcctgcgtgctgctgtcagaacccagagatgtcttgtccacatactggacagaaggcaccaggttggcaatctcgtctgtgggagaccgtccgatgctgccatccacctggacgcggatgtctggggagatggacagctggtgctgtgggatgaccctgtgatccgtgcactttgggtacaggtaggtcttcatctggcctttccccttgacattcacggtccctctgtagtcgaagtcatagcccatcttgctcaagacgcggtagctctcttcgctcacctggatgcggcactccacgccggtggtgtccatcctgctggcgatgttgacggtgtctccccagatgtcgtacagcagcttggtggtgccgatgaccccggccgtgaggggcccatggttgaagccgacgcggagcttgaagttgaaccacagcatgttgttgttgaagtcgtccaccacgcgcatcatctccttggcgaactcgaacaggatctgcaggtgctcctgcgggtggctgccgtcctgggcctgcgcggtgttcagccctgacgccgccatgtacgtggctccgatggtcttgatcttctcgatgctgctgtagtccggcttgcttaggagctcgtcaaagtccccgatgagctcgttgaggacccggtagcactccttgccgccctcgtagttctcctcgtagaactcgctgaagttgacgatgctggcgaagatcacccctccgctgtcatggttcttggagtaggtctgggacaccttcagctgctcagccacgtggtaggggatgatgttcctcagcagccagtctgcctggtcccgcatgctctggatcttggtgcggtgaagatccgcttccacgtctccgtggtagtggaggcggtagctgacttcaaattcgcgattcaggaaccagaccaacaagagcaggagaaagaagacgagaaccacctcctggccgatgaggctggcgggccgccggaggtcacgcggcaccgaactattgcacgggttcctctcggaactggagagcaaagacacgggaaagggagaggttactgctcggcgcttccaagctcagaacagccccgctagctacgcaaagctttgttgagtccaggccttcaacaacctgaagctgtcaagctgcccattcctggtttgggctggctgaaggtatggagggataaagactaacttttgaaactgattgatttcattttgttaaatagaggtggggtctcactgtgttgcccaggctggtcttgcactcctgggctcaagcaattttcctgccttggcctcccaaagtgctggaattacaggcgtgagctgctgtgcccagccctgtaactaacatctttagtaagtgcttggtaatcgtttttcttttctttttctttttctttttttttagaagtctttagcttctttcaaaaatcttttcttttctctctctcctttgtttttttagagacatggttgttgtccaggctggagtgcaatggcacaatcatggctcactgcagccttaaactcctgggctcaaacgatcctcctgcccagcctcctaagtagctgggattacacgcatgtaccaccacacctagctaattaaaaaattttttttttgaagagacagggtcttgctggttgccaaggctggtcttaaactcgtaacttcaagccatcctcccaccttggccttccaaagtgctgggattacaggcttgaactgtgcttggcctaacatctttttttttttttttttttaagattgagtcttgctctgttgcccaggctagagtgcagtggtgcgatcttggctcactgcaccctctgcttcctgagttcaagtgatcctcctgcctcagcctcctgaatagctgggactataggtgtgtgccaccatgcctggctaatttttgtatttttagtagagacagggtttcatcatgttggccaggctggtctcaaactcctgatctcaaagtgatcagcttgccttaaagtgctgggattacaggtgtgagccactgcacccggctttttgctgaatgaactttttgaaagtaagttgctgacatggcacttcagctctaaatatttcagcatgtatctcctaagaataaggatatttccctatgtaactacaatatcatcatcatacccaagaaatttaacattctctgatatatttggttcttagatttctttttttttgagacggagttttgctcttgttgctggtgagatcttggctcactacaacctccgcctcccgggttcaagtgattctcctgcctcagcctccccagtagctgggttcacagacatgtgccaccacacccagctaattttgtatttttagtagagacggggtttctccatgttggtcaggcttgtctcaaactcccgacctcaggtgatccgcccacctcagcctcccaaagtgctgggattacaggtgtgagccaccgcgcctggccttggttcttagatttctaatccaataaacttatcattttacaaatagcttttatgagttctatactctctacctgtataaaaaagtttgacaagacgccatctcccctgattctgggttagttctttttgccgaaatcactcaggacaatgctaacatctgaaccagtgccattattttctcatggctgtgcagtgttccagcactcggaaattctgtaatttagccagattccccctgatggaactgggcccgagtctgtcttttcttaccacaaacagtgtcacagggaatattcccctacccctatctttgtgcgtatggaagtgctgagtcattttaaatattgcacatttagaatttccttagaaatttccaaattgcccttctaaacaaggctgaaccagtttctgcttttttttttcttttttttgagaaggagtctcgctttgttgcccaggttaaagtgcagtggcgtgatctcgcctcaccacaaactccgcctcctgggttcaagcaattctcctgcttcagccttctgtgtagctcggactacaggtgcacgccaccatgcccagattatttttgtacttttactagagacaggttggtctcaaactcgtgacctcgtgatccacccgcctcggcctcccaaagtgctgggatcacaggcgtgagccaccgcgcccagtctctgctccctttgataactgagcctgctttcagcggggctgtctccacttcagtggcactgatggagacagccatggtcagggggctgcagatgagtggtgagtagcacaatttctttttttctttttcttttttcttttttgagacagagtctcactctctagcccgggctggcatgcagtggtgtgatctcagctcactgcaacctccacctcctgggctcaacgattcttgcggcccagcctcctgagtagtgtgcgccaccaggcccagctaatttttgtattttttttttggtagaaacggggtttcaccatgttggctgggctggtctcaaactcctgacctaaagtgatctgcccgcctcgacctcccaaagtgctgggattacaggtgtgagccaccacacctggctgagtagcacaatttcttaaagtttgtttgaaatatatatatatatatatatatatatatatatatatatatgtatttttttttttttttaagaagagacagggtctgtctctgtcatccaagctggactgcagtggtgcgatcctagctcactgcagctttgacctcccaggctaaagcgatcctcccgcctcagcctccagattagctgggactacaggcacacaccaccacacctggctaattttttgaactttttgtagagatgaggtcttactatgttgcccaggctggtctcaaactcctgggttcaaactgttctgcttctgcctccccagtgtgctggaatacattttttcccatttaaaaatactacatactcatcatagaaaatgtagaaaaaaatagacaaaaaagatttgtccatcgtcctgccatccagaggcaatcactattaacatttgttgaactgcattctagtctttttcttttttacaacaccgtgactgttctgttcatgtaaatgctgtaccctgatgcattcctcccgcgcacagagtaggccagttgatttgatgcaataatgggcttggtcactatatacttatatatgcgactggcggatccacagtttagacagctccatcacactggaaagctcaattctttttcttttagagacagggtctcgccatcttgcccaggctggtcttgaactcctgagctcaaccaatctgcctgccttagcctccccaagtgctgggattacagggatgagccaccacgcctggccaaaactcaattcttcttttttctttcttgctctgttgccctggctggagtgcaatggcgcgaccttggctcactgcaacctccgcttccaggttcaagtgattctcttgcctcagcctcccgagtagctgggactacaggtgtgcgccaccatacttggctaatttttgtattttttagtagagacagggtttcaccatgttgaccaggttggtctggaactcctgacctcaggtgatccacccgccttggcctcccaaagtgctgggattacaggcacgagccaccatgcccggccaaaagctcagtcctttaatcaaagtgtctaataagtttcactaactgttcttgggatattaaaaaacaatgagcttgacctgtgtggccatcacggccctctgcgaagcacaaccgccaaaagccctggccgtgggtggaacagaacccctgggccccatcctggctggaccgcgggggagtttcagaatcttgggtaagccatgccatctttctgggtctcagtttcctcgcttgtaagctgtgaagatggactggagcatggctacgtcccttccagcctaaggttccgtgcaggaaaggcctgaggctgccatccttggaaagacctgcctgcaaaggtggtggctggcaccagggagctgggatttggggagggttcctgccattccttgataagagcggctcacactgcctacactgtctaaataaggaggtttacgctgaatacccgctttcctgctggaagtctggaatttaggcacgtgctgggcagaggcgggagacctgaacagcccctaatacaagcctggacaccgagactttaatgagcttccctggtaggcagcatgttacaagtgttgtcaccactcactgctggaggaattaagcccatcccgtgtgactctaccgggagaggactcttggaagctggtgccggcttcctccaaacgtcaactcacacacccttccctttgctgattctgccttatgtcttttcgctgtaatcacagcggtgagagagcagattgcggagtcctgagtccacctggggctggtcttgggagccctgatacgggctttgtgactcaacgcctatgaccaggaaccaagagtcctcagtgggaagacaccctgtgcttcactgactcatttcgtgaactgctattgaaacagatgacattacatatcctacatctcaagtactaagcaaaataaccatttgttacgatgatgactcaaacatatttctgtccagctccatgagccctctggttgattgtaaatagagcaggaagagaatatggactgggggaaggttttgtgagccccgctcgttgggttaggagttgacctttcttttggtttctcaaagtggtgacaccaagaacagtcccctttaggagcaggtgtcaccaaggtctaacatccccattatgtgcagggggtgtttccagtctctgtggtggaaatgggagactgtatctgggcttctcaatcagttatcgcttgtacagctcactctaatctgcgggagccggagccagcagcacagctgactcgagacgggcgcaggccaggcccctccaggcagaggagggacagcagcacatgggctagtgccagagggagaggaaggcagagcacagcgtttgctttccacctttgcttccaaggaagaaaagccatcacacacagcatgtgcactcagaaaccaagggggctgcctcgcaacagaaggcatctgtaagaaacaggtacgaggacagcttcccagctagaatgtgtgtttcctattttaataccaaaggaacaaaggagccgatcctattcctaaattcaaatagcaaagatccacttcaaaaagaagaatttctttttcttttctttttttttttttgagatggagtcttgctctgtcccccaggctggagtgcagtggtgcgatctaggctcactgcaacctctgcctcccgggttctagcaattctcctgcctcagcctcccgagtagctgggattacaggtgcccgccaccacgtccagctaatttttgtatttttagtagagatggggtttcacaaacatgttggtcaggctggtctcgaactcctgacctcaggtgatccacctgcctcagcctcccaaagtgttgggattacaggcgtgagccaccacacctggctcaaaaagaggcatttcatgtgactaaatgcaggagttaatttataagtcataaatggaagttagagtaaaatacagtgtaatccgttatcatggagaagagggattgaaaaactgaaaaaaatagaaagcaaacatcacttgcagtcctaaccagccaaacgtggcttcggttgacactttggtatatttcagtgccatttaaaatctgcccctagggaggtggtcaggtcgggggagagggggtcagcagcggtggggttggagggcttctggggtagtggtaatgctctacttcttggtctgggtggtagttaaatgggtgtgttctctggtgaaaatgcactgagctgtccttttatgatcaggtactcttctgtgcatactgacatacacatcaataaaaggttaaaaaaagatgctaggtgctttacttttaagtactaaagctgtaatcatcactcattcattatatcctaagtataaatcttgtacatatttttactatatataaatacctagttgtacctatagtacatatatagtttcacctagtaaatgaaaatcttaaatgttttccatatttactgcattttaacagttgtattatttgagtaaatgtataatcagttaatttatttattattgacaactacagttgctaatgaatcttttttttattttattttattttttgagacagagtctcactctgtcgcccaggctggagtgcagtggccgatcttggctcactgcaacctccgcttcccaggttcaagcaattctcctgcctcagcctcccaagtggctaggattacaggtgcccaccaccaccccagctaatttttgtatttttagtagagacggggttttgccatgttggccaggctggtcttgaactcctgatctcaggtgatccacctgccttggcctcccaaagtgctggaattacaggcatgagccaacgtgcctggccttttttttctgagacagagtcttgctgtgacaaccaggctggggtgcaaggacaccatcacagctcaatgcagcctcaaattcccggcctcaagcccaccttagcttcccgagtagctgggactacaggtgcataccaccatacctggctaatttttacaattttttgccaaaacaggatttcgctatgttgcccaggctggtctagaactccaggcctcaagtaatcttcctgccttggcctcccaaagtgctgggattacaggcgggagtcaccgagcccggtccttttctgtgtgctttgattttctctcccttcctctcaaatctgtccatcttttcgttgtggttctatttattatttgtaagcctggaaagttatctcagttttagaggcttgaaaactattgaattttactttttctagattttatatagtttaatttttatttccgactcttcaatttatttagaatttattctgctgtttatagtaaagcaagggtcaaacatttagtattttggatttcaagtcagttattttattactttttgagacacagtctcattctgtcacccaggctggagtgcagtggcacaatcttggctcactgcaagctccgcctcccgggttcacgccattctcccgcctcagcctcctgagtagctgggactacaggcgcccgccaccatgcccagctaattttttgtattttgtttagtagagacggggtttcaccgtgttagccaggatggtctccatctcctgacctcgtgatccgcccgcctcggcctcccaaaatgctgggattacaggcgtgagccaccgtgcctggctgatttcaagtcggttattttaaaatattttacaaaataacttttttctttgatttgcgagatttcctttgttgcatgcgaaagtcttacataaaattacatgactgtaatgtcttattaaaataataaaactaattttattttccccattagacattataactatgatacagttcaacgaggagatattttccactttctattctaagaatgcacgtattgttccttttattcaagatcccattgttttcaggaagcttcgaaatgggcagggtaatacagtcactctcgtttattcagacagaagtgcaatattaaaagcttacctgaaattctgtactgcgtcaaggggcgaagttaatacagaactgaaattaaaatgcagaaaaatattatcataaagagcaaagaaggcattccacaaggcaacctgagaagagcttgaacaaactatgttccttttttagacgtggttgtacatccacataaagccacctgctcccacctctttcttcacatctgtgtctcccaatgctgggggcagttcccttggtaaagctgagtttacgtctttgtttaccatcccgcatcctctctatcctgctgaggcttagcaaccgtgatgggattaggggctctgaggcctcaagtggatggaggagttctgggccgagtggaacttcaaccatcatccctaccccagatctgctatttgaactctgggcacaaaggcggcagaggggtcccccatcactgtggctctccagctccaggtagaaaagccccgcagccatgactaaaggccacggtgaatgcccgatgagggacctgtgatggatttaaaaggtaaaaagcagtttgctggatttcatactctcgagaaagagctcatcgtgaccatcgttctagatggccataccttcagaaaaatccaagtctgctttattttgcttaatctattcattaaagtttcctttcaagtactgaatgacagtcctattttaaattccctttttgatcttaatttgcagggaatttaaatgtcttttgtattgtgattcttttcttaagtaaactgaggacggatgctcacactgcccatggctggactgttgctttgctaataaccaaagacaccccgtgcctactccgtctgatactgacaatactgcggcaaatagaatcattttgtgcttttgaatgaattcaagcagaggtccttggcaacagcaatgccactccaacggggcatttcggaaatgccaggggtccctctggttctcttaataactcagggagccagaatgttagatctcctgcaaggacaaggaagaaatgtcccatgtgactttaaaacattctgcgcacctaaaccctctgtaattgtaaacaggcggttcttcaatacacactaatagtgaaacatttttataagcagttataggaaaagcccaatatttgggagaaatttattacatgaatggaagcttaatgggtttaagatatcacgaaatatttgaataaattgttcactgcttacattctgttatacaaggtattactgtatttccaacaacacatttagttgaaaaggcttaaaataccctgaaaccagtagcaaatgtgtaataggcaattttgagacttattttttatttttatttttggagactgagtcttgctctgtcacccaggctggagtgcagtggcgcgatctcggttcactgcaacctccgcctcccagggtcaaccaattctcctgcctcagcctcctgagtagctgggactacaggtgcacaccgccatgcctggctaattttttgtatttttagtagagacagggtttcaccgtgttgcccaggctgtcttgaactcctgagctcagacaatccacccgcttcagcctcccaaaagtggtaggattacaggcgtgagcaccaagaccggctgggacttatttttaacaaatcaagaattattcagttagtgcaacacatgaaagatagggatcttactggatgtcgctaatggcaaatattttaaatatagcacctatcactgccatcctgtaagtttttacattttttgtagtacaatgatgagaactgggcttgtccccagaggtctaccggcctccctgactcctgtttctgtgtctgcgccatcccattcctcagcacctaccagtgatacggttctgaaggccagcgtcctcctcagtatgcagaggatttcaaaataaaagacctatgttcagtgactggtcattaatcctacgtctcatgacatcatatggggaactgttttgacctatttattattttttgtttttgagatggaatctcactcttgtcacccaggctggagtgcaatggcacaatctcagctcactgcaacctccgcctcccgggtacaagcggttctcctacctcagcctcccaagtagctgcgattacaggtgcacgcccccatgcctgactaatttttgtatttttcgtagagacggggtttcaccatgttggccaggctggtcttgaactcctgacctcaggtgatctgcctgccttggcctcccaaagtgctgggattacaggcatgagccactgtgcccagcctgacataatattttgaaataagccccaggtgacttgcaagatcatcctacgtcttcacctcctccttccaggctgtgacctgtcccggttcatgaaccctaccccactcaaggaaagtcagcaccagcttcctctccaccttcacatccatctgcagctccgctctttcatggccttgaccatcttctatgaaatccttcaggtcctactttcttagattccagcccattcatcagaagtcacctcggtataatgcaatggcagcattatgttttccaggatgtctacattcaactacccagagtgctgttctaaatgatattctttttctttcttttgcatattactctgagggcatctcattagctctttggtatgatgtgtgctgacagctattttgggtcatgatgggaaatatctctatcggggcgtgagaagcaatgtgcaaatgcagccaggccctacgcaacctcgggcaaggtggccacgcaccctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagcgcggccgagcctgtgaacactgggaactgcaagaggcgaagggttaggacagccgcccagggccaccccgccacccctgctatacccggccgccaaaacattcgccactaatccatgtttccttttttttttgactgagtctcactctgtcgcccaggctggagtgcagtggtgcaatctcagctcactgcaacctctgccttccgggttcaagtgattctcctacctcagcctcatgagtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgggattacaggtatgagccaccgctcccggcctaatccatgtttctgtgtaacctaaaaatatcaccgataccagctaattgctcactatctgcagtcagtcttacttttgctagtgggcagtgtcaaggacagatcaagcctctaggttccctacccggcgtgaggctccctgttcacatggcatcacactcttctgcaggtgtgggaaatggcacgtgtcttcgtggaaaggaaagggaggcctccctgtttgagaaacgctgtgtgatcagtttccttcaaaacacttttccttggggcccagtgagatgtgatttggggctaaagtgtcaaacaccatcagcccgcccggaagctcatgctcacttgcaccagaaggatcatctcccacggccgtgctggttccctctccacggagtttagcacagttcccttcctgatcagcagcagccgacccgggcacaagtcaattctgtgtgccaggtatgcttctcgcatggttaggaaaggtgggacagacgcttctttgtaaaatgtgaaggaaaataactgatttggaacttgatgaagaagaagccacactggcagggactcgtgcccaccggggactccccagcccggccactgcccgggcgtgagcatctgggcaggccaatgctaagtcggcttctaaaaaagctggctcaggagagtaaaagagttcgtgcctcttcaagggtttattttattttatttattttattttattttgtgacgcagtctcgctccatcacccaggctgcagtgtggtggtgcaacctcagctcactgcaacctctgcctcccaggttcaagcgattctcctgcctcagcctcccaagtagctgggattaaaggcgcctgccaccatgaccagctaattgtatttttagtagagacggggtttcaccatgttggccaggatggtctcgatctcttgaccttgtgatctgcccacctccacctcccacagtgctgggattacaggcgtgagccaccatgcctggccaaagggtttatttttaaattgctatcccaagtgatttaaagaaaagagagattagggagtccaggagagcgtggaaataaaacggctgagcctttacttacgtgtatgttggtctcatattcggaggtgacatgggagtagacggccagtgcgggaagcgacaccaggatggccccgatgcagtgacgtggtagccagccggcgatccactccagcaggcgcttggtgcaggccatgacgtcctccaggaagaacaccatcctgcgagaggcatgggggttagcaggagcgacggggcccggggtgggtcatcggccaggagacaggtgcgaggccgcagccagcgccgccctctgctctctcccgtgttgcccctgggatgggcgtgagagcaggcgtggggtgggagtctacctccctcacttttggtagaaggcaaggaagccaggcttagctcattgtacctgattctagggtcacatgttgcgttgtgataaaatatgcttgtgaaaagcacatgcttcgctcgcctaacagaacacgtgagagtatcacaggccctgaggagagtctcctgggggccaccacgttgccgtcaccggctcccatcagcttctgaggcaggaggtcttgacgggggcagctttggaggcgtcctggaattctgtggagcccgtgcagttgtcgcagcagaagaggcggtcctggcatctggtgggcaggcgccagggacagagctgtcctgcatgtgggcaggtgccacccagggaggttctgccctgcaccccacacagcagccaagcccctgggcacctgcaaaggcagaaggctgctgacagcatcttagcccagaggctgtgtcccagctacaaacagggtgctctgtggtggtgctgacacaccctggattttcttggagcgcagctcctgtggaaactgagtgacagtggtctctgctgtttggggcatcatcatcagtgtttcagaaaatcacaccacaggctgaacctggctcgtggcgcttagaccaccaaacccgcacacgcgtgccgtctgcatctgggctgtcatgttcatcgtgcatgttcacctctagctggcggcttcaggactctccagacagcggggctctgttgtacgtgaggtccagcaccacgtatttcattttaaaagactttgtccttctaagcagagcgactgtattcactgactccttttgcaggcgtgtgtctagcgggcttcgtttcaggagtgtgatgttgacacaataaaagtttctgtataaagaagcagctgagtgtgcgggccaagaaccactgtgaggaggaggaacaggtcttggctgagtccaaggacccctgggccatggtggggccacatggggaggtgaagagaaggtgtggggtcctcgtggggagacagtccttctctcaagcttgctgccagggagctggggataggcctgctgtccctgcctcaggagaggctgggcgggggccgctgttgtgactgaacagcaaaaaagcctctggcacagagccccccgcccccagccttcgggcctgaacacctaccatgcctctccctcttggctgcgtggtgtggccaggcgagggaacgctcactctccagccattccccacatggacgcaggcacagcctcacccttttagggtcctggacagccctggcttcctgatatttaaaggataatgaagactttggaatacttccaagaataaccacaaatatgcagaatacagaggccctaggaggggggacagagggaaccaagttcccagtcagcagcgggaaagatgtgaggttggagggggccttcatgctggtccctgagactgcagggatctgaaaatgagacctcacgcctgctggggcagagcagagagggtgatgcaggaagcctcctggaggcaacgggcggggcctgggccagtcactgaggaggcgcctggctttcctcctgtacaggaaagggatggggtgcccgtataccccacagcgcaggttcccgtcaacctggggtcctcaacacggccctcagaggggccagggaagcctttcagggtctgggcctctcccaggcttgacgattcctggtaaatggaaccaaatcccaccacaggcctgttcaggggtgcagcagccaccaccttcaccagatccttggggagtatgtctgtgcaggcagttccagcgcacctcaccccagccctcggcagtctacaccggggttgccctcaatgctttagaattgggtctgaaggagcagggaataatagctaaagggtgaaagtaaaaaggaatggagacaatgctggcctcagagccctcaagacgctacagctacccacattagaggaaaacctgggggtggaccagggaaggcagacctgggggagtgactgcccatgaggatgggtttctttttggggtgatggaggtgcccgatagttacatagtggtgatattcatacaattcttcaaatttgctaaaaatcactgagttgtccacttgaatgagtttattgtatataaatcatgtcacaataaagcagatcttcttttttttcttttttgagatggagttttgctcgtcacccagaatggagtgcaatggtgcgatctcagctcactgcaatctccacctcctgggttcaagttgattctcctgcctcagcctcccgagtagctggggttacacgtgcccacaaccaagaatggctatttttttttttttggtattttttagtagagatgaggtttcaccatgctgtccaggctggtctcgaactcccagcctcaggtgatccacctgccttggcctcccaaagtgctgggattacaggcatgagccaccatgcccagcctaaagctgatctttttaaagaggaaaaacaaaccaaccaggggcctgaggatgtctggtttgggttctggggaagtggaccctgaaagggtttgcaggcgacggctcctttgggaggggtccccagaagcacaggagggcactgaggcaggaggggaggctgtgccaggaagagggctgctcgctgggggtgatggggcatgagcccacagggagttctgggaaacactgagcacacgccacagacagcatggcccatggcggcctcggaggaagctgaaagggtcctgggtacagtgcaggtgggaaggagggggcaggaatcccagcctgcccaccccagatgggagaagccagcattccggcgcctcacgccagactcaaagccattcatttctgccctgggatgttggataagggcagcagacgctcaaggtcagggctgcctccccatgtctgtttgaagcccagctccggggcaccgttgctagtgggactctgctaggccggcagccatcctgttgagggtgacaggaccacccaaggggcttgtggtgcccaggacggggaccacacagggccaccttcctgctcaggaatacagagccgctgcgagccccctcagggagccaggctggtcccgagggcccagctttcccaagacgcacctgtggtctattcggagcctctgtcccctttaaaatgagctgtctttttattatcaggctatgtgtgctctttatccattctagatgttagaccttgtccgaggcctgatctgcaagtgttccctcccgttctgtgggttctttctctttcttgatggtgttctttgtagcgcaacagcttaacttctgaggaagttgggcttgtctattctttcttctgttggcgtcacatccaagagaccactgcctgaggcaagtgcgtggagatgctgtttggctccggtactctgaagaggcgcctgctgtcccaggcccactacccccgctcatgtcttttcctttccttcctccagattgtttcctatcttctcaccttctcctttgcagtctctgaacctggaaatctggggacaagctggcagcggttggggctgtggaggcaccgccccctccagcgaggtggtccccccgcatctgggccaacgtcagggagggaggatgctggggcacagggctcggggaggacacggggacccatctccagaaatcagccagcagggacagctggctggggaccagtccaaccgctcagccataagccatggagccagaagagggagctaacggctcagagctggagacccagtccacgcggcgcttacctgatggacaccgcgagggacagcacctccagcagcagggctgcactgaagaccgccagggcggcgggcgggggaggcacggtggccgcctcgtacttcaggaagcaggtggtggacagcgtcagaaacactgtggtcgacagaaacacatccaggagggagctgaaggtgggactagcaaacgtcttcacgggggagttctttatgacctgtgtggagcaggagtggagcagaatgactgggaggccatgggcggccaggagcgcagttcagatggagaaacaggcaacacgtgcggagcactgctgctctgggccaggcacagggcaggaaggctctcggagggctgtctccctctactaccccatttaacactggggagtccaaggcacagagaagttaaacttgcccagggggctgggcacggtggctcacgcctgtaatcccgacactttgggaggctgacgtaggagggtcgctggagcccaggagttcccggccagcgtaacacagtgagactccatctctacaaaaaactttaaaattagccaggcatggcagtgcgtgagtgtggtcccagctactcaggaggatgacgcaggaggattgtgtgagcccaggagtttcaggccgcagtgagctataatcatgccactgcactccagcctgggcaacatagcgagaccccgtctaccaaaaaataaaataattagctgggcatagtggtttgtgcctgtagtcccaggtacttgggatctgaggtgggaggattgcttgagcccaggagtttgaagccgcagtgaactatgatcacaccactgcagaattataccgtttccgaaaacaaaaaaacacaaaaaaaaccctgccagggtcacagagcaactgattatgacccagcacattctcatagacacattatatatttagctgcaagatgagttactgactggcgcaggtgaggtccctgcatctgtaaggcagttggacgagagcaatgtgcagggcggtcctgctgcatggcggagtcctaggttcagcaggtgcgaaagcggggcttcgtggcggaagtggccgacggggatttaagtggcacatcatcgcctgggaacctacggggcctggctctgtgctgggggccagtacactagagaggcacacactagtgttcggcaattgagggggagaaataacgatgctgacacgtccaagaggtgaccaggcccaggccctgcaaggctctggggaggtgcgatctccattgacgctcacggcaccccacaggcaggaactaccacccatctcggtgtacagattgggaggccaaggccaggggctacccctagggcacacagcgaacaaggagccaggccaggacttggcatggaccggttgactcctgagtgtgtccctaacctagaggaaggtgtaggatccaaaggcagaggctgtggttgggagaggaagggatgtagccagttcagctgctttccatttggccttgcaaccttctggcaacccctgagaggccatgggtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcaggaggggcacttggacggtgggagcaaggctgccagtcagccctgatgccaggctggaccctgccagggcaacctgggggttagggtttggttccaaattctctccaaggaagctggaggctctgtagtgcccaaaagggcaagtcaggtcccagccctggaatcccctcagaaggtgtgggaatttcttttttttcatttttcttttcttttccttttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacctcgtgatctgcctgcctcggcctcccaaagtgctgggattacaggcctgagccactgtacccggccaggtgtaggaatttcaggggcgacactgcccatgcccactcaccttggcagaggcccacgcacgtcccctttctgtggggctccatctagtgcccgtcaggggttcgagtcagggccgggtgcatgcatgtgatgtccctgagacatcactgccttgcccacatgtgaggccggaaggtttccacgtgggctgccgtccttctgagagcccacacctcccaccttccaagccaagggctcgggtacagggcctttcctgattggggctgccatctcctctgtagaactgccccatccatggacgctgccagaggccccgctcctccctccacctcccttgcagtctctcctgcctgccctgctacttgccagagacacctgtccctgccacagcctccccctctgggccacccctggccctgatgccagaggctcccaggcccatctgccccacccctgtgcatcccgggagtgccacctgtcccagtcccactgagaacgacgctcccccacatcatgacactctttcgccctctctccccatgggcgaaacccagggacagtgccactggctgccagggcaccgtgggccaggctccgccctgctcactacccacatcccagggcctccgggtgcggccgtcccaccatcatcagagcacaggctctgcagccgggctgtctgggctcaaggccactccaccatgattagctatgatacccacgcgtccatgcctcagtctctttatccaaaaccagggataaaccagtacttgcaccttgtgggcggtgggatgctcggctaagaacgcacccacgtggagcccccagcacaatgagtccccaaacgcgggccagctgggaggctcccttgtcctggcatctctcctttcctccccaccgggaccctgtggccacctgccctgagtttcggtaacagcctcccacctgtcatgtggcctcctgtcttgtccacactcttatcaccctccgaaactcagctgatacatgtttgttttttttctttttttgagacggagtttcactcttcttgcccaggccggagtgcaatagtgcaacggcatggtctcggctcactgcaacctccgcctcccgggttcaggcgattttcctgtctcagcttcccaagtagctgggattacaggcgcccgccaccatacctggctaagttttgtatttttagtagagacggggtttcactatgttggccaggctggtctcgaactcctgacctcaggtgatctgcccgcctcagcctcccaaagtgctgggattacaggcatgagccaccgcgcccggccatgtttttcttctttttgttggaagagacagggtctcactatgttgcccaggctggtctatctactggcctcaagtgatcctcctgcctcagcttcctgagtaattgggattacaggtgtgagctgtgtgatctttgtaacacaacctgttccagatccttcaacagctccccatggcctgtggcataaagtccatggcatgggagccgtgacctggcccctgccacgtcctgccactcctgccccaccctgccccggatgcgcctgcaactccctggacgaaccaggctctttggtatctctaacgtttgtgggtgctggccccactctccagaatgttccctcatcccacattccattaattcctagtccccccactgaggcaggctcaggagttccccccttggagcccccagcctgggcttggtgcctcgccgtgtgctgggagggcactcgcagacctccagctccggatgttgtttctaattcctgctccccatcaggccacgtctttcccccttccccagcaccaagaacagtccctggcagagcagaggctgagcgtacatttggtgcctggaggaaggcatggcaaaggtgtctgctgtttgggaggctcagcagtgcagggcgagaagcggcccggacgcctggtttggcagccagaccactcgtgtccgaccccggctatgggaccacagccacctgttcagccttgctcagcgtcagctctttggtaaaaggaggataatcatcagcttccctacagcattgctatgagcattaaatgagacgatattttgccttacgggccaccaaccagccaactgccaacttgcaagtccactccgggagccatgtctgggacattaacggatattcactgtcccttggaggctgacggaagggggcacctcccaccccacgaggcatgaactggctctactgggctcaccagggtctctctagagcccaagccaggacaccacggagtttaatgaagacctgctggaggaaccaagggaatcagagtgagaaatcccttttgttccgggtggggagggcatccactcttgacttgggaacactcagaggttaggtttgggcccagaggagagaatgcagtctggaagccgccaggattcaaaccaggctctaggttcttgtattattccttccagcaaccccctaaggagcacttgtgagcgctgggactctgctggaggctgtgaggaggggctggaggagagagatgggtgttgggactgtgctggaggctgtaaggaggggctggaggagagagacgggggtcctacctcacagagctgagcatctagggagggaggaacacgaatccagaaccacacacggaaagattccaaaatggggcacacacggagaaggaagtgtatgaagggaagtacaatccagtctgcagtcggggagagcttcttggaggaagtgggattgggtgatgggctgagaagtcaagtacaaggggttaaggcggtgggggcgggagagggaacatggagccggagttagagagagaggtgaaggcctcctgggcccttctcaggggaagaaagcagggagggcaacagagaagagtctcacccaagactccaggacaggtgggacgggggctcttccagggcaggtcggtggggagttcccttccagggcaggtggggggttcccttccagggcaggtgtgggggattcccttccagggcaggtgtggggggttcccttccagggcaggtgtcggggttcctttccagggcaggtggggaggggttcctttccagggcaggtgggggaccccttccatggcaggtggggggggttcctttaccagggcaggtgtgggggccccttccaaggcaggtgggggggtttccttccagggcaggttgggggtttcctttcaggacaggttgtggtgggggggccccttccaaggctggggatagcctggagatgccacggcagaggaaaggggctagtaatggcgaggctgcgctttaagacaaaggactaaagaaagggtttttttcctcctttgcaaagagacatttcatgtacagttgccacttagggtttacagagtgtgggaaatcaatgttcgccttcgtgttcccatcccttggtaaagcacaaaactaacagtgaatgaccatgtgagaacaacaaacacattctttagtaaaagcgcaaggagaaatgaacgcacctcttcctgatagctggtcctgtaggatcgctccagctcctgatccaggaagttcaggctgaactgattaatgggcggcttaaaaaagtaatctttcatcaggctagaagacacaacaaatgcagtcgatcaatacccagcaccataactgtgccaatgttttcagatcataattagctaccaaaacgctgctcattaggtatattacaacagctgcgtctaaaagcgcctgtggaacagacgccactcagctgccccttgttaaaacagatctgtggaaagtccttcgcacctcaaagcataatcatattttgtgtttcaccttcgttaaagaatgaccatccaccatgattatagcacacatcatcagaaccttggttttttggggttttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggctggtctcgaactcctgggctcaagagatccacccatctcggcctcccaaagtgctgggatgacagcgtgagctgctgaggcttgtttttgaaaacacattcctaatgtctaggattaggagaagatgaaggcagcttttctgttctttgaaacaatcttttgtgaagaacacgcagatcactgtgctgagagtacttacatggatttggaggcttcaaacgaaaacataattcagaaccggcggtcctgtcattcagagcactgacagtaattgccaccgtaaaagctaacaggttgttatcacaaaattgtgtttatagttagcgtaattttggtgctattgtcacatatgcagattgcatgtgaaacctgcagaatgataaagctcagtgattttaatagcagggaaatcaaccccgctttccatgactctttcattcatttatgaattgccagcaaatagtaatatcctttctatactgcagaaaattactagaaactaagggaacgttaacatgatttcagaaagcaaatatagctgtgttagcctctctccctcatacagtgactatcagaagtaaattagacgaggctgggcgcggtggctcatccttgtaatccccagacctttgggaggccgaggcaagcggatcacctgaggtcaggagctcgggaccagcctggccaacatggtgaacccccgtttctacaaaaaatacaaaaattagccaggcctggtggcaggtgcctgtaatcccagctactcgggtggctaaggcaggagaatcacttgaacctgggagatggaggttgcaatgagccaagatggcgccactgcattacagcctgggtgacacagcaagactatgtctcaaaaaaaaaaaaaaagagtaaatcaggtgaaatatgtcaagtgcctcatgtgccccccacacaaagtacggctcatcacgtgtgttccttcctgtccttgcagcacggcggacactctcctttctgtgacaggtatccagtaacttccaacattctcagactcagaagagaaataattctgtcccaggacactgaccctctctcctcccctgactcagggagtgtggactgagggaagagcaaccacgcagctgcagagaggatgtgcacaaggccacattttagcagtcaagtggcagaagcgacactgctattagctgtgctgctccatttatttcttatttgttttttgagatggagactcgctctgttgcccaggctggagttgcagtgctgcgatctcagctcattgcagcctctgcctcctgggttcaagcgattctcctacctcagcctcctgagtagctgggatgacaggcacccgccaccacgcccagctaatttttgtacttttagtagagacggggtttcaccttgttggccaggctggtcttgaacccctgacttcaggtgatctacctgcctcggcctcccaaagtgttgggattataggcgtgagccacagcgcctggctgaaaatcaccctttgaggcattatagtgaagacagaggcaagaatcatcaatgaatgttaaatctagggaattctgatggggaatgaaatatgtacaagatcttcaagtattttctcacagattgcttattagtcataagaggaatataataaccctagatgagacaacccggcaccaccttgcctaattaatcaaaattagtatcactaatgaggaacagacgggcactgcgtgtccctggagaggacaccctgaggaggacacggcatcccttctgcagtctctgcctggccagagggagagcctgaatctaaccaatccaacttcaggaatatttgataaaaggactggacctgtatttttcaaaaatgttaccattaggccaggcacaggctcacacctgtaatcccagcactttaggaggccgaggcgggcagatcacctgaggccaagagttcgagacccgcctggccaacatgttaaaaacccatctctactaaaaacacaaaaattagctgggcatggttgtgtatgcctgtagtcccagctacttgagagacctaggcaggagaattacttgaacctgggaggtggaggttgcagtgagccgagattgagccactgcactccagcctgggcaacacagcaagacctagtccttataaaaaaaaaaaaaaaaaaaaaaaaagccaggcgtggtggctcacgcctataatcccagcactctgggagggtggggtaggtggatcacccgaggtcaggagtatggagaccagcctggccaacatgatgaaactccatctctactaaaaatacaaaacctagccaggcatggtggtgggtgccagtaaccccagctacttgggaggctgaggcaggagcatcgtttgaacctgggagatagaggctgcagtgagccaagatcgcgccactgcactgcagcctggatgacagagcgagactcagtcttaaagaaaagaaaagaaaaaggcagagaggcttctgcctgcaacctttgctttttcccagacagccccagtcgtacctgtcttctttgataacgtccacaaagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggattaggtcctccagaagcctgcctcgagacaaagaggacgcagacacgggaagtgaagtggcaccgggcactgggcacacacgcctgtcccaccccgacctccgctgcggggcgctgctgcactgggcgtgggactttctgacctgcgaggaacccccacccccctgcgcctacagacctgctccaatcccagccctgactgcccgtctgctccttcctgttacccaacagtgcccagtggtaacgctgggtgttcaggctgccaggacattgagacatgggaagagtcggtgcggaggtggaggggaagggaggaaagtgaggagccgaggcccccagagtctgcttaggccagaaccacggttctgggagcagggtgcatgggtcgggggtccaggagaagtatgacgaggggtccagggctgtcagggcacaggcaaggtggatggaaacgggctcgtgtcgtgggtgtcccccgtggctgtgggaaggcatgggatgacctgcacctgcaatcctttggcagatggagagcagatggaggacgagagcccgcgccccaggtgagtcgcctgcatgagcccccgccgacaggctctcgcgggtgggctgagtcctggccctggtgtccaagtctggttttcctgaaagccttcctgccaccggccctaactcccaacctctctcttcacccagcctttctcgccgtgaagaccccctcttgtctctgcccgtctatattctctcataaactgagtccagcttccagtaccacaaatcccctcccggcactcgaatccacgcattttaaacccttattggcctttaaaggaatcccgcccagctcagcccctgagcgctggtttccacgtgggttgctgctgaccctccctcgagctccctgccggtctcttcaacacccggaggacccgcgggtgcggagtgctgttacccaagaggagttactctcagaactaagaagtcgacaagacaggaatgtcaccttgggtggatgcgccaggagaggaactgacaggaacaacagccatgagcttgttaccttggtgctgtttttatgctcgtcttggcagccgttttgaggtgctcctccctcggcgccggcttcagatttgggagcaaatgtgattccgcacgaagggcaggtctagaagaaaaacacagactgtggggacacacccagaaaccgcgactgccaccctgaattcaggcaggtccgctgttgccatctgccgtcacgcagcatggtggtgagcaaggggaaggcacacagaaccgctcggggatgagctgaaagccaacgggcaaagtgacagtggaaacacacagaaacccgggcacgaacgcaacaggacccaaaaatggaaccgggaatgttcactgactgaacaatggatcaacaaactgtggtctattcgaacaatgggatattactcagccacgaaaaagacggaagcactgacgcctgccacagcatggtgaacctcgaaaacattatgctcggggagggaagccagacacagcacagatattacgtgatcccgtctatgtgaaatattcagaaaaggtgaatccttggagggagaaggcagattcctggctgccaggcgggaccgggggcaggaagggggagtggctgctaaggggcgtggggtttgctacgattcgaatgtttgtgccccctcaaaagtcagacgctgaaatcctaattcccaaggggatggcattggggggcaaagccttgggaggtaattaggtcatgggggacaagccttcaaaataggattagtgccctcataaaagaggccccagaggaatccctcgtcccttcgccctgggagaaggcaccatctgtgaagcaggaacgggtcctcactggacactgaatcttccgggaccttgatctcggacttcccagcctccagaaccctgagaaatacatttctgttgtttaaaagccacctggtttgtggtatttcaacagggtttctctttgggatgataaaaatgttctgaaattgatcacggtgatggttgcacaaccttgctaaatatactaaaaaccactgaactgtacactttaaaaagatcgatttttaaatattttttgagatggagtttcactcttgtcacccaggctggagtacagtgtcacgatcttggctcactgcaacgtccacctcctgggttcaagcgattctcctgcctcagcctcctgagtagctgcgattacaggtgcctgccaccacgcccggctacttgttttgtgtttttagtagaaacggggtttcgccatgttggccaggctggtcttgaactcctgacctcaggtgatccacccgtcttggcctcccaaagtgctgggattacaagcatgagccactgtgcctggccaaaaagatcgattttatagtatgtgaattatatctcaacaaagctgttattaagtaaagaaactggccaccaactatgcgaggacacaaatccaaggttcttaagctccgtgtgatggtgagctagtctcataagatgggctgaataatcaaaggtacacgatttccagatctaggcgtacttaaaagtttataggaattaatggacctagaaaagagaaggcaagatttaatacaggtaccctaaaaagagcaaagcctttatttctcataaactaggattcaaaccctagtcaagtacttactagtttggagactctgttcaaatcactttacctcagttccctcatctataaacaaagagtgaagatatgttgctaagaattaaatgaaattggctgggtgtggcggctgtaatcccagcactttgggaagctggggtgggaggatggcttgagtccaggaatttgaggccagcctgggcaacatggcaaaaccctgcctcaacaaaaagcataaaaattagcctggcctggtggcatgtgcctgtagtcccagctacttgtggggctgaggtgggagggctgcttgagtctgggaggtcaaggccgcagtgagctttgatggtgccactgcactccagcctggggcaaaagagaaagaccctgtcttaaaaaaataataattaaatgaaataagtatatatatagcctagcacagttcctggcatacagtatacccgtaataaacttattattattattaatgtgaccaggtaacctaggaaccatctaagaaagcaactaacagcttccaatgaagaagacaaaccgtggcaagaaatatatttttttttttttttggactcaaaagcaatttccttgcagcaagaagtgtaaaacattgaaataaattatgggaggccagatattattttggaaatttaaagtaagtgtcactacctaagggcaaagatatgacccaggttgtatttaaagttagactgcagacctgtactatattaaataaaagaaacaaagattctacagggttgtatagtttgggaatctgatgtaacatacaagctaaatttgaacatttgtatgcattcaaaaaatgaaaatatacatgccaaaacagctagcgaaatcattaattaacatatctgagcaaataatggcatctagataacatttgcttacagctctttaaaaactgacattatcaacagaggtaaaatgttctagttatcaataacatacagtgagtctatttgaaagcacctcttggtattgactggcagagttaaacttctaaacattttgctggtgtgctggctcacacctgtaatcccagaactttgggaggccgaagcaggaggactgcttagggccaggagttcaagaccagcctgggcaacatagggagaccttgtctctactaaaaataaaaccaattagctgaccttgatggcacgtgcctgtggtcccagccactcgggaggctgaggcaggaggattgcttcagcgaaggaagtcaaggctgcagtgcactgtgattgtgccactgcactccagcgtgggtgacagagcaaacccattctcaaaatacatatatatatgtataaatatgtatatatttgccaatgagaccactgctcttattaaatgtaaaaaaatctaacaccaagagaagaataaaataggtgtgcctgatacccatgcctaaaagatgcctgagggaactctctggtgtggctaaggtggggggcttggtgcttgatggggcacaccagccatttcagggcccaaccggtagaccaggaaaggaagctggaggtgtggaagcgtctgctgcacttggctcagccaaagcccgaagtgcaagtgcgtgctcagtaaatgctggtagtgaatatgaaaacttctgttaactatgctctctggtcattaaagttcatctggtaattcaatgtccttgattacagacagaacagcccttggtatctattcttctgtagccatttagtcacaggaatctcctggcgtcagtctgtttcaggtatttttcttgcctcaagttcatctgctgtgcttttctctctttttttgtttgtttgtttttttgggactgagtctcgctctgtcacccaggctggagtgcagtggggagatcttggctcactgcaacctccacctcctgggttcaagcaattctgctgcctcaacctcctgagtagctgggattacaggcgcccaccaccacgcctggcttatttttgtattttcagtagagatggggtttcaccacgttggtcaggctggtctcgaactcctggcctcaagtgatctgcctgccttgccctcccaaagtgctgggattacaggcgtgagccaccgtgcccggccaaccctcctgtgctttaagacgaggccgcctgcttcttcagtgccccccacggcacactggctttatgagattttctaagcatttagagccatgaatgtgtcaccgtgacagtcaaaccaacttggcaccagagggcacactgaggacagggggctccatgccctccacaagggcttccctcagaggggctggaaggccggtgcagcccgggcatgcccactgggatgaggctgagctctgggggcctggggcagtggtctccacaggtggggaactcagtgctttgcttacatccccttgaacagaggccgaggcctgcaccctgcagtgataagaagttctgatacagaagtgaggtctggcagagccgcccacaaatggcaaatgaggctgcgcttgcagaaggaagggggctgtctgggtcacatggccagctgtagacacccacgctcgggcctcctgagggccgggacagtgctcactgcctattccattcccagcaggtttgtccgggaagtgggagtatgggaggtggggggagagccaggtgcagactccaggccgcgctgggtggcatggtcccacagacctgtgtcacccggacccagcagccatcattttactgcactttgaaaatgcggattttggctgggcgcagtggctcatccctgtaatcccagccctttgggaggctgaggcgggtggatcacctgaggtcaggagtttaagaccagcctggtcaacatggcaaaaccctgtctctattaaaaatacaaaaattagctgggtgtggtggcacacacctgtaatcccagctactggggagactgaggcaggagagtcgcttggacccgggaggcggaggttgcagtgagcccagattgtgccactgcactccagcctgggcgacagagcaagattcctcagctaccttccttttgagggataattttctagataaaaactttcaaacaaatgaaacaaaagaaatcttagagctgggtgtggtggcttgcttgagcccaggagtttgagatcaacctgggcaatgtatcaagaccccatctctacaaaagctttttaaaaattttagaaattagctgggcacagtggtgtgtgcttgtagtcccagctactcaggaggctgaagtgggagggtcgcttgagcccaggagggagaggctgccatgagctatggtcatgccactgtactgcagactgggtcatagagcaagaccttgtctctttaaaaaagaaaaaagaagccaggcgcagtggctcatgcctgtaatcccagcactttgggaggccaacatgggtggatcacaaggtcaggagattgagaccatcctggccaagatggtgaaagcccgtctctactaaaatacaaaaaattagcctggcgtggtggtgcacacctgtagtttcagctactagggaggctgaggcaggggaatctcttgaacccgggaggtggaggttccagtgagccgagatggtgccactgcactccagcccgggcaaaagagcaaaactctgtctcaaaaaaaaaaaaaaaaaaaaaaaaaaagaaaagaaagaaagaaagaaaagaaaagaaaagaaaagaaaagaaaagaaaagaaaagaaaagaaaaaaagagaaatccatctacccaatggagagattctcacatctcaacatccccttctgagctgtagttagaggccccttctgtaccaggagggtcccaccatgcaatggtgggtgggtttgtttccctcccctgacctcctaccccccaacccccatggcaattttccttgagcgattcattagcttaattttaatctggattaagacatttcacaacatgttttttgccaagtacagatgcctctgtgaaatgtttcccagccggctaaacagcgtctccccctgcacagctgcaggcatctccacccctgctgagaagccctccctgggaagagtatttctgactccaggaagctgcaggcatggaagcacctcactgccttgggagacaaccctagcagctggctcacagggagccacacgggcaggcacattagagaaaaagcagtgtcataatgacagtagctactatgacttaggaatgtctatgggccaagatcctacccgtgaacaagtcgggcccccatccacgcaatatctgcagtctcgactgtatgatctcgtcctttgcagccacactgtgaggcagcaatgatcattccgcagacggccacagactccagggccctgggacccggaccaccgtcatatggctctggccccctttcctggcacaaggaggacccaggaataatcctggcaccttgctctcctgggccttgtttccctagagtgacctgagcagctatgcctgtcctcctggttcttccaagcagcaccctgggccctccggcatcaagggaagtctcaagacttctaaggtcctcccagcagcacgcctggcgggccagggagtttgctggctgttgcctgggtaacctgagattccctggagaacgcccaagagcaaactctgcatttttccggattatctttgctccttcccccatgtggacgtgggctttggagggaagagtgtagccatttctctaacacacttgggcacatttgcatttgtttttaacacatttcaggacgtgcaccctacattccggtcaaaatatatggcacaaagctataaaatcgttttttcttcaaggttatttctcatcacaagataaatcatttctaagccaacagctgtcccttttcaaaactgtcaagggagggagtggggaaacctcttttctcagaaatgaggaggatacaccagtagaagagccctggctttgcctgcttcgtcttctcaacacgactgttttgcaagatgtcgtgttatcagaagcatcctttgctcccaaactcaaaatgatgttaacatggtgagcaggaatagtcatgatattgcaaccacaataaccacaaacacaatttcctgaggtgttctttgaaactccttgtatctgcttaaccctcgtaagcaaccacgatgcaggtactatgatcggttccattttacagatgaggacactgagacagagcaagcactggcccagagccacacggtacggtcggaaccgcgtaaagaggcggtgagcccaggcagcagagctcctggccccaacgatctccaggtgaacggggcagcctgtcagtgcggcagagccatggggctaactctatgtccctggcattgctgtttaagctaacaggttaggtacgggcataagtacaaaatagagtatttctgctaatgcaacattagagaaaaatagaagcagaatattagaagaaaagataagcagtaattatcacagaaaaagaaattttcttacatccccaaagcagtaagaacagacagcagatggcctgagaatactagacaagtcaccacatgaacacacacgtgtaaaactcacacacacaatctcagagccacacggggcggagtcgaaaagtccctggacctctcactcaatcccttagccctaaaggaccactgggctcaataaccaggctggtgatggcgatccgagtcaagaatagatgaaaatatactcagcagactgtcaggcaggaagactgttaccagctgtggaaacagtccatcatgaagtcaagataagaaaatatttggcatctggggaaatttcatggaaatgcaatatttcactctctggcaatgccagttcaatgattccgcacatacatttccatccctctctctacacacacacacacacacacacacacacacacacacacacatatataatttcttactttgaaataattttagacttgcagagagtgggaaagacagttcaaggactctgcatatatcctccgtacatactcaccgtacagttatcaaaaccaaagcaactcatgctggcgcgataccgttaactaagctgctggctttattctgatgtccccagtttccgcaccgtccctttgctgttcgggtctcctctaggtcccgtgttgcatttagccctcatgccccctgctcacccccagcctatgggggttcctctgtctttctctgtctcttctggccctgctgcgtttgaagtcccggccaggcattttgtcaaatgtccagatctggacctgcctggtgctttctcagagcagactgaggtttggggtttgcggaaagaatgccgcagaggtgacatgcccttctcagcacaccacactagggtaccggatggcagtgagcagggaggctcacctggatcatttggtgaaggtggcatctgcccggtttgtccactgtgaagttcctattcctaccccgccccccacctttcttttttgagatggggtctcattctagtgcccaggctagagtgcaatggtgcaatcttggctcactgcagcctctgcctcccagactcaagcgatcctcccacctcagcctcccaggtagctgggattacaggtggataccaacatgcctggctaacttttatagtttttgtagagatggttttttttttttattgttttttttttttgagatggaatctcactctgttgcccaggctagagggcagtgacatgatctcagctcactgcaacctccgcctccaggttcaagagattctcctgcctcagtctcccaagtagctgggactacaggcaccagccaccacacccggctaatttttaaatttttagtagacatggggtttcaccatgttggccaggctggtctcgaactcttgacctcaggtgatccatctgccttggcctcccaaagtgctggaattacaggtgtgaccacctcacctggcggagactaccctttagttttacaacagctttcttaagatgtcatttgcaaagcatataatgcacccatttaaagtatataactccagggtttatagcatattcacagggatgtgcaagcatcaccactatcaattcagactaccacttataataaatacctatttaatttctaagctatatatatttatatatgtatgtgtctataaaatatgaaatcattttttcaatttctataacgaatgaaaagccccttacttcctcaaattgggccaactgagcctactcataatgacttgacacatagaaaacaagtagataaaagaagttatcatttagggtcattttcaaaattcactgtcacaaaaggatggttcctgaggtgagtggccttaaaggggaaggagaaaccttttgaaagcaggacaggtcctctctgaatcatccccgtatgggtaaatctacatcactagcttcattactgactggtccatgtagaaacacccagtggccaagcagcccggggttctgaataatagatgaaggtaaactcaggaagaccagccacgcaggtgcgctccagggaggcctttcagagatgtactaagatgctttcacagctcaaatggttccctgatcagaagtaatgtgatacaagtaattcaattttgggttttcttttcttttcgagatggagtctcactctattgcccagtctgaagtgcagtggcgtggtctcagctcactgcaaccttcacctactaggttcaagggatcctcctgcctcagcctcctgagtggcttaggactacaggcatatgccaccacacctggctaatttttgtatttttagtagagatggggtttcaccatgttggccaggctggccttgaactcctgaccgcaggtgatctctctgcctcggcctcccaaagtgttgggattacaggcatgagccactgagcccagttgggttttctttttcttcatgaagatgttggaaaagctgtttttattgatatatggcatctagatccactcatcacccacagggttcatgagaaaatggaaagcaaatgcctgctggagcgctgacgtcacattcaacaggccaaggcacacatgctcccgtgtcatacaagtgacttggttacggccgagagcatccaacccacagcaatgctcagccgcaatcactgtgagaatctccctcgaatcggaaccgtggagaagatgggaccttccccagagagtcagtgacttcctgcaggcaagctgggaccgtctctcggcccctcccagtcctccatggctccgtctgtggtcactgtccctgctctgcgtggagtgaaggcgtgcgtgccgagtgtgagcgaggcttcttctcagccctggcgtccacaggcaccattccggctcatctcccagcaatcccgagaggtctcttccttatcaccaccgcactgaagaggaaaactctcacttagaggaattaagtgtgtgtttgctctttcttttctttttttttttttttttttgagacagtgtctcattctgtcaccctggttggagtgcagtggcatcatcacagctcactgcagcctctaactcctgggctcaagcgatcttcctgcctcagctgtctgagtggctaggactacaggcatgagccactgcacctggctgcagtttcttcacagtcgcaaagccaaggcttgagaagggtcttgcttcaagttgcgcccctgcccgccgtggtccgcctcccctccgcgacgctgacagtggcgtcctcatgtctaatgcttactccttggtttccttcttgacctctccttccttcactcgggcagtatctgtcccccacattatgcaatgtcagggcccttaggatgaggacctctcactgctggtcatttcaagaacccaaggccaggcacagtggctcatgactgtaatcccagcattttaagaggccaaggcaggaggatggtataaccccaggagttggcaaccatcctgggcaatatagcaaaaaaaaaaaaatttaaaaattagctaggcatagtggcacatgcctgtggtcctagctactcagcaggttgacttgggaggatcacttgagcctgagagtttcgagctgcagtgagctaagatcataccactggtactctagcctgggcaacagagcgagatcccatctctttaaaaaaaaaaaaaaaaaaaaaagaagccaacacttgggtgtagaaagggttccctttgagctatgacttcaggaccaaagccctggcctttgacatcactatcatttcctggtaggtcgttacagtacacaggttatgttacattagataagaattttccagctatgacctaggagatgacttaaggtcacagaggacacacatgctaagggcaggaaataaacccttcgtgggcgctgccctggttctacacagttctgctcgggcttctgacttcagtccttcgcctggctctgcagagctgcatcgctccatgtgtttaattaaagaattaaaaagccaaaaagaaactgttaattactacatgccaggcaccatgctcgacacttgggaaatatttaagttatttaacactcagtctctgaatgcaaagagctcccaggaagacgcataagaaacaaagatttaagatcgtgtatgttacagccaagtgggacagactgaagggactgagaatttggagacgagggaacagcgttatcagctgcggaggcacgggaaggcgtggtggagctgaacggtgaatgcagacaggagttcaggggaaagagaagccatgagtatctcaagtgagcagcagcaggaacaggacacacgtgaaaatctacgcatgctccttcagggaacgtttcctgaacaccttttctctaatgtattggtccttggcatgaaactccttttactacatgagcattcccccaaaaggtgtgaccacattagccctgcaaggtgcagcttgaaaaaaaacaattgtgctcaaagaggcctgagaatgctgtatataccgcgtcctcctctgaaggcctagctactgtctactagcctagtgaaggctccgagaagtcctgcagtaaagaaaccctttctgtgttgaatatcccaagcttcccgaatttactttaccactgagcaccctcctccctttttttggagacaggacaaggtctcactctgtggcctaagctggagtgcagtggcaaaatcatagctcatgcagcctaaattcctgggctcaagtgatcctcttggctcagcctcccaagtagctgggaccgcaggcacaggccaccaagcccagttaatttttaaaatttttttgtagagatgatgtcttgctacgatgaccaggctggtctggaaatcctagcctcaggcatccctcccacctcggccgcccacagcaccaggattacaggcgtgagccaccatgcccggccttctgtcaacttgatagatcacaagattctcagaaactttcaacaatatttggaaaatctccacatgccaagaagatacgctaaatggtttttgctcattccgaccaaaacaaatatatatgactagagtgcaatgtagtgtagaatcgccattgctaaaaccgtggtcactaaacccgtgagcatgtgatatggtgaactctgcgaccgcatcccctaacggacagaaacacacatatgtggaagctaaaatggcaaacacaacgaattatatatttttggctcggggctgtctttcacgacttaaatacagctcagtttgcaggctggaggaaacaattcttccccaaatagcaaaaccattcccgattccaccccacgccagcccctccctgcccgggtccgctgtctaggagcccagagctccattttctgactcctgcacaacgtcagcccaggcaaggcggctgtctctaaagtttgcaggcatccagggaatctcagatacatgagctttacacatgtgccaagagtacagggaagagagggtccaacaccactgtcccggtggttttcacccaggggtgactctgcacccccaggggacactgggccatgtctggagacatttttggttggcacagctggggagtagggtacgggtgggtatgctgccatctggcaggtggcggctagggatgctgccagccatctgacagtgcacaggacagccccacaacacatgactacctggtccaaaatgccagcggtgccaaggtgagaagccctgcattacactaacaaagcacccaacgaccgcgatccacgagcggagttgacagaacccgagtgcaatcattacgtgtaactgggcgacaggcactatgtattctgacccagtaagtaatctgcataccccagctgactgccacataatgaagactgttcctcgtaaataccaatagcggctttcaaacctgtgaatgaatgtggagaggcagggacgtattgggtgaagctgtaaccactggccgccatcctcacacataccccactgtgttatctgagaacacaaagcagcataggagagctgttttgattctctgtctcattttaagaatggagacagtagatgtttaaactataaaaataaacagaaggtaccagtggggaaactaaatcaaatgtgaaagcaaaggaacagctcataaactgaaatgatttcacacacccaaggtcgaccgcgccaattccctggtagtttatgatgacaggtcagtccagaaacgggcacttctaggcagctaccaggagatcccggttccaataatgaaatactacaatgttctcggcagcctgtcctctcagtgagctgtgtcctaggattcacccacaccaacatcatttcaagtaatcataaaatagtggatttcaagagacgtagaagtatttgagaaagtggtctctgaaatcagattatcaactagctctccacccaaggtgccaaggaaagccacctttactgtcatttatcaccagcttctagaaatcccaaaaggcaccacaggtcccaggaagagaaaataactaataattcaaatgagaagcatccttgtgcaatggaaaggcaatggaggtgcgtcatatgtcaaaaagcaaggatgttaaaaatgcagaatgctactaactttagactaaatattaaaatcgtgaaaaccaaatcgaaggtcattccaagttgtttgcctcagacctggaggctgcttattatttcacgtgctctactgcagaattaatagaaagttttagaagtaggaaaaaaaaaacaaaaaaactaaccttaaggttatcaaaggttttgacagtctgcgccaagtcactgacattccctgatgacgctgtcccctgtcccctagggcctgaggacacctgtgagccgtcaatgacctcaaagccagaaagcaaggcctctgcacagctgcagcgagactccttggctctctgacccgatatcaggtatgtcttcaaacctatgatggataaaagttacagtcagcacagattgaaagcaccgtctgttgaaacgcagctccgtcttgctctctggagaggactcactcctggaaagttgagagtaaagtgaaaatgtgaataggtcatagtttacgacggacgtccacgatctctccagagagatgcggcctcagggagaccgtgggcccccgagacacaccactcacccacgttacgttttcttggagtaatggctgcatgtttcatgttttaccttcagggttaaaataagcattaaaaagttcctccatgaaagggtcccaggacctccccgtgaaggcagcaaagcagattggttgaccctagacactgctttggtttatttccatctgtgaataccagtccagtgagtaccttcctaacggtcagtctagacgtcatggcagcttccggtactgaccatcttacctgtgtcagaggctgcaaaactaccccgaaaaacaagaccctaccagggaccaagaggccattaaaacctccccagactcagagctgttgagcatctatttcctgttggattcaaacactcaccccaggaacattcagcttttgttaagctgaggtccacatgcattttattgtctcacaaaatcccgcatatagaaaaaaaaaaaaaaggtggtcaaaaggacacttgacctgtatctttacaattctcctttgaggctgagctaacagccggacccacactgcgctggaaggagctgtgaacaggtgggtggatcctgccccgggaatctgctgggaagatggcaaaggagcagcttttctagaaagagcccaaggaatttttgaaaaagaagcaaactttatttaaagaaatccatcctttgacttcactggaatttaaccagatggcaaatgtatcggaaggagggacaatgtaatttaacatttaaataacatttatttcaggcctagtgtatgccacacaccgagaataaaatcatgaacaaagcagggtcccttcttttttttttttttaattgagatggagtctcactctctcacccaggatggagtgcaatggtgcgatctcagctcactgcagcctccacctcctgggttcaagcaattctcctgactcagcctgtgagcaggcaggtgtccaccaccacgcctggctaatttttgtatttttagtagagacagggtttctccatgtcggccagactggcctagaactcctagtgatctgcccaccttggcctcccaaagatgacaggtgtgagccactgcacccggtcgcagggacccttcttgaagggtttaagctccagcttcaggtcgtgaagggtgtggcatggaaagatgccatcgagaggcgacgtgtctacaacactgatcgactctggcttcttacgctgggtacatatttggtcagcgctttaaaattaattaatcagaaacctagggactacttcatcaataatcccgaatcattttataagtatggccccatctcatcacttcacctccctctctccttgtaaaaatactacgtggctaatctttttaagtcaactgttctgagaatttgccaagagtcctagaaacacgtaaagacagcctagaacgtagccaggtcatagctgagaatcaaaagacttagatatttttagatgccaactggccccaagaaactcttcatgttttgttttgttttgttttgttttgtttttcctttagagatagggtcttgctctgttgcccaggctggagcgcagtggtgcaaccatggctccctacagcccccacctcctatagcctcagcctcctgagtagctgggactacaaacgtccgccactatgtccaactatttctttctttcttttttgagatgggggtctcactgtgttggccaggctggtctcgaactcctagactcaagtgatccgcccatcttggcctcccaaagtgctgggattgcaggtgtgagccaccacacctggtccaatgaaaatctttcactcttacttagctcctgaacttttgtgcatttttttctccaacaaaaacccacatcccaatttatgcacaggatcaatcacgactgtaacatgtatacactgaaatggaaacgtgaactggaatacgacgcaggagtgaagccatctttatactaatttctcggacctgtcccaggcgacaccagactgactttgtaacttcactttgccagagttaaaaaatgcaacctatgtggactcaagagaggacaatgagctgccagggcttatacccgccttcatcaaagaagtacacgcaaggaggcctgtcctggggctgctctaagggtctccttcccatgactcctgagtgtggcccacaagtcaccaggtggcagggtggtgacaggagccactgacagccagtgtgactgtggatggccactctggagaccgcagtccccacatactgagagaggagggacatttttttgatgggaggtaggaaaagttgcggctgaaggatgaggttttccattatgtctgtggctggccctgcaaggtgctgttggctcagggtgcccctgcctgaggctacggctccccatgcacaagggctgccctgggagcatgaactgggctgcctctgaaacccaggaaggggccctcacccaggtgactgcgcacctgctccctgtgtggctccgggactgcaagagaaagtcaagatggcctctcctagaagtgcgtggcaactgaagctgagagaggctgagcagggaggcctgaagagctggagcacgacgggacagccagcacattcacagcgctcagcacggcagtccacggggagcacggagtggcagcggcggcctctgctcacaagctgggcacgtgcctcaagcacatctccaacgtctgctgttgcttttttgtactgggattactgagtcactcttaattcatcaaacatttattaagcacttcctgtttactacacactgatgggtgcagggacgatgtgtgactattttggccgagatcgtgacctgtgtggagcccattacctgaagaggggccaagaggacaagcaggtatgactatggtcaggcgtgccaagtcccaggacaaggaaggacgggtgctccaggaagcacaggagggggcatcttgagaagcctcaggaaggaaggggctgtggctcgaacgtgtcccctccaaagttcaggcgttgtggagtgagagtcttaaggaagcagggctttaagaggtgacgaggccaggagggctcctcccctgcgatgggatcaggcgcctgcataaaggggcttgctgtaaggggctctctcgcttgccctccagtttccttctcccttccagaagatgcagccctccccagacacctgaacctgctggtgccttgatcttggacttcccagcctcctgaagcatgaggacagaaatttccgtgctgtatagattacccagcctatgctgttctgttattgcttcacaagcagatggagacggacggatcagcaccctccacacggagaactgaaagacggggcgaggtcagcccggcaatagcaaaccaggccaggggcgggggtggctgacaccaggcaggggggttactagaacaggtcatgaaaggccctctacagaggtggcctgcagcaggcatagctaaaggatggcttggagctcagtgtggctggagcagagaacgtgtggagggaatggccagggctgagccacagcacctgtgcagggcactgtgtgggccatcctgggaagcctccattctggggccacgggcagcaggggggcgggaggagaaagaagagccacataggaggcatgaggcgtaggacaagccagggagccggtggaaatgccagccacagcgggtgggaagttgggaggcacgggagtcaggaaataacagtggaaacgggaaacctactccccacaaactgctggcgagaggcaaggctcccattacaagcaaccaagcgtgatgggcgagggcctggctgctggagggggcctcggagtcgggtccaggtccgccccctaatcccgtgatctaagtgagctgcttcatctctgcctctcagtttcctcatctctaaggggagggcaggagcagagctagtgagctgcttcatcgctgcctctcagtttcctcatctctaaggggaggacaggagcagggctagtgagctgtttcatcgctgcctctcagtttcctcatctctaaggggaggacaggagcagggctagtgagctgcttcatcgctgcctctcagtttcctcatctctaaggcgagggcaggaggagggcttaccacacagctcgcatgtgaggcttaaatgatcaacacgcacgcagcaagcactcgacattagctgtgattatcgacgcagtgtttgatctgcgtatcactggaatctttttcatgcaccttctacatacaaaagcatttgcaaaactgttaaatcaataattgctcctgatttgtttctgacttgagtttttctttaggaagcgctgaatgaccaacccatagtgataacatgatcctactagctttacgaaggtcaaacacacctccgtgtccacaacgagcaaaatcgggaagtaaattatctttttatttatgcttcaatatggaaagctaaatttaaagtgaaaccttttgtcagaaccagaagggttatcaccctgacaggtaaggcagagcccagctgcctaatcacaaacgcctgagaaatacatcaggacaggttactgagttcaagcccagcgaaagtcttaagtcaggagactctgcaggcgacatgatttaatgaataaccacacacatggaccctggggtccaagttcattagaatggctcttttgcagcagaaggtccaaaaaaaaaaaaaagacagctaaatgatttaagtgtagtgtaaacaggagaataattaatatgatttcttatattctttcctggttatccattgattttaaacctcaacaacagcgatgtcttttatcagcttaattttacaaaggctacagagaggggtgggcatttcctaatgggctcctgtctgacgggggaatttgtctatggctgtgtgcgtggaggttaacgcagttaacgttcttaagtattcttaagtatagtgtcacttctttgaaaactaaaactgcactttgcacatagtggtgatcaggtttggtgacccaagtataggaagagtgactgacaaagcccattttggaaaagagtgatgggcgaggcccatttctggcctcatttgtcccagtctctttctgtgggattcttgccttggactgagataccctcagccaccaagaatcaaggacctgactgccaactcaacagaaagagaacaacagcgaggcacggggatcacagctgtgaccccggcactctcggaggccgcggcaggaggatcacttgagcccaggagtttgagaccagcctggacaacatagcgagatcccatctctataaaaaatttaaaaatcagctgggtgtggtggcacctgtggtcccagctacccaggaggctaagatgggaggatcacttgagcccgggaggttgaggctgcagtgagctgtgagtgcgccgttgcactccagcctgggcaagagagtgagaccctgtctcaaaaaaaaaaagaaaaagaaaaacaagccaggcgtggcggcacacgcctgtaaatcccagctacttgggaggctgaggcaggagaatcgcttaaacttgagaggcggaggttgcagtgagctgagatcgtgccattgcacttcagcctgggcaacaagagtgaaactccgtctcaaaaaagaaaaaaaaattaaaagaaaaagaagaaaagaaaaacaagaaagagaagaataatcaggaaggaaagaatgttttaagacatgactttgggagccagccacatagcataacaaatgcctagaagcttacgtcacttatgacttaaaacaataaacagaaaagaggcaatcagcttgggctggttcagaaacattccaaaaacgtctttcactttgcattgcattcttcctcacgactaggtcggaaacgaccaagcggcatgagagttatttaaactaaactgtaatcagccaataagaaaaataaagataaaaatactcttaatctaccaaatagccaaagcctatggagtcatagatatattttataattatctattctttctgcgtaagaagaacaaaagttttggtacaaaagagagaatatctttcatatgttaacattaaaatgctctccggagggttgtaagtccttcctactcatatgcaccataaataatcataagaactgatttgttcttgttgtcccaatatttgatgataaatctcaagttcctactacaaatggctgctggtgaaacttaacctcttcttaacaaatgaagtcccaggtcaggcgcggtagctcactcctgtaatcccagcacttagggaggccgagacgggagcatcagttgtgctcaggagtttgagaccagcctggccaacatggcgaaatcccgtctctactaaaaatacaaaaattaactgggcgtggtggcacatgcctgtaatcccagctactcaggaggttgaggcaggagaattgcttgaacccaggaggcggaggttgcagtcagccgagatcgcaccattgcactccagcctgggtgacagagtgagactttgtctcaaaaaagaaaaaaaaaaaaaaagaagtcccaaataataaaatatgagatggatttatggaagaaagtgaaagaaacaaagggtaggcaccttgcctgtttaatttgatcttctgcttaaccaaaaaaaaatttttttgtttttttttgagacagagtcttgctctgttgcccaggctggagcgtagtggcgcgatctcagctcactgcaacctccgcctcccgggttcaaggaatactcctgcctcagcctcctgagtagctggaattacaggtgtgtgccaccatgcctggctaatttttgtgtttttagcagagagggggttttgccatgctggacaggctggtctcgaactcctgacctcaaatgatccgcctgcctctgtctcccaaagtgctgggattaaaggcgtgagccaccacacccagccagaaaataaaattttagagcatgtgcacgcattctctctctctctccctcccgcttccccacccctgcttctaaacaggtaccttctatacccagcttccctctctctcccagtaatggctaaacagctgccatcacagccaaatgggaatgacaggcatcccctgagtgaccacattcccctgttttggccttttttttttttttttttttgagacagagtctcgctgtgtggcccaggctggagtacagtggctccctcagctcactgcaagctctgcctcccgggttcacgccattctcctgcctcagcctcccgagcagctgggactacaggcacccaccactatgcctggctaattttttttgtatttttagtagagatggggtttcaccgtgttagccaggatggtctcgatctcctgacctcatgatccgcccacctcagcctcccaaagtgctgggattacaggcgtgagcgaccgtgcctggcttggcttcttatcttctgtattccgagttaataaatgccccactgctaaatgctacattccagaatgctaacatagggagagtccaggagtccacacacttcagagaccttcgcctcccacctctaagaaacctcttgaattagggtttactagcacgagccttcacaaagactgtagaaatgagtctctgagagacgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctaagggttgaaagaaataaataggttaaaaaagaaaaaaagccacctaggtgactttcactccaatgcttgacctcagttcccttgtctagataatggaaatgctggccggcgcggtgactcacgcctataatcccaggactttgagaggccgaggtgggcagatcacttgaggtcgggagttcaagaccagcttggccaacatggcaaaaccctgtctctactaaaactacaaaaattagccagctgtggtggcaggtgcctgtaagtcccagctactcgggaggctaaggcaggaaaatctctcgaacccgggaggcagaggttgcagatagccgagatcacgccactgcactctagcctgggtgacagaatgagaccctgtctcaaaaaaataaaagaaaaagaaaacgaaaatgctgtgatatgatggtcatatcatagcacagggctgttgtgaggattaaatgagttgattcaggtaaacagggacatccgaaaaagggaaagacggtgcttgtcctgagaacagctgtgaatgtgaggacagtcagtgagtgacgatctggacccacaagaagagagtcatatgcattcaagtccaagtgtctatgggctgttcagaagcaacaaatggcacttcaacaatgagttgcagacaacaaaatggaaatgaaggtctgcaataactattaagaatcctgtaacagagcagagtttaaataatgggaagaggctatgaaacaagagagctggggaaagataccagaactgaaacagaccaccagctgatcaccttttatttgtgaaatgacagcaccaaatgcaccagatgccacagacgggagggagggggataggtcacgtcggcagagggagggggtcaggtcacacctgcagcagggacgggggtcccagaccgtgttcttgtccctagagagctaacagctcatccgtaggtttctaagaggtgctgattcaagcacacagtgtagatgatgaaaaatagattatagaaagaagagaaaggaaaaactaaatttaaaatctgagactaggtagccactaaatacttgaaaacaaaaaaagggaatacactgaaaatggaaataaagctgtatgatgtttagttaaagaagccagtcccaaaaggccacgaactaggtgatcccctttatatgaaatgtctggcatagggagatctgtagacacagaaagcagatgagtggctgccatgggtttaggagagagagggtgtaactgctaacggatgcagggttactttttggggtgacgaaaatgtaaaattaggttgtggtgatggttgcacaacaccatgaatatactaaaaaccaccaaatcatacacttgagagggtgaattgcatcatatgtgaattatacgtcaataaagctgtttttttgaaaaagaaaaggaagctgggtgtggtggtgcatttctgtgatctcagctacttgggaggctgaggcaggaggactgcttgagcccaggaaatgaaggctgcagtgagctatgactgtgtcactatgctccagcctaggtgatagggtgagaccctgtctcaaatataataataatattaataatacaataaaataaactaaatacagtaatgtgaacatcaacaaggtgcaataattctgagatttagagaagaaataaaataaagctgggaagaaatacaccctccctgagaatacaaggtagagtgagcagtagcaggtaaatgaaaaatattaaaggcttagaaatagataatgtgggccaggcatggtggctcacacctgtaatcccagcactttgggaggccgaggcggggggttgcttgaggtcaggagttcaagaccagcctgaccaacatggtaaaaccctgtctctactgaaaatacgaaaattagccaggcgtggtgatgcacgcctgtaatcccagctacttgggaggctgaggcaggaggatcacttgaacccaggaggcagaggttgcagtgagccaagatcgcaccattgcactccagcctgggcagcagagtgaaactccttctcaaaaaaaaaaaaaaaaagataatgtggtagagctagggcagaaaaacatgcaagtcaagaataaggccaaataaccttgaagaactaaaaattcaacatagcaaaagttcagaagtctgggagagattaaataaaacaaaacaaaagaaaatttgaccttcatgaaatagctccaagaatcatccaatttgcagctctcactattgtagtccaacctaaaaacgccgggccgacacccacattgtcttcttcgagcacaaacacacttctcctgcagcaggtgtagcccgcacagcatggtgagcccagccacacccgcacgccagacgcttggccacagaaacgcagaagcggccactgtccttgcctggaacacagatgggccttttcatccaggaggagatttacttgcaaaggcattttcttctgacccacaggtggttatacctgcactgacacctcctgtgggcatcttcagctggaagaaaggccaccgaggctgcggagccacctcgcctgtaaacatcatatcatgcaaaggaaaagctctaagttgcggaatattcttctctttttttttttttttttgagatggagtctcgctctgttgcccaggcaggagtgcagtggcatgatctcggctcactgcaacctctgcctcccgggttcaagcaattctcttccacagcctcctgagtagctgggattacaggcacctgccaccatgcccggctaatttttgtgtttttagtacagttggggtttcaccatgttggccaggctggtcttgaactcctgacctcaagtgatccacccgcctcggcctcccaaagtgctggaattacaggcgtgagccaccgcgcccggctgatgctgaacatgcgtgactaaccttccgcgggagcagtcatgccgctgccttcaccacctgttgcttctgggaaatgtggatccaggctgctggctctctcccagatcgtatctgcagcacaggcacatgcttgctgtgaatttccacacttgtcagatcacccggttttcaacttgttttctagttttctctcttttgaagagtattttgcacactggctggggcagaggctgacagtttcccagactgtgttttcttgtttacagagcacatgcagacttgttcgagtcatctaacggagaaacccaaaaacctccattttctcctgagatatctctgctatctctaatttcacttcagcagcactggtggctgaaatactatggactatgtatttcggacttcctttttctgaacttttctggaagaatcgcagttgtgtgtgtgtgtgtgtgttttgttttgttttgtttttttaagagaaaaggtctttctctgtcacccaggctgcagtgcagtggcatgatcacggctcactgcagcctcgacgtcctgggctcaagtgatcctcccacctcatcttcccaagtagctgggatgacaggtgtgcaccaccaagcccaccttcttttaaaaaaaaatttttttttaaagatggaatctcactatgttgcccaggctgggcttgaactcctggcctgaagtgatcctccggcctcagcctgccaaagtgctggaattacaggcatgaaccaccatgcccagactcaggtatttattaataacctcaaggtgttgctgcacattccataagttgagagcaggtccactctgccacccagggatgtcccaggctgggcgatttgttctcccactgcacaccatgcaactgtcatttatgccttaagaaaatcccattgaagttgtggactcaatgcacaatcaaaactgaaagcaaaaccgaggcagtgagtagtgagtgcccaagcacgagaggaggggacaaaggctgggtccccggccatcaacaaacggagagctagctcataaaacagtgacctggagcttcagtcagcagccctcactcccaaaaggggtgaggagtcttcagaaactcccctgtcttatggcagaaagctgagctctgcacagaccctggaaaaaccactgttgtcaaaggagagatggaagtgggcagaaagcccaggaaggagggttccagactagtggaggtactagcctcaaacaagacagctgagtacttagagaagaagagatacatgccaggcatggtagctcatgcctataatcccagcactttgggaggccaaggtggaaggatcacgtgaggtcaagagtttgagaccagcctggccaacatggtgaaaccctgtctccactaaaaatacaaaaattaaccgggcgtggtggcgggagcctgtaatcccagctactcgggaggctgaggcataagaatcacttgaacccagtgggtgaaggctgcagtgagctgagatcgcgccactgcactccagcctgggcaacacagcagactccatctcaaaaaaagaaaaagaaaaagaaaaagaactttctatgaacttcccgtgatgatgggtacatcctgtagccgtccagttctgtggcctccaggcacatgtggctactgaccactcgaaatgtagctagtatgaacaaggaattaattttttaatgatttcaattataatttaaattttaaacagctacatgaggctggcagctatgtaggaagcagtgaagatccacatccttccttattggtgaaaggaatgaattggaaacagaaagttcttttttacctttattaaataaacgtgaagtcataagaactactaaaagaaaatgggtgggataaaagtaaaactaaatatgaaaccagtaagtattcactgttatttattatagatgacatttagacgcaaatacgagagggagagtaccctgtatattaatagcagggatagccaattacaaagtggaataagccaggcgtggtggctcacgtctgtaatcccagcactttgagaggctgaggcgggtggatcacttgaggccaggagttcgagaccagcctggccaacaaggtgaaaacccctctctactaaaaaatatacaaaaaattagctgggcttggtggcacacgtctgtagtcccagctgcttgggaggctgaggcaggagaatggcgtgaacccaggaggcggagcttgcagtgagctaagatcgcgccactgcactccagcctgggcgacagagcgagactccgtctcaaaaaaaaaaaaagaaagtggaatagaaacagttactctatcgaacaaaatagcagataatgttttagaataaagaaacaaaagagctggaaacatttgaacgttttcaaaaaaaaccctataagtgggatgagatactggttcacaactctaatttagagcctatataaacacattagcttgaccttgcttgacatacattatttctaaaaaatgttttaaatgtgaatatttagaagatacaccatattttctgctttttatatactataaattttactatgtgagtttaaaaagtggttggtaaaacacacacccaagctctctgatctttcacacccattaaaagcagcacatgtattaaacacactgctgcacaatgggcgtgccatgggtgctctccaaccgcattgggcttgaatgtttaactaggcctgaagccacagtgctaacaagatctggcagagacagacaaggccacgccggcagcaggtgtttcaggaaaggtattactccaccatcccttgcgctgaagccttagcctcaggcaaattcatgaaccaggtagaatctaattcaggtcactttggccaatctccactttctaccagcctcctccaggtccctactgcctcgggaggccccctacccacctgccaacctatcccctcaccatctaccggcaccaagtctgtgtgagcacactgtagatacacgagctccgtcccaactcagagctaggagagtatcagaggccaaacgcctgccccctgcttctgggctccaccagcagcctgggaggccaccccctgcagctgactcatctgcatactgagacttcctgacacaaatggaggtgacaatattcgttcccccatcatatcccagaaattcccttattgccgacatccattctgggtttttactgcgcttcacacgaggacaattccaggctgaagtggcaggtcccagcaccagactccacttcatcagaacacttctgttagagtctttgaaacgcatgaaatcccctttagggtccataataacgccttctggaaactcgacggcaagccactcaccctcagccctatcagaccccatggctccttacatttctgtgacatacttaatttgcaatgtcctcttttccatcatgaaataaaattaaattcatggacaacataacctttaatcactgagaccataaaggacacctccagcagctgactagccttccctcagccacctttgtgcccagcctaagggcagggtggcaccggagcctccatgcttcaaaggtggccaccagggcccatccccctttccatgcttctccctgcccagagagaaacagcctgaggacaggttaaagactaaatacaaccaggcatggtggctcatgcttgtaatcccagcaatttgggaggccgaggtgggaggatcacttgaggtcatgagtttgagaccagcctggccaacatggtgaaaccccatctctactaaaaacacaaaaattagccaggcctggtggcccatgctgtaatcacagttcctcaggaggctgaggcatgagaatggcgtgaacccgggaagcggagcttgcagtgagccgagattgcaccactgcactccagcctgggcaccagagcgagactccgtctcaaaaaaaaaaaaaaaaaaaaaaaagactaagactatgccacaattccgcatatgcatgtatttattatatacatatatgtataaggtacatatttgtatgtgtatatccgtgcatatgtgtatacctgcagcaattttttttaaaaggagaaaataggccagagccagtggctcatgcttgtaatccccgcaatttgggaggctgaagcagaaggattgcttgaacccaggaattcaaagcctcagtgagctgtgactgcaccattgcactccagcctgggtatcagagtaagaccctgtctctaaaatataaattaataaataaaaattaaacggagaaaatttcttaacaacttttatcctattcattctttcaacacataataagctcctgaaatccgttaagaatgagattagacctattctaaatcctactaacaccttacattgactctgtcttattaatctcagtactgtagtacctgggggaaggcgcagcaccgtggacactcagaaacgtcaagaatcaaatcacatctctacaacggtggtccatctgcaaacagcgtggagatcaaggaagggcagaacaaagtactgaaagtgctgtcatttctctggagggtgaattacacagaccaactttcttcacataataagaaacaagaagttgtttgtttatgggttctatgggagcacccgctgcaggccacgctagacgctggtgataaaactgtgaacatggcgtccatcacctgactcagtggtaggaaccagtggcagggagaatccacaagcaaggacccgagtcaccagctgtgattaagagccaggaagaaagcaaaagcttcctgcaatagagaatacccaacatgcggtttggacagagtcagggacgtcctttctgaagaaatgagactgaagtggagatatcacagtgagatggaggcaattgcggtggtgtaggtctggggaaggcacgagggatgcagggatcagcatggaaaggacggtcccagcatgctcacgtggctgaaaggtggcaactgttcccgatgcagactgagggaagaaagtgtggcatgagaggaggctggggaggtgggccaggccctgggagccattaagaggtttctgcctggccaggtgcagtgattcacacctgtaatcccagcactttgggaggccgaggtaggcggatcacttgaggtaaggagttcgagaccatcctggctagcatgatgaaaccccgtgtctactaaaaatacaaaaattagccaggcggggtacatgcctgtgatcccagctacttgggaggctgaggcacgagcatcgcttgaacccaggaggtggaggctgcagtgggccgagattacgccactgcactccagcctgggggacggtaggagactctgtctcaaaacgacaagaggcatctgacttacatgctaggcacacacaagagctctgcagtgttttaagtaagacagcacacagttcgattctttcttattttgcattttaattttttaactttttttttttctcttgagactgagtcttgctctgttgcccaggctggagtgcaatgacacaatctcggctcactgcaacctccgcctcctgggttcgagtgattctcctgcctcagcctcctgagtagctgggattacaggcaccaaccaccatgcctggctaatttttgtatttttagtagagacggggtttcaccatgttggtcaggctcgtctcaaagtcctgacctcatgatccggccacctcagcctcccaaagtgccgggattataggcataagccactgcacccatccaattttttaaaactttttaattcaaactaatgttaatcatataggaaagttacatatacggtacagggagttctcatatatccctcgctccacttctcctaacgtgaatgtcttattgtacgacgtcaagcacagcttgataatcaagaacaggaaattaactagacgatgaacttgatttgagtttcaccaatttttcacctgatttatgttccaggatcccatccaggatcccacgcggctggctggctctttttaaagcctacacagctctgggtggcgaatggctccggaggtgtcaggagtagaagcgggggctcactcctggccttttgctgtggtccaggcaaaagctggagtggccttaggtcaggttcatgatttaaggtctaggcagaaccgacaggatgtgaacaaagggaacaaggacacttcctgggttcctgggttctgccttcagtacgtggacggatgagtgagaccagaagaagtaaaagtttagggggcaaaatcaggagctcagttctggacctcccaagctgaagatgctggtgacacgctcaagcgatagggacaaggaggtggccataccatgaaatcagaagggagctcagggccagagatccactgtccataatatcaccagggagaagacagcaggtggggaggcctgggaagcagccttggagctgcaatgttttgaacggccagggaagtgggccagcagggctctgaggagggacaaaggggtagggaggggggctgggtgtgatggctaaagcctgtaatcccagcactttgagaggccgaggcgggtggatcacctgagctcaggagtttgagaccagcctggctaacatggtgaaacccccgtctctattaaaaaatatatatatacaaaaattagccaggcatggtggtgtatgactgtaatcccagctactcaggaggctgaggcaggagaattgccttgaacccgggaggtggaggttgcagtgagcggacattggtgccactgcactccagccagggcaacagagcaagactctgtctccaaaaaaaaaaaaaaagaagtggatcactgtgaacgctgcagagagaagatgaggccactagcaaagccagcctgggtttggccactggccacgcaaagactgtcagtgaccacaccagggagaggtgcgtttgggcggcgaagagcacaggccaggctggcaggttggtgtgcgagtgtgtgcaaggtggagaaggcacacgcggtcagtcctttggagaagtctggcacgaggcctgccgaggaaatggcccgggggtgtggcagggcggaggtcctgtgccatgtcctgcactgaccagggcagcccacgggaaggcagctgcagagaaggcagaacccgcagctccagaaggtttggggcatgaccagcagaggccaacttctattgtgaagaagaaaccgactcccagactttcagggaagggggtgtgtttggtctggtggcagtggggacagcaaagtaggacccttgggtgtggctacgattgagaggatgtcaggtagtgtgagattcaggctggtgtagaatcactcatgagaaagtatctaaaatcttccagatgacagtgctaccagctggacagctgacagtgggcgctggctctttcaaaacagtgctccaaaggcaaagaaatagcaaagacagaagtaaggcacttaactatttgttgggtgaatatagaaatgaatgaatgaatggatggatgagcagatacatcaagaagttaattcacaaattaaagcccattatgaaactaaagtagaggctgggcgcggtggatcacgcctataatcccagcactttgggaggtcaaggcaggtggatcacctgaggtcaggagtctgagaccagcgtaggcaacatggtgaaaccctgtctctactaaaaatacaaaaattagctgggcatggtggcgtcacctgtagtcccagctactcgggaggctgagacaggagaactacttgaacccgggaggcggacattgcagtgagctgagatcacgccattgcactccagcctgagccaacaacagcaagactccgtctcaaaaaaaaaaaaaaaaaaaaagttaatcctgcaatgaccatacacccagaaaccccaatcatggatatttaccctagagaaatcaaaccttatgtttacaaaaaacgctgtacgcaaatgtttgtagcggcactattcataattgccaaaacctggaaaccaacctaatgtccttcccaggatgaatggataaacacactgtggtccctccccacaatggggcactactcagcatcacaaggaatgaactagagacccatgcagcatccaggacgaatctcaatagctctagactaagtggaagaaaccagtcttcaaagggtacatgctgtgtggttccattttaatgacaggctcccaaaggcaaaactacagggaatggatagttgttgctgggtcggcaggggcctggaggcagggaacttaaggccgattcaccctgactttttagaactgaatcaaaaggaaaaccatacccaggtaacaaaaggatcagaggctactactccctttgcacctcgtggcagatgaaaaatggaaagtacctctgattggttccctcccgcaaccaaccagactggtcccaggccaggtcttcaggtgtaacgttgcaacttcacttcaacctctgattggtcgcctcctgcaaccaatcagactggtcacaggccactccttcacttacatagggtgtaaccaagtaaccaatggtaaacctctacagggtattaaggctccagaaaattctctaatcagccacttgctcctgctcgagcctgctcccactccgtggagtgtactttcatttcagtaaatctgtgcttcccttgcttcgttttctcgttgctttctttgtgcattttgtccaattctttgttcaaaatgccaagaatctggttaagaacccagacaacttgtagtcaagaccctccactggtaacacccataaagggtgtattagtctgttttcacactgttcataaagactttataattatccgagactgggtaattacgaaggaaaggtttaactggcttgcagttccccatggctagggaggcctcacaatcatggcagagggcaaggaggagcaagtcacgtcttccatgacggcagggaagagagagagtgtgtgcaggggaactcctctttataaaaccatcagatcaactggacgtggtggctcacgcctgtaatcccagcactgtgggaggccgaggtgggcatatcacctgagctcaagagttcgagaccagcctggccaacatggtgaaaccccatctctactagtaaaacaaaaattagctgggtgtggtggtccatgcctgtaatcccagctacttgggaggctgaggcaggagaatcgcttgaacccaggaggcagaggttgtggtgagccaagatcatgccattgcactccagcctgggtgacaagagcaaaattccgtttcaaaaaaaaaaaaaagaaaaaaaacccatcagatctcgtgagacttattcactatcacgagaacagcatgggaatgacctgcccccacgattcaattacctcccactgggtccctcccacaacatgtgggaattgtgggagtcacaattcaagatgagatttgggtggggacacagccaaatcatattaaaaggtcaacccttgggaaagatttttggggggtgattaaactgttctgtatcctgattgtactggtggctacaaaacctatacatgtgttatgatccttagaaccgtatagcaagagaaaaaagtcagttcacaaatgataattagcaaaataaaattatacgttaccatacaatcttgcaattccaatccaagcctctactcacgagaaatggaaacaactaagacttgcaagcgatgttcagagcagctctgtttattacagccaagacgtgggaataatccacgtgtccagcagctggtgaatggatggacacactgtgatatatccacaccaccgaatttaactcacgaaaaaggacctaaatacttgatctgtgctacaatacagaagaacctcaaaaacaataagctaattgagaagtcagctacaaaagactacaatagtgcatgattccaattatatgaaatgtctagaaaaagcaaatctatagacacagaaagtagatttgtggtttgggactggaagcaggtattgcctgaaaccagatatgatggacctcatgggatgatggaaatgttctaaaaccagatgataccctaaattttctaaaaataaaattgtatacttttcacagctgagcttcatagtgtgcaaatgataccttagtaaaactgtctttaataaaaagtgctcaattcgttatctattttctttttttcttttttttttctttgagatggagtcttgctctgtcacccaagctagagtgcagtggcgcgatctcggctcactgcaacctctgcctcccgggttcaagcaattctcctgcctcagtctcttgagtagctaggactacaggcacctgccactgcacgcggctaattttcgtatttttagtagagacggggtttcaccatcttggtcaggctggtctcgaactcctcacctcgtgatccaccctcctcggcctcccaaagtgctgggattacagacgtgagccactgcgcccggcctagctatatattttttaaagtaaaacttgatccctacctcatagtgtacacaaaaaatatcagttcacatttcacgtggattatagacataaatctgaaaagtgaaacaatagagtatctaggaaataatattatagtttcatgacctcagaagtagagaaataggacaaaaaaagtcctcacctaacaaagaaaaaaagtggatcaattttatggtaggctgaaccatatgccaattgccaatatttgaccatttcgatctacaaaaatggcaatttcgtagtaaaaaggcaaaactagagtgggagaaggtatttgcctcacatataactgacaaagggctggtagcctgaatataaagaactcctcaaaatcagtaagaggccaggcccgggggctcacacatgtaatctcagcactttaggaggccaaggttggtggaccacccgaggtcgggagttgaagagcagcctggccaacatggtgaaaccccatctctactaaaaatacaaaaattagctgggtgaggtggcacgtgcctgtaatcccagctactggggagactgaggcaaaagaatgttgaacccgggaggtggaggttgcaatgagccgagattgtgccactgcactccagcctgggcgacagagtgagactctgtctcaagacaatacaaaacaaaacaaaacaagcccaacaataagaaaacaaaaccagaccactcagtagaaaaatgtgtaagaaagctgaacaggcacttcactgaagagccaacccaggtggccagcagacatatgaaaagacactcagccagggaactgcaaatcaaatacagaatcacaaatgaaaattaccaaaagaaactgcacccacccaccagagtggctgcaattcaacagagtgacaagcgctggtgaggatgcagagccacccacaggaaccctcatactctgctgacgggtatgaggtgataacaatgttatcaccatttgttatcaccatttgtaaaacaagtcggtattaccgatggaagttgaagacactcacactctatggctcaataattccccttctagacattgatttcggccaaagaaatgcatgcaagtgtgcaccaggatacagtacgtaagtattcacagggattattgtaaaagtcaaagcccagaaacaacccatgtatccatcaagaggaggatcgatggatacgttgtgatatgaccgagaaggcacaacagcagtgacgatgaaggaaccccagcgtaagcaacaggcaacaggaatgaagctcacaaactttacactgagtgacagaggcagccacaaaagaatatatactgaccaggggcagtggctcaagtccgtaatcccagcactttgggaggcctaggcgggtggattacctgaggtcaggagtttgagaccaacctggccaacatggtgaaaccccgtctctactaaaaatacaaaaaatcagccaggcatggtggtgggtgcctgtagtcccagctcctcaggaagctgaggcaggagaatcacttgaacctgggaggtggaggttgcagtgagtcgaggtcatggcatcgcgctccagcctgggcaacaacagcaaaactcggtctcaaaaaaaaaaaaagaatacacactgcaggttccatttgtacgaaattcaaacacaggcaaacgcaatttatggtgccagaagtcaggacatggttacctttagaaggaggaagtgggtagcgttgggagggacacgagggaggcttctgggatattctgtttcatctgggtgctggtttagtggatgtgttccttttgtgataattcttcaaactgtacacttatgcattttatgtatgcatattacacttcaatgcaaaatttattttaagaaacaggaaaccaaactcttcaaaaatgccaatagcagtaaagaaaaaaaaatgtgcggaactgttctagatctagatcttgagtgtcctcttttaggaaaagatcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaagaaaaaagaggacaaatatagatacacacacatacacatatgcacatacatatgtgtgtactgtattatatcccattcagggttcttgcacaaatgtgtgtataattatattcacacatacatatatacacacctacactgagacagccaaagaaatttggcaaaatgttaaccacgggtcaatcaggtgaagtgggatattagtgttcattatactattatttcaacttttctgtaggtttgaaatttatcaaaatgaaaagttgcgaaggccaggcacagtagctcacacctggaatcgcagcactttgggaggccgaggcgggtggattgtttgagcccaggagtttgagaccagcctgggtaacatggcgaaaccactggctaatacaaaaattaatcaggcatggtggtgcacacctgtagttccagttcctcagggggcagaggtgagaggatcatctgagcctgggaggtcgaggcagaggtgagccatcatcgtgccactacactccagcctgagtgacagactgagaccctgtctcaataaataaataaaattaattaattaaaattaaattaaaagttggagaaaaaagcaaaagcaagccaaaaaacagacaagccaaacacccgacgccaagtgttgaaggactcacagttggataagaaaaccaaaaagtccgggcgcagtggctcacacctccccagcactttgggaggccgagccgggcagatcacagggtcaggagttcgagaccagcctggccaacatggtgaaaccccatctctactaaaaatacaaaaattagccaggcatggtggcccgtgcctgtaatcccagctactcgggaggctgaggcaatagaattgcttgaacccagcaggtggaggttgtggtgagcagagatggcaccactgcactccagcctgggcaacagagcaagactccatctcaaaaaaaaaaagaaagaacgaaagaaagaaaaccaagaagagcagagacgggaccaccaggaatggcaagatctggccccctgcggcaggtggagggcaggacggctgctgggtggctggctgtgctctcctgcaacctgcctggtagatatgcaaaggcggtcaccttataacaatcagattgtacatttattttacgtggtcttccatctatatcacacaatttttttttttttttgagatggagttttgctcttgttgcccaggctggagtgcaatggtgagatctcggctcactgcaacctctgcctccctggttcaagagattctcgtgcctcagcctcccatgtagctgggattacaggtgcccaccaccatgcccggctaattttttgtatttttagtacaggtgaggtttcaccatgttggccaggctggtcttgaactcctgacctcaagtgatccacctgccttggcttcccaaagtgctcggattacaggcatgagccaccgtgcccagcctgtatcatatacttttttaaaaagagactttacagaaaaacagactgagcaaacagagctgcatgccggtgcatgagcaacaagttataatcgcacgctggaggaagaaagaggaagccgtcggccacacagctccgctctgccaaggctctgctgccgtccctcacccgccccaccacgtggcaacccaatcacaacaatgccgccgtcccccagctgctaaatgctctcaccatttggttgctgtgcaaacacacctaacttagacttcagactgatgtcctggaggtgctacaagatggccattctttatgagtaaggctgccttccagggtaaaaattatgattttcccataaatcacatataagcacttagcaaaaaatatttaaaactctcataagttttggtcctaaattcttttctcttgctgttactacaaaaatgacagagacaaaaaatttattatttataacggcttggaatctaattccaaatgagttgcttccgtagattcacgtaatactgcagaactaaatatgcaagattcccgattccaaatggaggccaaattccatccacacaggagacagaggaaccctcagcagtctctccttgaagtaattttttttttttttttttttgagacggagtcttgctctgtcgccaggccagagtgcagtggtgtaatcttggctcactgcaacttccaccaccgaggttcaagcgactcccctgcctcagcctcctgagtagctgggactacagacgctaattttttatgatttagtagagatagggtttcaccatggtggccaggatggtctcaatctcctgaccttgtgatccacccgcctcggcctcccaaagtgctgggattacaggcatgagccttgacaagctgacaacagttatctatgttcttcgtcagttcatggactcgacaccaaaatgcctgggttcagatcccaattcctgtgaaggcttaagcaattacttaacctctttgtgcctcagtttctgagtctgacagattatggcaacatcagtgactttacagggttttgaggattaaatgagtaaatactctaaagggctcagatctgtgcctggcacatattagcaccgatgctggcctgttcaaaaattctattattatttgctcaacaattgcctgaaaacatagaaaaactgtctgccacatacgcagatgaggggaacaacgaaagatttggtgggtttcagaagaggtacaggcctgatggctgccgtgcgccaacaaggtgagcctgcagatcagagaccacgtgcatgagccacagtgcatgtggctgctgtgtcccctctgccttctcggtcttacacaaatggtctcttgtggctcaagttacatacagagctccaacttagccaaggtgacgcaaaacgaactcactacacgtaccccttgtcaacttggtgtccatatctactcctcttttcaaccgtacttaacttccaaatcaagtaaatagcaactaggcttccatgccatataatgctactatccgtcttacaaccaaaaccatgctaaccctctccccagaagaggagccaaagtccttttatgaactttttttgagacaaggtctcactctgtcacccaggctggagtgcactggtacgatttcggctcactgcaacctccgcctcccaggttcaagagtttctcctgcctcagcctcctgagtagctgggattacaggcacctgccaccaggcccagctaatttttgtattattagtaggggtttattagatggggtttcaccatattggccaggctggtgtcaaactcctgacctcaagtgatctgcctacctcagcctcccaaagcgctgggattacaggcatgagccactgcacctggcccaaagtccttttacattctatctgagtggttatccgttggcaccccatggaatgaagaaggagactgaagtgataacataaggctggtagctgacagacccctgaagtgtaactatgaaggcgggctgtggaccttgccggctggaagcaagacccttctggtcatctttactaccaggtagagaaggagaagacactcaccgcataccaggtaccaggaaatgtgttgatttgttccagcaacaaaaacacatctggcacagcagctgtaactgcagtcaccgcctagtttaagtttatgacaacctgctgtcattctctaagatccatccgtcttctagacaagccaaatatggattaaacggagatgtgacacgatcaccacccttgcatctttcaagtccctgatggtggcactaatctctgccatcctcccaggaatgtgataattgctttgggttgactattttggtagacagaggcagttctggcagcttccacttggcctttgctaccacaacagccctcactccagggaaccagtgtcagaattctgccaggtgctaagtagatatatatttacttatgcattgcagaactgcagaaagaaccacaggacagctattatatcttaataattacttaatatataatacacaatgatatgtgggtattaaatattatgagtcattactctgaaatggattaaagttaatataagtgtaattgccatacagagtgattatgggtgcccactcaaaagtcagccatactcaattatacacaaaaacacaaaacacacgtgcacacatgcttagattgcctcgcaaagcctatatgcatgggaagccaatgacacacacgaggaaagatgggaacacagagctgcttcttggtttcagggaatcctcacttctttcttccttctcagggaaatttcgctttgtttcatgctcgacctccagcctcccaggtcttggccttaaagattccaagggggccgggcacggtggctcacacctggaatcccagcactttgggatgccgaggcaggcggatcacctgaggtcgggagttttgagaccagcctgaccaacatggaaaaaccccgtctctactaaaaatacaaaattagacaggcgtggtggcacatgattgtaatcccagctacttgggaggctgagggtggagaatcacttgaacccggaaggcggaggttgtggtgagcccaaatcgtgccattgcactccagcctgggcaaatgagtgaaactccatctcaaaaaaaaaaaaaaaaaaaaaaaaaaagattccaaggggccccagcccccctcccttcactaaagacaagccagctccttagatcccatgatgccagagctgtgatcttccagtacactggagaagctccttgtatcttcctatctcctagtaggctgatttcatccaccaacagccacagcaccttgaagcaacccaggagctgctgtttcccgtgatcatgtggtcaaccctggtccttcaaacttctttcagaactcacacacacaccacgtccccttatgagttttgagcagaatgctttttctttgaaagtctgtattcaacaccccctttttatttatacaaacttggagggtatgtgagaaattttatggcatgtatataatgcgcagtgatgaagtcagggcattcagggtgcccatcactcaaatacaatacattttggttttggggtttgtttgttttttttttttttttttttgagacaatctcgctctgtcacccaggctggagtgcagtggtgcaatctcggctcactgcaacctccgcctcccaggttcaagcaattctcctgcctcagcctccagagtagctgggattacaggcacccaccaaccacccggctaatttttgtatttttagtagagaaagggtttcgccatgttggccaggctggtctcgaactcctgacctcaggtgatctgcctgtcttggcctcccaaagtgctgggattataggcgggagccaccatgcccagccacaatacattttttgttaggtgagaatatatataatattagaataatattactctgctctcaagccttgaacttattccttctacgttactgcatgatggtaccctttaaccgacttctcttgacccttctcctccccgccactcacccttcccagcctctgttacccttcttgccactctctacctccatgtgatcaaaccttttagctcccacatataagaacatgcaatatgtcttttgtgtctggcttccttcacttaatgacttccaagctgggcatggtggctcatgcctgtaactccagaacttcgagaggccaaggtgggacaatcgcttgagccccaggagttcaagaccagcctgggcaacatagtgagaccccatgtctacaaaaaataaacaaaattagacaggcatggtggtacatgcctgtggtcccaactactcgtgtggctgaggtgggaggatcatttgagcccaggaggtcaaggctgcagtgagctatgattgtgccactgcactctaacctgggcaacagagcaagactcttctctaaaaaataaaaataaaaaataatcataataataatgaccttcagttccatccatgttattgtaaataacagggttttgttccccttgatggctggacagtatcccactgcatatacatataccacagtttctttacccatccattcgatgatggccacattgattccatacctttgctattgccaacattgctgtgatgaacatacaagtgcaggtatccctttgatagatcgatttcttttcctctgggtagatatctagtagtgggattaataatagccattgtgcccagtaagaccccacttcttaatattattctcatataattctaatagccattctgactggcataaggtgatatttccttctggttttgatttgcatttctctgtgatgagtgatgctgagcattttttattgtaatgctcttgactaactgtgccacgtttacaactgtctttgagcggagacctgtactacagagtcctacacagggttaaggaggagcatcagaaggcagtgaacagacgtgaggcctatcagctggtactagaaaagagacaatccatttaaggctttgactcatttttgaaacctatgtgctatggtctaaatgtcccccaaaattgacgtgtttaaacttcatcacgaagggatggtattaagtggggtcttactggcacagtggctcaacacctgtaatcccaacagtttgggaggctgaggtggaagaatcacttgagtccaggagtccaagaccagcctaggcaacacagcgaagactccgtctctacaaaaacaaaattgtttttaatgagccagacgtggtggcacacgcctgtggtctcagctacaagggaggctgaggtggggggatcgcctgagcccaggaggtccaggctgcagtgagccgtgattgcacccctgcactccagcttgggcgacagagtacgattctgtctcaaaaaaaaaaaaaaaggcagtggggtctttaggaggtaaggaagaagtcatgagtgctccaccttctcaaatgggatgaagaccctaatacgagagggcttaggggtgagcaaccgcatgaaaggcctgagggaacgagtccgtagcctttgctcttctgtcatgtgaggacatggcaccagacacccaatgccaaggcctcgatcctggacttctcggcctccagaactgcctccagaactgtaagaaataaatttctattgtttggaaatcacccagttgcaggtattttgttgcagcagtaaaacggactgagataccgtgtcgctgtacactctttgcagtatgaagtcagcatggtttcagttgagaaaagaggaacagagtagttgggtctcatcctcacaaccctgtttctctcctctcttctctcggggtcatcactccccaaccatccaaaccagaagcctccaggtcactttcttctccttcctttccctcaccatcaagccctgccaagtctcgctgtggaatccactactttccttccactcccactgcctgaaccctgaatgtctctcgggccccagcaaagagcttccaaaccattctccaggcttccagtttctcctcttccaattcatcctccattatattatcaccccataagccttgctctgaaactcgtaatgcttgcccttttataaaaataatagcaacaacatctcctacaactaagatttagagaatacggattatgtgtcaaacactgttctaagcaccttacacgcattaccctcacagttaacccgcaccagtctgtgaataggtactactacaaactcctgctaacagaacagagcagagactctaacgtggcatgcaaagtctttcactaccaggccccaagcccctttccacccccatctcccatgtcctccatctttgccgcttccccacgtacttgcggtgctgtttctcaaacacccacccctttctgtgttacacgccctcatgccgtttccttgccattttaggtgttctgctactgttttaattcttgtctttttaagtgttccaacgacactttaaaaatgctttaaatgcaggattgcaggccaggtgcggtggctcacgcctgtaatcccagcactttgggaggctgaggcaggcagatgttctgaggtcaggagttcgaggccagcctgaccaataagatgaaactccatctctactaaaaatacaaaaattagccaggcacggtggcatgtatctgtaatctcaactactcgggacgctgagataggagaatcacttgaacctgggaggcagaggttgcagtgagccgagatcgcaccatttcattccagcctgggcaacaagagtgaaactctgtctcaaaaaaaaaaaaaaaaaaaaaagcaggattgcacccttgaaagttaaaattttacttttgctgaaaggaacaattgaggtcaggtgcagggactcacgcctgtaatcccagccctttgggaggtcgaggcaggcggatcgtttgagctcgggtgttcaagaccagcctgggtaacatagtgagatcccatctctacgaaaaatgcaaaaattagctgggcatgatggtgcacacctgtagtcccagctacttgggaggctgaagtgggaggatcacctgagcccaggaggtaggggctgcggtgacccatgattgcaccactgcactccaggctgggtggcagagcaaaaccctgtctcaaatccaaaagaaaagaaaacaagagaagagaagagaagaccattgagcttaacacgccttttcatataaataactccaatggcggcattcatctaggctaaaattttggtttctgagaacaaatcattttgctaataattcagtggacatttatactcaaagataggcagagcccctaaatctgcaggtgcatgaaaaattcaggtgtagggacattacactacacaattacctcagactagggtagtttgttgcggtgaggttgggtttttctttccttccttttaaatttttacttaatcaagaaagcttcttttaagacaaacacttggtgaggtggccaagcactatcatatttcctggtttcctcttcttctttacttaacaaagaactgctcattaaaatgacatcttcttaattttttttttttttttgagatagagtctcgctctgtcacccaagctagagtgcagtggcgcaatctcggctcactgcaatctccacctcctgggttcatgcgatcctcccacttcggcctcccgagtagctaggattacaggcagccgccaccacacctggttaatttttgtatttttagtagagacgagatttcaccatgttggccagactggtctcgaactcctgacctcaggtgatccacccgccttggcctcccacagtgctggtattataggagtaatgacatctttaaactcacatctaaggagtgtctactgagtataagacattgattccaggttaaataaagtatctacacgagtcttttcacctattgactgaactgtctttaataatcacacttgtgtagtacttttcatttccattacctcatttgattttccaacgagacaggtgaaacaattctgcttccagtagacatgggagggtggaaacagcagggccactacttacctgtagtagtcagttttaagttgaaggtaaataccccttcaaaatttctggatggaaaagaccacaggagataaagcagagaatcaaagcccagggaggaaaatcatataggggacattaaagaccagcagggtcataagacttcccaagaaatggcatattctagaaatagagcaaggaagccactccacactcatccttctctgaatttctacccttattttttccttctaaagagctagacttgggctgggcatggtggctcacgcctgtaatcccagcactgtgggaggccaaggcaggtggatcacctgaggtcaggagtttgagaccagcctggccaatatggtgacacctccgtctctactaaaaacacaaaatgtagctgggcgtagtggtttacgcctgtcatcccagctacttgggagcctgaagcaggaggatcacttaaacccaggaggcagaagttgcagtgagctgagatcactgggcgatcgagcaagggcgacaaagcaaggccccgtattaaaaccaaaaaaaaaaaaaaaaaaaaaagaggctctttctaaacttttaaatctattgctaaattcaaggaagacttgattgcagtagcatttaactctggaatcacaaataaagtactagcaaattccatcttcatatactactgctttaatgccaagctaatacttaaaaaagaaaatgggcaaagaaaaagaaaaagttgatgattcatgagtctaaacaattttttgtttttatttatctgattttttttgttttttttttttttgagacaaggtttcaccgtgttgcccatgctggagtacggtggagtaatcacagctcactaaagcctcgatcacctgggcccaagccatcttcccacctcggcctcccaagtagctgggacctcagggatgtgccactgcccccagctaagttttttttttttttttttttttgagacggagtcttgctctgtcgcccaggctgaagtgtactggtgtgatttcgactcactgcaacctctgcctcccgggttcaagcagatctcctgcctcatcctcctgagtagctgggactacaggcgtccgccaccactcctggctaatttttgtttttttagcagagacgggggtttcaccatgttggccaggctggtctcaaactcctgaccttatgatccatccacctcagcctccgaaagtgctgggattacaagcgtgagccacggcgcccagctgactcagctgtttttaaattcttttgtagagacagggttttcctatgttgcacaggctggtctcaaactcttgggcttaagcaattctcccgcttggcctctcaaagtgctgggattacatgtgaaccagcatgtctggccttcaattcatttctaaaaagagaggaaaaatatatggcttcttccccgccccattgttatttgattcaattatttacaaaatgaattcttaggatattttgcatttttatttccttctgaaaaatcagtttttacaccatgaccttaatctagctaattctgttaaaataggatttaattttagataagttcccagaggacctgcattccattcaattgttggttgaactatatttcctagtgactaggatttataaatattaattatctgaaagagtggaaatgaacatatagttatttttagaatatactgtgataacaacaacaaaaaatcctgcaaaacggagctagaccagcgctgacatgaaaatccaacagccacctggcgaactctgtgttccaagaggtttttatttacagtgtaggatgtgactttacctataaaatgctttctggctgccactccgtttggacgattccggttttggtctgctaacttatcaactgtatgatttgggcaagttcctaaacttctctgtgcttcgtttctcccctttgtaaaacaggactaaaaatattaaaactcggccgggcgcagtggctcacgcctgtaatcccagcactttgggaggccgaggcgggcagatcacgaggtcaggagatcgagaccatcctgactaacatgctgaaacctcatctctactaaaaatacaaaaaattagccgggcgtggtggcgggcgactgaagtcccagctacttgggaggctgaggcaggagaatggcgtgaacccgggaggcggagcttgcagtgagcccagatggcgccactgcactccagcctgggcgacagagcaagactctgtctcaaaaacaaacaaacaaaaaattaaaactcttccctgtggggttgctttaaaaatcgtataatgtgttatatgtaaacataaagcattataacaagacagaggaatacaccactggagcaaaatcagaagcggttccctcgttttttcacaatgtggagtctggcccggcgcggtggctcacacctataatcccagcactttgggaagccgaggcaggaggatcacttgaggtcaggagttcgagaccagcctggccaacatggtgaaaccccatctctactaaaaatacaaaaattagccaggcatggtggcacgtgcctgtaatctcagctgcccgtaatctcatctacttgggaggccgaggcaggagactcacttgaacatgagaggcagaggttgcagtgaaccaagattccgccactgcattccaacctgagcaacagagcaagactacatctcaaaaataataataataaacaatgtggagtcttttattctttgcctagaattttctgtgcattgctggaatgagtatatccagaattcattccaaagttaattaagaaaagtacagttaggctttggtaaaacagtctgccaaaatttaacaaaaaagagaaggagaagaaaagttcattaaaaaataacatcactaggaactctgcaaccttgagtggggcacttaagtgccacagacctcagtttcttccttttttgttgtttttttatttttgttttctaggcagacattgaatgctagtttcttcctttttaaaaaaatgaaatagcttaactagaaccatctaaactacaaagaatctttttaaaattctaggccaggcacggtggctcatgcctgtaatcccagcactttgggagacccaggtgggcggatcacctgagatcaggagttcgacaccagtctagccaacatggtgcaaccccatctctactaaaaatacaaaaattagccaggtgtggtggtgtgtgcctgtaatcccagctactccggaggctgaagcaggagaatcgcttgaacccaggaggcggaggttgcagtgggctgagatcgcaccactgcactccatcctgagcaacagagtgagactccatctcaaaaaaaacaaaaaaacaaaaaaacaaaaaaaaaattctaaaacactaggtttatgaagtaaataataaaattctgtgataggacggagccattttcttccaggctatttaccaaacacagcaaaggaaatcaaaaaaaggcttcccatatagtaaaacttacattttggagatctggatttctccattataaacctatggaatcaaatcatttaaaatctagttaccagagaaacctcggtttaatattaacaaacatacttcctttaaccacgagccactttaatgtatatcagttttatctctggagcttcatagatcccaacagagaaggctgatctattttcagagaaacatagcaagagagtgtcacttctgaaccattatacatttaaacaatctctctacatgtagagcctgcatctaaatcccagcaatttttcaggacctagctctgaggccacatcagcactccaggcaggcggagggactctccaccccgcctcttttgcccccagaaaataaatctttccccagaccaacaatccacttcccggcctcacagcaacgggctcccggctcccgcacgtgactgccaactctttacgagatgaggctgtgctggctcggtatggttgataagacaagcatgcaagaaatatttattaatgcaaactcgtataaattcgtatcatctgagtttatgggaatgaggataaatcacaaaagcattataaagtgaggctttggacaaagtcctgaatggaagagtctagtaccatttttagagcctcttttgttttttaaactccttttactatcattcccagccttggtagacacttgacaaatatttgaggggaagctgaggacaaagagatgaaaataaagtgactgctatgaaaaaatgaaagcccaggtaacaataaacagtttaatctctgtttagttaggaaggagccaaacgcggctgggcacggtggttcacgcctgtaatcccagcactttcagaggccaagacgggcagatcacaaggtcaggagttcgcgaccagcctgactaacatggtgaaaccctgtctctactaaaaatacaaaaattagccaggtgtggtggcgtgtacctgtaatcccagctactcaggaggctgaggcaggagaattgcttgaatccaggaggctgaggttgcagtgagctgagatcggaccactgcactccagcctgggcaacagagcaagactctgccttaaaaaaaaaaaaaaaaaaaaaaaaagagccaaataattttgcctcccaatttgctgcatccatccaagaggggaagatggtctcaggcagtaactagctttgaaaacccttgtgaattttttgagatagggtctcactctgttgcccaggctgcagtacagtggcgcgatcttggctcactgcagcctcgacctccttggctcaagtgatcctttcacctcagccgcccgagtagctgggactacagacatgcaccaccatgctttttttctttctttttttttttttttttttttgtagagatgaggtttcatcatgttgcccaggctggtcttgaactcctaggctcaagcgatcctcccatttcagcctccccagtagctgggactacagttgcataccaccacacctggctaaactttttttcatattttttgtagagttgggggtcttcctatgtttcccgggctggcctccaaatcctgggctcaagtgatactcctgcctcggcctcccaaagtgctgggatcacaggtgtgagccacggcaccaggtctgaatttgtgattcgtgttaatgacgaacctgagctgagccttaagtatctgtccggagtcgcagaagcaatcagcacagtgcccagcactgaaccacggcacacagtgcccagcactgaaccacaacacccagtgcccagcactgaaccatagcacatgcgcattccccccacgcccccgaacttatattcgtcaccatatgttgtgcagatccacgaatgggcagagtcacaattctcacatgagctttgtaaataaggaaaaactgcatgggccagcacacgttgcttgtgtgtgtgtgtcctaagcactgatgacaaatgcagaaccaacaacattcccactcatccagaggaaatcgtgagttctcaatgagcaggctgggagtagcttagtagtcatttccaaagcactgtgaaacttgtctacttcatgaaaaagtactgaggctgttttacagccctttaacttaaatctagtaattgtgcctatcagagttctgaagaaaataagactcaataatctaagctactagttcacgcagatcatcttaaagcaagattttccacagacctcacatatcgaggtgacatgatccttttctaaaatgaaagagcttcgctagagcccagaagttcgagaccagcctgggcaacataagtgagaccccgtctcaacaaaacaacaaaaaaaaagttttttttttaaattatccaagtgtgctggcatgcacctgcagtcccagctacttgggaggctgaggtaggaggactgactgagctctggaggtcgaggctgcagtaagctataagtacgccactggactccagcctggtcaacagagcaagacccaatctaaaacaaaaaacaaaaaactacgaaaacatattccacaaaaaagatttgtacataaggactgtatataagattgtttctaggcagacattgaatgctaatttcttcgttttttaaaaaaaatgaaatagcttaactataaccatctaaactacaaagtatcttttttaagttctaaaatattaggatttataaagtaaataaaattctatgacagcatggagccattttcatccaggatgtttggacacccttctcctttttttgagactccatcaaagaaagaaagaaaagagagaaaggaagagataaaaagaaagagagagctagcttagcaaaaatcatctaaactacaaattatcttaattctaaaatattagaatttataaagtaaataaaattctgtgatgtggtttctctagttaagggcctgggggacttacacagctgttacgaagacattatttaaaaaaatcttcagttctccctggggggcaattggattgacaattgcaattcctttgtaaccaatgggcttctgtgtgagctgttagacgcacactggtattcgttcaagatggaaaaccaaacaacatggacacaacccatgacagccttcaaagttctgtctgcatgaccaatcaggtcctttggttgaaatccatgaccaatcaggtcctttggttgaaatccatgaccaatcaggtccttcggttgaaatctatgaccaagcaggtccttggttgaaatccacgttggccaggctgatctcgaactcctgacctcaggtgatccgcccgcctcggcctcccaaagtgctgggattacaggcgtgagccaccgcatccggccagagtgtgttgttttctcattgcagtccctaacttgccctgaaccctcccttacccaggtagccacgaagcatctggtgactgaggcctgggagtgagccctggaggttctggctgacgctctgccgtgacccacttggggcttctgtgacgtccccttcagcctgacaagaggacccagttctcctctgtgctcaccctgaacaaaacaggtcctagtctgggaagggcgccaaagagagatcttttcactggtttctgttccctgtcatttttgggggagggtgggctggggaacacaaacacccaataattggaaattgtcagacatacaaaaaagaaatgtaattagtcataaaccctattttaaggttatatttgcactgccattttaaaatgagaaaacactaataacattaaaatgaagtctttgttaaaagtaaccatgcattgttcaaatttccatttgttctttgtttgacaatgaaaaatcattctaaattagttccatacacttactgtgaaacacaacagtttattcctgggtcacattctcccccttctgtggtttatataacttctctttgttccgcaaatggcagtacaatggcaaacaaaataaaatggagtttattatgaaaatggatccattaagctacctaagaataacatagccctacaactcctgcacttgtagagggacacgggtgagatgaaacggacgtcagtacccctgcaagaatcacacagataggcccctcggtgcacctggagagggaggccacaatggcaaataataggagacacagcgatgccccactcccttctttcccaagagctgccatttctgcccttgctggataagctcagtgtctcacacagcgtgagcgtccactagatgctggcttggacaggcgatgctgagggttcccatagacggcactctagtagggctgctcaagtccctcctcacaatccagaggatctcacctaggcagggcccatggtcactccccaggagaagagccaggaatgtccccatcaagcaaaacccctggtctccagctcacaactcaaaacccaagcaaatgaaggaaaagctcctgggaccatcaggactcataacgaccaagggtcagtcatggtatcaggaaatcgtaatcctggctcagaaaggttttaaatacagggaagcagaaggctggggcagcaaaggacactactaagagcaagcgactcacagggctcacccggaaggcattacaaactggaattcctaaaagagtggttgccaagctcacccagaagaggaggtcccactggtccctgagtctgctccaaacggccacgcacagcgtgggcatcctctcccctgctttccattgctgtacagaacctgacctgggaccagagagaagagggtccagggaaatgctgctgaaggcttcgtctctgcagtggagagaaagtcggaaggggcagcacccacccctagctgcccatagatgaccaggcacaggcacccaccaccgacactggcacaatcccccaacatgttctcagaccagaccaagaccctagccgagcccaaggatgctggctaatcaaatagtaaacacctttggccagattatccttaaaaagtctctggaatgtcaccttcagtctctgtagtctactttctaacatacttctgagccgaaaccacgtgaaaagatttttcttctgactacaaggcagaacaataaaagtgaccctctgagtcaaaaacaccacatgaaactcacctcccgcctccaacccatcccttccgcatccttcatgtccaccgtccctttaccaacaaccagctgattcttccagacttcaaaatctttcagattaacccagaaatatcgataagggaggcctttttcttagcttatgttgtatatgtttttctgtttaggctactgctataaagaactatccaccagcctgggcaacaaggtaagaccgaccctgtttctacaaaaaatacaaaagtagacgggcatgatggtgtacacctgtagtccctgctactcaggaagctagggtgggaggactgcttgaacccaggagttagtggctgcagtgagccgagatcacaccactatactccagcctgggtgacagagtgagactgtgtctcaaaaaaaaaaaaagaactatcccgagagtccactgttgggggccgaagtgggggtggggacccttggctgccatgttcctgggccaggaacatggactggatggcctgcatgtcagaagactggtgacatacaagggtcaataaataaaaacagttaatatgataagagctgttactgttattgttagaaaagaggggcacagccaaggaaaggggagaaagctgaaacaaaccatttgacttggatggtatcatgatttttatatgagatgaatggatacatagatacgagcgggacagatggatacaaagaactacaaacgcatgtgtgcccgtgtgtgtatgtacaaacatatgtgtacgtgtagggaagtacatgcatatgtttaatttcctagctatgccaggcgcggtggctcatgcctgtaatcccagcactctgggaagccaagatggatgggtcacctgaggtcaggagtttgagacccagcctgaccaacatggtgaaaccccgtctctactaaaaatacaaaattagccggacgtggtggcgcatgcctgtaatcccagctactagggaggctgaggcaggagaactgcttgaaccgggaggcagaggttgcggtgagccaagttcctgccactgcatgccagtcttggcaacaagagtgaaactccgtctcaaaaaaaaaaaaaaaaaaaaaaaattcctaactacgctgcttgagaagtccttgtagccgtaatagcccagtagcgtgaacacacctaatacttagatcctggtttctaaaaaccactttctactaaaaggaaccagggcttattggagaaatggctgattccagggctggagcaaggaaagttccgggtgagcctagaaccaagaactaaacatgtggccgggagcagtggctcacacctgtcatcccagcactttgggaggacgaggcaggcagatcacctgaggttacaagttggagatcagcctggccaacatggtgaaaccccatctctactaaatatacaaaaattagctgggtgtggtggcgcacgcctgtaatcccagctacatgggaggctgaggcaggagaattgcatggacccaggaggcagaggtttcagtgagccatgatcacgccattgcactccagccggggcaacagagtgagattccatctcaaaaaaaacaaaaacaaaaacgaaaaaacctggccaggcatggtggctctcacctgtaatcccaacactttgggaggctgaggcaggcagatcacgaggtcaggggattgagaccatcctggttaacacagtgaaaccccgtctctactaaaaatacaaaaattagccgggcgtggtggcgggcgcctgtagtcccagctactcgggagactgaggcgggagaatggcgtgaacccgggaggcggagcttgcaatgagcagagatcacgccactgaactcccacctgggcaacagagcaagactccatctaaaaaaaaaaaaaaaagaagaagaagtaaagatgtgctcaaagaatgacatgaacacatcaaaagaacacaggggccagcttggaggcgctgcttttggccaaatctgggacaatctgggtatcgaagcaaatgataatggtaatgaattataacccaatgggtaaaataggagtctatgagtgtattgataggaaggagagaaagacagcaggcaagctccagcttgcagtggaatgccaactaatcaatgcaaaagaaacaatgcaactagaaacatcaccatttggcaatgctcatactaattccctcaggcaagaatcatcccaggatgctaaaacaaatgggcaaaaagcttaatgagaaacaggatattttccgagtccccaaaaaatctccccaccagaaacagtactttttaactgataattacaaaataccaacaaattaattttacagtggagaaacctggtagacaccacctcaaccaaatgataagttaacttctccagaaatgggactgatcagacctgtgtgcgttcctgtcgtgacaaccctgcagggactctcctgccaggaacctaccacctgattctcatcatgaaggaatatgagaccagcccaaaccgagggacattctacaaagtaactggcctgttctcttaaaaaaatgtcaaggtcgtgaaagacagagacgaaggaacagccccagattgaaggagactcgagagccattgacacagacggcgcctgtggtcctgggcgggctccggggcctctgcatttggtggcatggtgtgacagtgcccacgtcctgatttgggcaggtcggtgcaggctatccgggacagcgtccttgtttttaggaaacccacacaggagaatctagaggcactctctgcagtctattctcaaattattccggaaaaaagggatgtgtgtatgtggagagacagacagacaaacatgtcggaatgttaattcagggaatctgggtgaagagtatttgggaattctttatactgtttgggagcatctctgtaaatttaaacttacttcaaaattagaatataacgccaccaaaaccccctctatcactcactccgcattcctagataacaactagtgtggaattctgttctttgaatcactagatatcaactagcgtgtaactctgttgtttgaagccacctggtttgaggtactttggtacagtagccctaggaaataaatatgctactcaaagaatattgaatgtggctttttctacaatactaaaatctgacctaccatgttaacttagtaaggcaaactgctggggcggggtcccgtttcagccgaacgcatctgacaatgccttaagtcacacattgcataatcacaagttgcttcttgacatgagcggctcttcaagtgcacggggaacaacagattctttgtcagggactcacaagagtcacatgctgttattcttttctccttaagagacaaactgattttttaatcactgagagcctattacatgcgtggcatagttttaagatgttttgacatgtcacacgtaaacgatagtaaacatgtcttggaagaggggctaagatgtgggacgaacgtgattattcaatgggcatgcgcttccggccacgcatcacacgcacatacaccagcgcggttatccataactctaccatttcaagtgagccgcaagagactgtaaatcgcagtgaagtgggccgtcaggcaatgattactaaataagcatgggaaacatctaagattaacagtgaagagagaagatgcgtttggaatggaatcctggagacagttaagttaccaggtgctttcacagtcgttttttcaaattcagtcactgagacataaaataatattgatctttgagaagagctctcgacggaaacagcagttggcagtgtccccagagcacttgcccttcctctggagcgcttcacgtgcgagcccgccgtctatttataacagttgggcacttgtcgccacaatggctgattgtgtggcccagctgtctgtgtctatcaagaagggcaggagtggacagcctgcactttgatgtttcccttttttggagactgaaaataacatttttaaaaaactgccaaccggcaaggtcacaaaatatttttggatggcacggggacccgattgcaaagctgtggttcacatcagatgcggaggcctgggaagaagccagtgagccccattgcacaatatcctgctcatgccaacttcaaaagttatttgcctcggagagctcccagacgactctttctcggtaataaaacacagcattttagaaatttgcaagggtcttctggatagggcattacccagaggagcaaggatttccctggccactctggttacagttgcaaccagcagccccaggcctcttgccacccttgccccgccccaccccacatccctcacccccactccacaaactcctgcccttccctgatgagctctcaagcacttaccagcgacacgctacatatttttctaatgcatgtgtcaatttcttgactcgcccattctattatagatggctcacgaaagcaggattagcgtctgttttgttcactgatgcaaccacagagccgagaatagtgcctggctcacaatatttactgagtgcatacttgtggaattaattaatttaaatagcagagacaatgggatcaggaaacacatggaaataccgatgaccagtattagatgtcagggttctgtcgcccttccctccgcccccgacgaagatcccagctttgtttacatatttgtggtgcacaaaaatagaaatggactaaacaaaattcccgattttcccaaactgtggtggattgcagaaaccaagacttcgcagggctcggttctgaaatgattttcactcaaaccatcttcctgaaactcttcctattactctctgcccatttcgcaaaccttcttgctggaggtattagatacgggaagcacctgtagtaatcaacaagtatggctctgattaaatggatttttttctttttttttttttgagacggactctcgctctgtcacccaggctggagtgcagtggcacaatctcggctcactgcaagctacgcctcccgggttcaagcaattctcctgcttcagcctcccgagtagctgggactacaggtgcccgccaccatgcccggctaattttgtattgttagtagagacgggtttcactgtgttagccaggatggtctaaatctcctgacctcgtgatccacctgcctcgacctcccaaagtgctgggattacaggtgtgagccactgtgcccagccgaaatggatattttgaaaatcatcaagttatacaaaagaatcccacatgctgtacaacaccactcgagattttagggtttttgcgggttttacatcagtagatcatgaaaccctgactctttaattattatgtaaatgaaattcaacaacacactcacacctcaaaaactctggaaggtcagaaagaggcagagagcagggcccccgcggaaggggaggcacacaaggcagacagaggcagaggaggtgggagtacaggccccagcactgtggtagccaacagcagagccattcttccacaccgggaagggcccccaggcctcaggaagccagctctattcagcagatttcacaagtgaaaaagcctttttagatgtcttttggggtcaggcgtggtggcttacacctgtaatcccagtactttgggaggctgaggcgagcagatcacttgaggtcaggagttcaagaccaacctggccaacatggtgaaaccctgtctctactaaacatacaaaaaattagctgggcatagtggcacacacctataatcccagctactcgggaggctgagacaggagaattgcttgaacccaggaggtagaggttgcagtgagtcaagatcaggccattgtactccagcctgggcagcagagcaagactctgtctcaaaaaggaaaaaaaaaaaggccagacgcggtggctcacacctacaatcccagcactttgggaggccggggtggggggatcacgaggtcaggagatcgagaccatcccggctaacacggtgaaaccccgtctctactaaaaatacaaaaaaattagccaggcgtggcgccgggcgcctgtagtcccagctacttgggaggctgaggcaggagaacggcatgaacccagaaggcagagcttgcagtgagccgagatggtgccactgcactccagcgtgggcgacagagcgaggatccgtttcaaaaaaaaaaaaagataccttttgggaacaattccccagcagaacaaaggtgccacttctaagtatgaggaattccttatcaaagatgcctgagcctgcaagacagctcccacaagtacaagcgctgcaacgactgggtgactgcgcgtctctggcaagcggttttgaagccacttccttagctcccatagacaggcagtgctggaaacacacatgcagggagctcccagccggtgttgtgcgatacagaacccgaaagctgcgccctccccgcaaggaggttgtctatagaaaattctgtgacatcaggattcttcaataatctcttcaacatcagctctcaacatatttatagaagatctccaggcccagcagttttcctacctgtgcaaaatgctgtggcttcaaagtaatgttttgttgtgttttgttttgtttttgagacgagtctcactctgtcatccaggctggagtgcagtgatgcaatctcagctcactgtaacctccgctcccgggctccagggattctcctgcctcagcctcccaagtagctgggacgataggcgtgcaccaccacacttaggtaatttttgtatttttagtagagatggtgtttcaccatgttggccaggctggtctgaaaatgctgacctcaagtgatccacccacctcggcctcccagagtgctgggattacagccgtgagccaccacacccagccaaagtaaatttaaaaggggctttcgtcctcctaggagtcagaatcagtcctcactgtaagaagcagaattctaacctcaaaactggtctcctgggaacactggaaagcagtgcgtgatccgaaggggcagaaatgactgacactctcaaattcccctctgcatcatgggcactcagcactgtgcctagtgcatagtaagacttcaacaaatatgtgctgttgttataattcggcatgacgatggaggtgcagaggtttacctgtgtttttattatctctggttgacaaggcggccacacccaggttgcctgttctgaagctgtctcaagacagtgaccatcacccaggctgaggtccaggatgatgtgagtgcaaattgctaaagctctccttcaggtgccaggcctgccatgacacatggcgagtcctagcagaggtcagaccaacaactcagttctttcaggtaacctgtactgatgaaaccgccccccccccccccgccaatcttactcttctgttatttcatgtctatgaagggttttggcataaaaaaaacaaaaagcctcattttaaaaaaatctacaattgtttaggtttttgtttaaagagaagcgtctggttctgttgcctaggctggagtgccgtggtgcaatctcggctcactgcagcctccaacccctggcctcaagcaatactcctgcctcagcttcctgagtagctgggactgtccatcttttttttaataacagctttattgagatataattcacataccgtacaattcatctgtttccagggtacaattcagtggtgtctagcatattcacacagggctgtgcaaccatcaccaccatcaacctagaacactttcatcaccccagaaagaaactccgcacccggctgcagtgacaccatcatcctggcttattgtcgtttgtccgccggccaccgttctgtctctgtttctttcccaacaccagcctctcttttcacgcactatctccccgccagccctgctccctgcattctgtaggaaatgcttggctcctacagtggttgacgaataccaaagcttctgtgagcacgccagagggcccccacaaagctctctcctctgtctgaaacattactctgaaggagtgatttcttgttcattctgaataaggatgacgacaccaggaagcggaggcccggggagcatttacggcgtgttctcgatgtgtgagcactgtggccagcacgttccaacccagtgctgcaagagttgctcccagccccacttcagagatgagaaaaccaaggcccagggaacccaaggtcacaaaggactctaagaaggagagttgagtaatcccagcactttgggaggccaaggtgggcagatcgcttcaggtcaagagttcgagaccagcctggccaacatagtgaaaccccatctctactaaaaatacaaaaattagccaggcgtggtggtgggcacctgtaatcccagctacttgggaggtcgaggcagaagaatcgcttgaacccaggaggtggaggttgcagtgagccgagatcatgccactgcactccagcctgagtgacagagtgagactctgtctaaaaaaaaaaaaaaagagagttgaggctgggcgcagtggctcatgcctgtaatcccaacactttgggaggccaaggtggcaagatcacttgaggtcaggggttcaaaaccaccctggccaacacggtaaaacccccgtctctactaaaaatacaaaaattagccaggcatggtggcgtgcacctgtagtaccagctactcaggaggctgaggcaggagaatcacttgaacctgggaggcagaggttgcagtgagccaagatcgccccactgcactccagcctgggaaacagagaaactcttgtctccaagaaaaaaaaaaaaaaaagaagaagaattgaaatttgaactccaagcaatgtgacaccagagctcaggcccggaaccccatgctacactgactcttgttgagagaacactccaagatgtaatcatgcctacaatgacgttgcagggggaagtgactgatccactactttcctggagaacctgggaaggtatgtgtgatcaggaggataaaaggccagggaacaagaaaactgcagagaggagacccagcaggcaagatgctgcaaaaggtgcagcggaactgagtccaccgaggagctaaaaatccctccgtcttagaattctgtccttgccaggaaagggctcctcatctcctgattgctaattaactttatctccttgaatcaagggagctaaaggaagtctctgaattagaaacctttgtggtgaggggtaaaggaactttggtaagaggatataatcaaaaatatgatgattaaagaaagatgattaaagcttggaaagcaagtcactaacttattaacagtggctatctttaagggatgggattagtaaagattttcatttccattttatacatttctatattgccaaattttacaacaagcttatagtacttagaaagttggaagaaaaaccggccgtgcacgatggctcacgcctttaatcccagcactctgggaggccgaggtgggcagatcacctgaggtcaggagttcgagaccagcctggccaacatgatgaaactccatctctactaaaaaatacaaaaattagctggtggcgggtgcctgtaatcccagcaacctgggaggctgaggcaggagaagtgctagaacctggaaggcagaggctgcagtgagccgagatcatgccactgcactccagcctgggcgacacagcgagaatccatcgaaaaaaaaaaaaaaagaaaaaaaaagaaagaaagaaagttagaagaaaaaaccaaaaagatgacctggggagaggggaagaacttctggaataatgaagtgagaagcttggcaaaacctctcctcaaaaagtaacaacaaaactagacaagtcggtcaaaaacaaccaccacagggttggaaatcaaccaaagacatacaaaaaattgaaaaatgtttattcaagaaaaactacgcagctgggcatggtggctcccacctgcaattgtagcactttgggaggccgaggcaggaggattgcttgaggctgggagtcagagaccagcctgggcaacatatcaagaccccgtctcaacgaaaaacaaaaaagtcagcctggcgtggtgatgcacacctgtagtctcagccactcaggaggctgaggtgggaaaatctcttgagcctgggagcttgaggttacagtgaactatgattgtgccactgcacgccagcttgagtgacagaggaaggcctcatctcaagaattaaaaaataaaatgaagaagaaaaatgaccaaatcttgagttagagcggtggtgttctgtgatgctttggcttgaggggctcccctccttcccctcagctcacccatgctgctacatctaccagggtgggacgagctgtgaaaattggtggctccactgctggaggggttgacttgatttggaggagagcacatgcccaaaggcactgacataaaccacggtgatttcctgtaaacaacaggaaatgtacagaaggtcaacatctcagccaccctgagcctgcaatgccggttgtggcaaccaacagatcaggagaccagccaaaaacctagccggaagatacagagaataagggagctatcacgggcagtggtaaagtccctgaagtcccacacattcttcgtgctctggaaggctgcacacaggcaggaaagactgaagagggccctggttatccactcatccttggctaaagtgaggcctaccccacgcacaaaggaggccagaaaaggcctggcaaaaaggaaaaaccaagacaggctcgtataatatatgcctgaattctgaacatgtccctaaacgtacacacatatccaccgcaaactgtgaaaagcattagtagctcaaggtgtttcagcacacctctgaataatcattgcctgaccactaagctatgctgacctgggttaacccctgcaaagccaggcttaaacacattttaaaaataagaaaaaaaaaatgagcaggatcatcagcagctgctacagagacagacttcacagaattaatccaggcaagtcacaaacaaaaagaaataaacaacaaacctgcgttttgccaaaggtgatcataatccagagttgctacaacgtattaactaaaatacagagcttaaaaaaataaaatataagacatgcaaagaaacataaagtattgtgaattatactcaggcaagagtcataactggaaactctaagggggcccagatattggacttaacaaagatttcaaagttataagaaactactgtaagaatggaactgaaggaattcatgtttaaagaactaaaggaaagtatgtaacaatgactcatcaaatagagaatactaataaagagacagaaattataaaaagaaaccaaacagaaattctagagttcaaaagtataataactgtaatgaaaagttcactagaggggctcaacaacagagttgacatgggagaagaaagaatcagtgaacttaaaattatccaatctgaagaagaaataaaaaagcataaagaaaaataaaaagaacctcagaaacacagggataccatcaagcatgccaacatatatataaaggaagtttcaaaagaaaacgaagcaaaaggaagcagaaaaaattttttgaaaaactaatggcataaacttctcacatttgattttaaaaaattaatgttcacatccaacaaactcaaagtaagctcaaaaaactccaactcaataaagtgagccaccatgacacatcatagccaaactgctggaagccaaaaacaaagagaaaatcttgactgcatgaagacaaaatggttcttcatgaaaaggagcactaccataagattaacagctgacttcacgttagaaattaacagagaccagaaaacagtaaaatgacatattcaaagcactgaaagaaaaacttccaatcaagaattccatatccatcaaaaccataccccaaaactaacaagtagaaataaagatattcctagataaacaaagacagaaaatttgttactggcagaccctacttacaagaaatactaaaggaagcccttcaagatgaaagaaaaaaacaccagattatatcctgaatccacatgaagaaataaagaatgctagtaatactaattacataggcaaatatacagcagatttataaatagtctcttttttacacttaactgatttaaaagacaagtacatataacaataactacagacttttactactgggcttatgacatacaaagatatcatatacatgacataataccacagaggaggtagatagacatagacatttaatggaacaaagtttctatattttattgaaaatgaattagcattaatctacagtagactgtgagctctaggcacagtggctcatgcctgtaatcccagcactttgggaggctgagatggaaggatcacttgaatccaggagtttgaaaccagcctgggcaacatggcaaaaccccatctctactttttaaaagctatatatagatctttaaaaagtagactgtgatgagatgcatattgcaatccttagagtaaccactaaaaatataaccaaaaaatattaaaaacctcaccaaacagatgaaaacagaacactagaaaatatctatttaacacaaaagaaaacagtaaggagaaacagaacaaaaagatgtgagacagagaaaacatagcaaaatgttagatgtaatccaagcatatcaataattgcattaaatgtaaatggattaaacactccaataaaaggtgaagactgtcagattaaattttttagaagttctaaccatgtgctgtctgcaagagatgcagatggagaaaaatgtactatgcaaacaaaaccataagaaagttgcagtggctataataatatcaaagtaagtatgggaggctgtggcaggtggattgcttgagtacaggaattcaaggttatagtgagctatgattgtgccactgcactccagcctgggtgacagagtgataccctgtctcaaaacaaacaaacaaaaacacaaaaaaatcccacagactgaataaactttaagacaaaaaagttataagagaaaaagaaattttgtaacaataaaagggtcaactcatgaggaatatataaaaacataaatacataagcacttaatagcagagcacaaaatacaataaagcaaacactgactgaaccaaagggagaaataggcaattcacaataatgtttggagacttcaatatcccactctcaataattgacataatagttaaacagaaaatcagcaaggatatacagactttgaacagcattgtcaaccaacctgacgtaactaacatctgtagaccatgtcaagcaacaacaaatagaatatatattcttttcaagtgtacatatcgcattgtctagaatgaatcatgggctaggtcataaaacaagtatcaataaatttaaaagaattaaaatcatataaagcatgttctctaccaaaatgaaatttttaaaaatcaagaacagaaataaatttgtggactccccaactacttagaaattagaaaacatatctaaaggattcaaaggtcaaagaagaaatcacaagggaagtttaaaaatacttcaaactggatgaaaagaaaaacacagcagatcaaaatttaggatgcagctatgagaagtacttagggagaaatttataatgttaaaagcctgtatcaggaaaaaaaaaagaaaagtctcaagttaataaactgagcatcagcagggaacagtggctcacacctgtaatctcaacactttggaaggccaagctgggacgatcgctcaagcccaggagttgaagaagagccttggtaatatagtgagaccctgtgtctacaaaaaataaaaataaaaattagctggcccaatggtacacacctgtagcctcagctccttggggggctgaggtgagagaatctcttgagcctggaaggtggaagctgcagtgagccagtatcgcaccactgcactccagcctgggccacggggcgagatcatgtctcaaaaaaaaaaaacacaaacctgagtttccaccttaagaaactataaaaaggagagtaaactaaatcccaaaaaaagcagaaggaaggcaataataaatactagaccagaaatcaatgaattagggaaagtaatagagaaaactgatgaaaccaaaagttggttctttgttcagaaacaaaacaaggatgtctactctcaccatttctactcaacattgtactggaggtgctatccagaacaataaggcaggaaaaagaaatttaaaagacacagattggaaaacaagtaaaactcttcatattcactagctctatatatagaaaatcttcaggagtctacaaaaaactactagaactaataagcaagtttaacatgttcataagatacaaaatcaatatcaggaaatcaactgttttgtgtataccagcaatgaacaatccaaaaacaaaattaagaaataattccatttgtaatagcatcaaaattagtaagttaaaattacaaaactttgttgatacattaaataatatctaaataaatgtaaggagataccaggttcttggattgaaggactcagtattgttaagatggcatttcttcccaaattgatcaacagattcaacaagacccagcaagctttttgtagaaattaacaagaaaggttatgagtgggtaactgaagctgggtaacgtgtacctgagagttgattatactactctcttcacttttgtttatgtttgaaatcatccataataaagtgttgttttttgtttttgagagacagggtctcactctgtcactcgggctggagtacaatggcacaatcagagctcactgcagcctcagtttcctgggctcaagcaatcctcccacctcagtctccccattagctgggactccaggtgggtaccactatgcccagctaatttttttaatttatttgtttatagagacagggtctcaccatgttgcccaggctggtctcaaactcctggactcaagcaatcctcccacctggacctcccaaagtgctgggatcacaggcatgagccactacatttggccagcaacgtggtttttgtttgcttacaaaaaaaaaagaagactacacaaaagaaaaaaatgtacaactaattcaagggctgccttaattattcctcactctttaccctcggcccacatcatttccctacaggctgatccttgcccagtccactcctgattcatggctggtgaataggtgagggaggaaaatggagagagcgaatacacagagtgacagagggaggagaagtgaaaggtcataggcattcgctgcagccatgcctgtagtacgtccatcaccaggcttcaatttatagcagctacatgactgcgtgtgtcaatctctaactggctcatgtgccagaccagaagctactattggaaaatgcccctctctcgtcatgtcgtttgcacagtaattcacttagatctgaactgagtacaaatgagtggtgctctaagatcaaagcaccagggtctttaaaatgatcttcactctccccgcaacctgccccgaacacgtgcatgctcctttcactttcaattccaaactgcacccttctaacgctggccgaaagggaaagtaagccctgttttcgtttcctttcaaatacttgatgctttccaattttattcctattttccctaatggaataatacttactacttggaaagcatcattcatctcctctcaagatcctcacagcaacaccatgttgccagaagggcaggtgcgaaatctgaaataatggcagaagtcgaatgtcgcacgtcaatgtacagcctcccatcgaggcccatggctttatttttatgtatttatttatttattgagacggagtctcactctgtcacccaggctgcagggcaatggcgctattttggctcactgcaacctccacctcccggatttaagcaattctgcctcagcctcccgaacagctgggattacaggcatgagccaccacacctggctaatttttgtatttttagtagaggcggggtttcgccatgttggccaggctgatctcgaactcctgacctcaggtgatctgcccgcctcggcctcccaaagtcctgggattacaggcgcccactgccacacccggctcagttttgtatttttagtagagactgggtctcaccatgttggccaggctggtctcgaactcctgacctcaggtgatctgcccgccttggcctcccaaagtgctgggattacaggcgtgagcctccgcgcctggactaaggcccatgactttagcaagcgggatgttgttttccacctcctgctgctgcctcttaaggaacaggggcgcttcttcaccgcagaggagacggttctccattctaggaatgggtatgaacttgcctgaatagtctatgatgggcaatggggacgttccatctacatctcattatgaaaatccccaaaaaccttacaaaaccatataatcgtgaagttttaagaagtcttaaatagttctaatatataattctccacaaatcttttctctctaaaaaacacttatttttctcattttgatatgccacttcaaagcttttcccactccttgagtatatttacttttctctctcctctctctagtgactgagcagtgattttacctttacctatttatttagagatggaggtctcactctgttgcccaggctggagtgcaggggcacgatcagggctcactgcaggctccacctctcaggttcaaacaatcctcctacctcagcctccagagtagcttggaccaaagatgcatgtcaccacacccagctaatgtttttattatttgtagaaatgaggtctcgctgttgcccaggctggtctcaaatgcctgggctcaggtgatcctcccgcctcagcctcccaaagtgctggaattataagtgtgagccacagcttcccactaacaatttcactttttaaagagatgggtcatattgtccagtaacatttacatgagatccatgaaaaaaaagtgaatattattctttagaataataaacaattcatatcacaaaattagctttaaaagattcccgcttgtaggagctattagaatttcaaaactgcccagttaaacataacctggttcatcccaacgttttcatttacatataattcaaaaagatttacttttccataaatttcaaatgctcttcagatgaaggaaacattcatcattacatcaaagcaagtgcaacttcaatactaaatttcctgatcttttatacaattagactgcaagtgctcatctgagacagatttagagaaaattgcggctgatgcccagctctatgaaagagttttaagaactgaaataacttaaaaaaaattagaatcacagaatggggggagatgagaaaaaattcatcctaaattagaaatacgaactcctgcccaaagtgcagggtttttaaaaaatggaattgttaaacagattgaaataatatttagaaacaacaccagctcacaagggtagtaaaatactaattcttaaaatcgttaaacagattgaaataatgtttgtcaataacaccagctcacaaggatagtaaaatactaattcttaaaatcctccctcttgcgctatgcctgcttctgagttggctgagcaagttccttcccttccccaggcttctaacagtgaacatgatctggcagcattagacacaccacaactccactccagaccaagatgggtctgggtcaaacccaggacttctgcttcaaattaggagagttaccaaattaagacaattctgcctcaactgagtcaccctccagggacagctgagtccatttccagggtaagtactggggtagctctacccaccccagagagatgtattttatggtctgtcctaaacagaactggacccccagagaagttccgagatcagcacagcctgcagctgaccctcgggagagggtcaattcagggcatttgctgaccaaaaggatggatctccctcaccgggaggtggactgcaacctcccaaacactttgccactgtagctaatgtgtgcaaacatttactttgtgaatttgtatcttagtagcttcactaagtcagcaaaatccaatctctgaatctttttgtggtgactgaactaactctatgttgcacttttggtgaaaaactgcaacatagaatttaattaattctttaattaaatgggttaagggaaaaaccgtggcaataattttttttttcctctttcacttttgggatttgaggtcttcaaataagtttttctaattgtagggaaaacaaagtcttttaataattaccattaatgatttataatttaagcagtttaggaaataaaaaatgcatagaacatgatattctcatacccagacaagctcatatcccacctgcacccctttacagtcaaggatgattttgcatctcctttcctcacttaagtgccttttttgccaactaggataactcatataatgaatttttgccaactaggaaaactcatataatggctttttttaaatctggtttttctaataataaaatcatatctgttgcaaaaaaaaaacaaagcaaaaaaaatattagtacaagttcctctaatcccactgtaaagaacacgcgctatatataaatttgtatatatccttcaatgcatgtattattatctctctagacccacattattaaacacgctattttatggaaaatgagatcatgttttacatatggtacagttgcttgcttttttcaattcacagttcatggccgggcacggtggctcacacctgtaatcccggcactttgggaggcctagatgagcggatcatgaggtcaggagatcgagaccatcctggctaacacggtgaaaccccgtctctactaaaaatacaaaaaaaaattagctgggcatggtggcgggcgcctgtagtcccagctactcaggaggctgaggcaggagaatggtgtgaacccaggaggcggagcttgcagtgagccaagatcgagccactgcactccagcatgagtgacaaagcgagactccatctcaaaaaaaaaaaaaaacaattcacggtggctcttttgcacatatgggtacacgcagatctatctcattcttacaaatggttacaactattccaccataaggacagaccataatttccacctaatagatgttcaagtgatttcccactttctgctattacaagaaagacagtaaccaagattctcatacatacatttttgtacttgtgcaaatattgccatagggtaaatccctaaaagtgaaaggacttggtcaaatggcatgacatgtgaaattctgaagatatgcaaaatgtcctcaaaaaggtttctgcaattcgtagtcccaccaacagtgtttcagagggcctgcgttccctttcctctcaccaccaacaactagaatcaattttttcatctttacgaatcaaagagatttttcaaattttttttcttatttcaatatgctgttgttgtaagttattattattattattattattattattagggggattgtacatttagcccaccgcacactagctgcatgacctagagaagtaatttaatatcccggttccttggttgtaaaatgcagataatgaaagtaacatctacttctcgggggagccgtgaagatgtaatgagcgaaggcatctcagacacttggtgccgagtctgacagagtggggcttcaacaaaggttggaagaacaacgaataaatagaatatattctatgaacaatgaataaatggaatatattctatcagggtgacttaccagagttacctcactcatcaccaatttggctgctgttcaatttttgctattctcaattatattcgtatcattgagtaaattattctcttgtatctacaggaccatcttctaaggcgactctcccaggattcggacagtgttacagttcttacttctgttctttagaagaagtgaaccagcaacaacaggccacccatcaagttttagaaaattttctctgccttaaaaagtatataatgcggccaggcatggtggctcacacttgtaatcccagcactttgggaggctgaggcaggtggatcacttgagggcaggagtttgagaccagtctgcccaagatggtgaaaccctgtctctactaaaagtacaaaaaaattagccaggcgtggtggcacatgcctgtaatcccagccactcaggagggtgaggcacaagaattgcttgaacccgggaggcaaaggttgcagtgagttaagattgcgctactgcactccagcctcggcaacagagtgagactctgtctcaaaaaaatatgtatgtgtgtgtatgtgtgtgtgtgtgtgtgtgtgtgtacttttaaggcattctcttttgtacttttaaaattactagtaaggacatacatttccatatcactcactgtttgttgtatagaaaataagctttatcgttataattttcacgcatatatttttctccaaattatgacctggaaaaaaaacttgcagctagtaactggaaaactgggtaacatatatttataaaagacaaacacacatgtatttcttatatgtggcttttctctaccagtaaagaataggatgtggatgaaagtttcaaataatattatgttataaaccttatataattactgaactcaacaaaacttttgaaaaataaccaagtagaagttatttttagaaacctggaatgtcattccacctaacagaaattaaaactggctgggcctggtggctcacacctgtaatcccagtgctttcgaagaccaaggcaggaggatcgcttgagtccaggagttcaagtccagcctgggcaacatagagagatcctttctctttaaaaagaaaaaagcgaagtgcagtggctcacacctgtaatcctatcactttgggaggccgaggcaggaggactacttgaccccaggagttccagaccagcctgagtaacataagaccccatctacacacaaaaatacataaaaatgagctgggtgtgatgatgcatgcatgtagtcctagctactcaggagtctgagatgggaggattactttgagcccagaaggtcaaggcttcagtgagccatgatcagaccactgcactccagtcttggcaacagagagagtctccgtctcaaaaaataaaataataataataataaaaaccaagataaataatataaccacaacttttcttgacccatcaaagaggcggggttacaaagtaaccaagtagtagccaggcgtggtggctcacacctgtaatcccggcactttgggaggcccaggtgggcagatcacttgaggccaggagttcgaggccagcctggccaatatggtaatatcccatctctcctaaaaatacaaaaatcagccagccatggtgatccatgtctgtaatcctagctactcgggaggctgaggcgggagaatcaattgaacccgggaagcggaggttgcagtgagcagagatggtgctacttgcactccagcctgggcaacaaaagcgaaactcagtctccaaaaaaaaaaaaaaaaaaaaaaaaaaaaaaaatcaaaaaagttgaaaacagatcaatatctggcattgaggcttttaaaaagtcaaatccaaaattccttataaaggttcctgcaaagccaacttaaaaagggtccgtatggtggatcacaattcttgctacatttgatgcaaatcttcaggccaagtataaagcaactaaaatttgttttgcaaataaattggtcttactattatatatataatttatccctggtagaaatggggaaactggagaaagaaaaatttagattctagccttaaccattgtttgtgagtttttattatctgcctacaatttgggctaatcctgaaccatttcctggctgcaacaagtctctaaagaagaaccgagttttaattttcatcatgatgcattttagttggcttcttaacagaatacgttcttttttcattgttgttctggcccacgaattctgggtttttttgtttggtttttgagacagagtctcactgtcatccaggcgggagtgcggtggtgcggtctcggctccctgcaacctccacctcccgggttcaagcgattctcgcgcctcagcctcctgagtagctgggattacaggcgattctctttctattgcaatctctgtgtgcacagaattctactatccgagtgatcgatgttatatatctcacattgttttgcctattctgacagaaccaaagccactgcattctgaagactgaagacgatttaaaagcctgtgaatctcccttgtttggaatcccactgggcccgatctgttttccatgaccaaggcactgctgctaaagctatacagtatcaagcaccctccttaaaggctcagggaccatgaaggaagaagagggcatgtgagattacaagagctggattacaagagtggactgtggaggctgaagtagctccatcgtggatgctactccgccatgtggcttctgattaaccccagttccaggaaaccctctgagatttccagcttatgcgctgttcctcgtgtaagaccaagaacttaccataaagcctgaccttaggtcaaacaactttgatgttattgtactcacactgacctacacatccctctgaatcaccccttccctacggtatacaagccctgggaccaggggataatggtgcagggatccactgtctcttctcgctgcagccccagttcacagactaatgaacagaagcttgagaacagacatagcttctgtgcataagcccctattaaatgtttctaagaaaaaagaaaatgcttgaagaagaaagaaaggatagaaggaaatatttgaagagataatggccaataattttttaaacataataaaagacatcaaagcacagatccaagaagtttagaggactccaaaaaagagaaataccaaaacaacatcatgtccaaattgtcgaaaactaaaaataaagagaaaatcttaaaagctgccggggtgacagtgggaattgggaaacatattacattcagaggaacaaagaaaagaattatagcagacttctcaccaaaacaacaaaagccagaaggcagtggtgtgatatctttaaagtactaaaagaataagttgcaaaaaaaatttttcaacacaaaccttcatatcctaaaagaaaaaaaaaaaaaaaagaaacaaacaaaaccaaaaaaaagaaaaaaccgactcttaaaaatgagtgtctcttggatctccttggtatgaaatttttctttaaacattttcttttttttcagaaagagtctcactctattgcccaggctggaatgcagtgacgtgatctcagctctctgcaacctccgcctcctgggttcaagtaattctcctgcctcggcctcccaagtagctggaactacaggcatgcgccaccatgcccagctaatttttggtagagacggggtttcgccttgtcagccaggcaggtctccaactcctggcctcaagtgatcaactctcctcagcctcccaaagtgctggaattacaagcatgagtcaccgcacccagccctctttaaaaacttttttttttttttgagacaaaagtctcactcagttgcccagactggaatgcaatggcgcgatctcagctcactgcaacctccacctcctgggttcaaatgactctcctgcctcagcctcccaagtagctgggatgacaggctctcaccaccatatccagctaatttttgtatttttagtagagacagggttttgccatgttggccaggctggtcttgaactcctgactgcaggtgatccacctacctcggcttcccaaagtgctgggaataacaggcatgagccattgtgcccggcctaaaaacattttctaatgggagggaaataaaaactttttcagacagacaaaggctgagatcatttattcccagaagacctgtagcataaaaaatgttaaaggaagtttttcagtcgggagatgagacagaaacctatagatctacacaaagaaacgaagagttcctgaagtggcctaaaaagaagaaagattttcaaaataattttcaaaagtattttgaaaatcttccattgttctaaaactacactgtctatatggcagccgcttaaatttaaattacttaaattaaactagtttatttaaaattcagttgttttcaggtactcaatggtcacacatggatagtagctaccatattgtatagtctagatataaaacatttccatcattgcaggaagtttcatcaaacagcattgctctaaaaggtaattttctgtaaaaataacatgttatgaggtttataatatatataaaatacattattatgacactattagcatcataaacatttacaaggttctcatagaaccttgtagtaacttacagttatgaagaattcttacgaggttcttatataataaatggtataatatttggaggcagactgataaaaaatgtactttgtaaatttcgggcaatgacttaaaataagtgagaaaaaatatataagaaataaatcgatagaagagataaaaatagaatcatgacaaaaatctggctgggcacagtggctcatgcctgtaatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtacgcctatattcccagctacttgggcgacagaggcgggtgggtcgcttgagcccaggaggtcgaggcttcagtgagctacgatcatgccattgtaccccagtctggatgacagggcaatacccagtggcaaaaaaaaaaaaaaatagaaaacacactagcaaattgtctacaaagtggaaggttaaaaagtgatcgaggggaaaaaaaagcagttcggtatttctttacatagacaattcaaaaggttgttctgaatctcacaaagatttattgaaagttgttacacttttaagtactactttatggccgggtatagtggctcacacctgtaatcccaatacttttgagaggctgaggcaggaggatcgcttgagcccaggagttcaaggccagcctgggcaacatggtgagaccccgtctccacaaaaaaatagaaaaattagccagctatggtggtgcatgcctgtagtcccagctactcaggaagctgaggtaggaggatcacttcagcccaggaagctgaggctacagtgagctgtgatcatgccactccactccagcctgggtgacaaggtgagacctgttactatatatatatggagtgcagtggcaccatcttggctcactgcaacctccgcctcccgggttcaagcaattctcctgtcccagcctcccaagtagctgggattacaggcatgtgccaccacgcccagataatttttgtatttttagtagagatggggttttgccatgttggccaggctagtctcgaactcctgacctctggtgatctgtccacatcagcctcccaaagtgctgggattacaggcatgagccaccgtgcctggccagtgcctaattttaatctcttactaaattaaccactaaattaattttttaaaccccagaggaacattaatttacagcagaagaggtaagggaaaactggatgtactggcaagaaatgtacccggtcccatgtgtgcaatctgtcaacatgtaaatactgagcgtctgctaaacaccatacaccagggacacaaaaatgttgcaaaatgtgtcctggagagctcagtgaaggggagacacaactccaaagacccattaacgcaaaaggaggtaaaaagagacctggcaaggaatggcggctggggcagcgggggggccaggcgggagggctcaggaaaagctttccaacggagatgctactggatcttgtaaggtgggcaggggtccaacctgcacagatacctggctgagagtatctggcttatttgggaaaaatgcaggcagtgttttttggagaaacagataaattttaagtctggaagagttcataggggttctattatcctgaaatgcatcgctgttatttctttaagtgacagatatctagttaatgaggagaaaaggcaggcacaaaagcacaacgtgatgacagagcaaatgcaaaataacagctgggtggcgtagcacatgcctgtggtcccagctacttgggaggctgaggtgggaggatcacttgagcccacgagttcgaggctgcagtgcgctaccatcacacctgtgaacagccactgtactgcagcctgtgcaacacagcaagacccccgtcttacaaaacaaaaatgcaaaacaaaattagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgatttttcttgcagatgaaatattcccaagctctcacctctaaggtctaagtggatcttgtgataaccagcacaaagtgaggctggggatttgaaaagaaaataccagaaatggttaccaaaaactgacaagagcacccaaacagcatctgtgatcgctagaagatagacgcactgacaaattaaggagccattaattagtttcaaagagaaccaaatggcatcaataattttttttttagacaaggtcttgctctgttgcccaggctgcagtgcatcaataattaagaatcagcctcctggctgggggcggtggctcacgcctgtaatcccagcactttgggaggccaagggaggaggatcacctgaggtgaggagtccgagaccagcttggccaacatggtgaaaccccgtctctactaaaaatacaaaaattagccgggcatggtggcaggcacctgtaatcccagctactcagggggctgaagaaggagaatcgcttgaacctcagaggtggacgttgcagtgagccgagatcacgccattgcattccagcctgggggacaaggttgagacttcgtctcaaaaaaaaaaaaaaagaatcagcctcctttctgtacacgctttccacagctagcatgcggactcactggactacagggtgtaagatgaggccaactgtaagccctatacagggaagttacagttttgttcaaaactcactcacaattgggaacagcctgagaccatgcctgcatggaacagcacagccttgtccccccccgaggacacttcctgtgacatctggagagatgagcagattcacgaggcccaggagggttttcaggtggtctttctggctgtagagagatcaaacacacccttccccaacgtcctttaggagtaaatgaccaatttagcaacaatgagcactcaagaagtacgccagcattctctttattatgattatttcctgcacattacatcatgccttcttttcttacagcgggaaaacacccacacacacgcacacaggtatatgcacacacacacatcaaaagttactgtaactcctaagcagagaataggcatatttttggcctttacctttcagtccaattttttaaaatgagatataaaaactgaaaaggaggggattttaaatttatatgattttctgccaagaaaaatctaaggctatctgatttttaaaaatcagacacaggccaggcgcggtgactcacacctgtaatcccaacactttggaaggctgaggtgggtggattacttgaggtcaggagtttgagaccagcctggccagcatggcaaaacgccatctctactaaaaatacaaaagaaattagccaggcgtggtggtgcacacctgtaatcctagtacttgggagtcttcggcagaattgcttgaacccaggaggcagaggtggtagtgagccaagatggtgccactgcactccagcctgggcaataaagtgagactctgcttcagaaaaaaaaaaaaaattcagacacaataagcattcaattaagtgtccagttacaaagaaaaataacatgttcagcttcatagtttcttataaagttaaacacactcatcatacaacccagtcactccactcctatgcatttaaccgaaacaaataaaaatatacatccacggaagacttgtgaatgttcacagcaactctattcataatagccaagaactgcaagcaactcaaatattcatcaactgataaactgattttttaaaatggtggtatatccagtccaggcacaatggttcatgcttgttatcccaacactttgggaggccaaggtgggaggattgcttgaactcagaagtttgagaccagactgggcaatataatgagacctccatctctacaaaatacttaaaaattagccaggtgtggtggtgtacacctgtagtcccagctacttgggaggctgaggtgggaagatcacctaagcctaggaggtcaaagctgcagtgagatcacgccactgcactccagcctgcctagagtgagaccctgtctcaaaaaaagaaaaaaaaaaaagaaaacaaaaacataaaagtattagaagaaaatataggttaatattttacatagtcctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcagtaaggaaaagacaaccaattcacaagcaactcatgaagaaatacaaaagggcaacacacatatgaaaaagagatttggccccactactaattatcgtgggcaaagacaacggcaaataaggatattcatcacactgttataattgacaatattatatttcatcgagtctaagatgccaatgatgatgtttcattactttttgttctattaaaatataatgcaaagtgctgccaattaaactatgacataccattaaattatacaatgcatcctgatgtgagggatggctggattattaacagtttcatattgtgatatacaatgattcaaagctggaaacaatctacatttccaacaagagatatttcctgaataaattatagtacatccccagaataaaatctaagtcatttaaaatgatgatacagatgtatgtacagacttggccaggcatggtggctcacgcatgtaatcccagcactttgggaggccaaggtgggtggatcacctgaggtcaggagttggagaccatcctggccaacatgttgaaaccccgtctctactaaaaatacaaaaattagctgggtgtggtggcggacgcctgtagtcccagctactggggagtctgaggcaggagaatctcttgaacccgggaggcagaggttgcagtgagccgagatcatgcccctgcacttcagcctggatgacagagcaagactctgtctcaaaaaaataaaataaaataaaataaacaaagatgtacatacagatttaagtggaaaggtattcatgatccatgaatggtgtttaatggtgttaatggtgtttaatggtgttaatggtgtttaatggtgttaatggtgtttcatatgacaccattatatctatatatatttatatgcattgatatatatttgattttgaataaatatttgatatatatcgtatatgcactgaaaaagtctaaaaacctcatgttgaaacattcaaaatggctatctctagttggtaaatgtttttttaatcttctttttgcttatctgtcttttctaaaacaccaaaaacatgttttacttttataataaaaaattaataaaaataagatggtcaccccctttgccatctgccaaaacagagagcttcaaaagtcacacattccttaaagctgcagtatttacaaaggaaagaaaaaccttcaagcaatctaaaaagctcaaacaggaaatgattaaactatggcatattaattcaaagaaatactatattatgtagatgcacaggaaaatccccatgaaatagcaacagaaaactcaaacacaaaatgaccaacatcaattttaacaaagaaaaaaattaccacctgtacctaagaatttaaagaagttaacagaggtaatttttcttttctttactttttttttgagacagtcttgctctgttgcccaggctctagtgcagtggcatgctcttggttcactgcaacctccatctcccaggctcaagtgattctcctgccttagcctcccgagtagctgagactacaggcgtgcgccaccacacccgattaatttttgtatatatatatacattttttgatagaaatggggttttgccacgttggccaggctagtctcaaactcttggcctcaagagtgatcctcccgcctcaacctcccaaagtgctgggatttcaggcatgacccaccgttcccagcccaacggaagaaatttttctaataggcttcagagaattatgtgttttgacctttccattaatgtcttatataaaattagtttgacagaaacaataaaaaatatatacaccttcagaatcatgacggcgttctccaggcctctaccagaaacatttttttcgtttttttttttttgtaaaaatatcaattttatgctccaaaaacattccacatggcaaccaaggtcccgtagagagcactttttcccccttgcctcttctttaaactcctaattcaaaattttggtttctgataacctgctcaggataaaaagaaaatctcacatagaaatgcctttactacagggaaatggagcaagaaatttcccttgtctctgggattgcttttttctgttttctggttaaggaaaacatttcaaagttcataaaaacaaggaactaaaattagagagatgagaactgaaccttgactcgaggtagggaaaacactatttttaaaccgagaaatatttctaggtctgtgctttatgagaaaggaagacgagcgtgctcatgtgtgtggatggtgtggcctggggagggacggtggcaggagaaaaccatctcccgcagcggggcattccctgcacctcacacacatctgctctcgtggaacacaaactggaactaatcagcaggcggcacctgggaattctagtcacttaacagcagggagaaggttgcacgttgctcacagcagatcatgaagccatctccacctcctgctgtcaccatcctcagaaccagcagtggctccatggctccctgactccagaggagctggccgcacaggagaccctctgtcattcctgcagaacagctaatgctttgcagagctccagatgtaagtttaagaaatacgtttgttataaggtttcttaacaagacacatcagtgatatctaagactcttaacaggtgactattaaagaaataaatctcttccacatattaaaaccacattcatcctgacagtcatagcccagctcgaaagccttcgagagtgcttttacctcccaccacatcaaatctagatttcttcctttcatcctgacacccacatgttcaacatcacagcacatgcggggagcccccagggtgcaggaggggaggagggcgctgtgtctgcaggggcgtgtgggtaaaagcaagagagggtgtaacggtgggtggggggagggtgctgtgtctgcaggggcgtgtgggtaagagcaagaggggggcagcaggggaggagggcgctgtgtctgcagtggcgtgtgggtaagagcaagaaagggggcggcgggggagtcttggagaagggaggggtgcggaggggcactgccttgtgaggtcactggtggtgatgtgggttccaagcagcaagaaaaagggattgaggccaagctggagaactgaaggcaagtcacgcacaggcagagttggttaaatgatccaatttcacaagtttctcctagaacaagcagctacattttcattttttaaaatgctgcatgaaggttgggcagtggctcacacctgtaatcccagcactttgggagactgaggcaagagtgtcacttgacaccaggagttaaagaccagcctcggcaacatagcgagaccctgtctctacaaaaaaaaaattgaaaattagccaggcatggtggtacacgactgtattcccagatactcaagaggctgaggcaggaggatggctagagcccaggagatcaaggctacagtgagccactattgccactgcacaccagccagggcaacagaacaggaccctgtctcaaaagaaaaaaaacaaacaaaattctatgttttaactaaagtcacagccactaatgcattgcatccctaagaatcattttctttcttcatgtcctccccgttcccacacacctaccttccttaccagcagaagcctgattctgcttggggtatctcccttctacctgcttaggaaggagatgcacacacgcacacacacacatgcatgcatgcacacaggcacacccatgcaagcacgcacacacacatgcaggcacacccacgcatgcacgcacacatatatgcacacccatgcacacccatgcatgcatgcacacatatatgcacacccacgcatgcacgcacacacatgcacacccacgcatggacgcacacgcacacacaccatgcatgcgcacacacagcccacccgcagtaagtagctggagcagggtaagttcaccccaatggggcttccctcccctttccagtaactaaggaggatgtggcacatggccccgccttggccaaagggagctgagagatgtctgcttagtttccatgccagtaaaataagacatgcaggattggaaaagcccctcttctttactagatatcactgtgtcattcggaatggctgcagccactttgtgccacaagggaagacatctcccacgtggcaaagacagcagagagcaaagatgaaaagcacctggggtcctggaaatgtcatcacacctctgaattaatcaaccctggaactgccatacttcttgttacatgagatagtaaatgcgtttttttgtttgtttgttttaggtaattttagttaggttttcgttaactcacaacaaaaaccatcttaaccaatataacatgcttattttatcaaaacataaagtcttttttttagaaaaatcacctatacataagttttctgtttgtgtgggatacaaaagtgtctttccactagtgtggctataataaaaaagacgaacagcagcaagtgtttatggagacgtggggaaatcagggcccgcacacactctggtgggaagagaaaatggcatagccactttaaaacaaactccagacattcctcaaaaagttaaacagagttaccatatgacccagcaattccactcctaggtacatacccaagagaaatgaaaacatatgtccacaggaaaacgtgtctgccaacattcatagaaacactattcatcatagtcaaaaagtgaaacaacccaaatatccatcaactgaggaatggataatcaacaaagataaacaaaacgcaatggaatattattcagccatgaaaaggaagaaagcactaatacatgctacaccatgggtgaacccagaaaacattaggctcagtgagagaagccagtcatgaagggccacatatgatgtgattccatttttatgaaatgtccagaacaggcaaatgcaaagagacagaaagcagcttaggggctgccaggggctgggagcactgggggtggcagctcgggtgtgccgggcttctctgtcgagtgaagaaaacgtccccaaattgtctgtagtgatggatgtcaaagtataggaactgtacacttaaactgctgaattgtgtgacatgtgaattacatctcaataaagctttcttttgtttgttttgtgtttttctttttgacacagggtctcaccctgtcacccaggctgggtgacaggtgaattacatctcaataaagctttcttttgtttgttttgttttgtttttgtttttgacacagggtctcaccctgtcacccaggctggaatgcagtggcacaatctcggctcacagcaacctccgcctcctgggttcaagtgattctcctgcctcagcctcccaagtagctgggattacaggcacccaccaccacgcccagctaatttttatatttttagtagagacagggttttaccatgttggccaggctggtctcgaactcctgacctcaagtgatctgcctgcctcagcctcccaaagtgctgggtttacaggcctgagccaccgggcccagcctcaataaagcattttttaaaaaatgaaatgttggctgggcacggtggctcacacctgtaatctcaacactctgggaggccaaggtgggggtattgcttgaggccaggagattgaaaccagactggacaacacagtgagaccccatctctacaaaaaattcagaaagtttaaaaattaggtggtgcacacctctagctccagctactcaggaggctgaggtggaaggatcacttgagcctgggtggtcgaggcttcagtgagccatgattgcaccactgcactccagcctggatgacagagtgagactgtctcaaaaacaaaaacaaaaacaaacaaacaggaaatgtgatagaatcagtggcaatctctgtgtttctgttattaacatagccaaactgagccgcctgctagttatcagaaacccaacaaggaacgacccatattcctgtgacttcttaagtaactacttaacttgcgcatttatgatactcatatcaacttcaactcccggccttctaactggtttagctacagccaaataaagtacacatttttaaaagtcttcagacgcctgtctctccatttacccattggtgccttaggtataaacagtgctgagtggtggcactggctggcaacacccagaggctgaaagggaggacactggaagctggacgcagtggctcacgcctgtaatcccagcactttgggaggtcaaggtgggcagatcgcttgaggtcaggagttcgagaccagcctggccaacatggccaaaccctgtctctactaaaaatacaaaaattagcggggcatggtggcgcatacctataatcccagctacttgggaagctgaggtggaagaatcacttaagcctgggacgcagagattgccatgagccgagatcgcaccactgcactccagcctgggcgacagagcaagactctgcctcaaaaatgaaggagagagagaaggcaccaggttccaaaagagagccgcaccaagtgtgtgcacccagcccccaggagccctccgtaaatgtgtgttaaatgaatgtgtgtgtgaacaccatcagctgaggtggtatagaaaaagcaactcctggtcagagcagggaggaactcatctaaaggggaggctcccaagagctgcagcagagggtcaccaaaggaggggaactccatgtgggattccaaccctgactggttacatggaagtgaacaggacctcgtcgaagagggagaggtctgcgttgcctccaagcagtgcttcttgaaatggtatccccccagcagccgcctcagtatcacctgggaacttgcaggaatgcacattcttgccccaccctggacccgctgagccagactctctagggtggggcccagacgtctgtgttttgactcagatgacatcggtgcaggctcgagagtgagctactcttccagggacaaccagtgtggtccttccacccatgcgtgtccagggatgaccagtgggtgctggtgttcagggtggtgtgcggacatccattcatttattgcataattattaaaaaaaaaacaacactcgctgagtatctactgtgccctaaaaaatgagaaagactccgctaatgtgtaggcagtcaaccagccctggtcagcgtactcacaggtaggcagacggccgcgcggagagcaccaaggggcagaaggatgctgcttgggggtggggaaggtggcgacgcaatgaaaacagatgaaggacaaggagaaaaaaaatcaagtgctgccagacactggcacaaagctggaagggaggtcacatctatcgagggggaggagggcaacacaggaggagaagagacagggaaaccgcctctccggtgccttccacagagggtccattgcaagcaagtggagaatcagccacatgccatgtactacgtggcaggggtggcagcccgagccctgagatcggagagcctatcccatgtgacgcatgtcagccacacatcacccaggcctgtgatgaaggacaagcgcacgctccgctctgatgacacgcgcagctggcacggacccaggagggatcatggacgtgaggagacgtcagtgtccaaagagggcccatcagcccagagaaagttgacacagaatcatgaaacataatctacttaggggacagctcactctcagcaccagtacaaaatgtagattttatccattaatacttccataattagctcaaaaaaattggactgtgttttttatttttattaatttttttaagacagggtcttactctgtcacccaggctgaagtgcaatggcatgatcttggctcactgcaacctctgcctcctgggttcaaacgatcctcctgcctcagcctctctagtagctggaattacaggcatgcgccaccacgcccggctaatttttgtatttttagtagagatggggtttcaccatgtttcccaagctgatctcaaacccctgacctcaggtgatccgcccacctaggcctcccagagtgctggaattacaggcgtgagccaccacgcccagccctccaaagcttcttcattctcccctaatcaaggtgctgctccttcttcaaatcctgccatcctaggagctcacctgaaccctattccattctgatactgcgccctacatcccaacaagttatgtcttttacctgcattctattaatgtgaaatccactctggctttcttggtgagcgtttctacatttacctgcacccctcatgaagcagggagtttcctcttttatggtgaggttttgttttgtatggagattcgtttgttctgtaacatctccttctttaagaacaaggaaggccgggcacggtggctcacgtctgtcatcccagcactttgggaggctgaggcaggcagactggttgagaccaggagttcgagaccagcctggccaacacagcaaaaccctgtctctattaaaaatacaaaaaattagccacatgtggtggcacatgcctgtaatcccagcttcttgggaggccgagacatgagaattgtttgaacccaagaggtggatgctgtagtgagctatgatcacattgctgcactccagcctgggcaacagagcgagattccatctcaaaaagataaaaaaaaaaaaaaaaaaaagaagaacaacaacagctaagagtttggcagagtttactctgcacagttcagggagggcactgagtctgtgggcataaacactcagtccctcgtgggatgtgctggatcaaatcagatcctttgctcagatactacagtcctgaagcaatcctgttactatttgctcggatactacagtcctgaagcaatcctgttactatttgctcggatactacagtcctgaagcaatcctgttactatttattttctttctttctctctctctcttccttccttccttctttctcttttctttgtttctctttgtttctgtctctctcgctctctccctctctttctccctttctttcgtttctttcttcctttcttcttctttttttttgtttttttgcgacagagtctcactctgtcacccaggctggtgtgcagcagtgtgagctcaagcaatgctcctgcctcaacctccccagtagctgagactacaggtatgtgccaccatgcccggctaacttgttactattaatgaggcctcacagataccttgatctcatggaggaactgccttgggaagtagatattaatattccagccactggaaaagtacatcatattccccaaagtaacttaatacactggcacctgctttatacatcggtctcatggtcagcatgaatcacaactcctaaactcacacagttctgaagactgatggaaatgaagattctggtttgtttttgtctttgttttagatagggtcttgctgtgctgcccaggctggagtgcagcagcatgatctcagctcactgtagcctcaacttcccaggctcaagcgaccctcccacctcagcctccagagtagttgggactacaggcacgtgccaccattcccatctagtttttgcattttgcagcgacaggatttcaccatgtgaaccaggctggtcttgaactcctgagctcaagcgatctgcccaccttggcctcccgaagtgctgggatgacaggcatgggattccaaaccaagattcttaatctcaaaattatgaacaagatcctgaagctcggtgatcacctcaggatctctgtccctcctaagaggctgtaacagcaccgtccacctcatccctctccgctccacaatctacaaaatctctatgtccaatcttatcttgccaatctacaactgtcttgtactacaatatactctaattgttaatgttggtctggtaggttcgcttttcataacagctttatatagagagaattcatatactgtgtaattctctcgtttatagtttataattcagggaggtttcgcacacagagttgtgcaaccatcaccatagcccattcgagaacattttcatcaccccgaaaggaaaccccatccatacccatcggcggtcacctcccatttcccttcagtttccccagccctggccatcactaatctactttgtgtgtatggatttgcctgtagttctagagttcctagaaatggaatcatataaaacgtggcatttgggtttttgttttgttttgttttgagacagagattgctctgtcacccaggcaatctcagctcactgcaacctccacctcctgggctcaggtgatcctcccgcctcagcctcccgaggggctgggaccacaggtgcatgccaccatgcctggctaatttttgagttgacaggattttgacatgttgcccaggctggtctcgaactcctgggctcaagcgatcgaaacgtggcctttgtggtctggcttttttcactgggcatgttttcagtattcgtccacgttgtcacatgtatcagaactccattcctttttaaggctgaatcgtatgctatcctacagaggtgctacgttttgttgatgtgttacttgttttgtttatgtgttcatcagcagacaggcatttgggctgtttccactttttggcaattgtggataatgttgctatgaacattcctataagtttttgtgtggatgtgtgtttttcacctcttaggcacaaacccaggagtggcatggctgggccctacggtagctccgtgcttaaccttttggggacctgccagactgtcttctgcagcaagtgaaccatttcacgttctcaccagccgtaaaggggaaagtctgggaggctcccgagacaagaccatggtttcttcgtgctcacatcttcaacctccagcaggtactccaaaattttccaccagtgcctgcgtgccaaggtggcttccaaagagagagcaaatcaagcctggccacaggggaccagggcacttcccagaacagtcctctccctggtgggatccttttgttccctggaaaagccaaccccccttaatcctgggtagttttacctacccacaggcttgaattacatcctaacaaacagtaaaccacacttgctgggactccgtgggcccgagggctgcttaacagcttggcaggcatccccggcagccactgtgacccagctgccctacaggccattccaagctcccccaacaagggcacttttcaggtgaactcatacaaatgtgtgccgagcgatacccctgacttggaggggactccagctgaggtcagccctggagcaggccccccacgccctatggatacttccaagcccaacttagcaaatacagctggaggcgtccaacctcacccagttgttcaaggagggaccttgccccttcctttgcctttaaggatgaacagattttttttctacttagaaactcaatgtgttcctcttctatcctaaacactactgatgttcggtaatgcagacatgtttacatgctatttcttgttttaacaacatgaaaacaaaataaaaatgaactatgaactgatgacagtgtttgggagttgagctttttctgtggccaacgctgcttttaaaaacgttctatattaaggaagtgctgtgggaacactgctggccgtggaaaccgtcccacctccctgtgctccgaagccagccagcaggcagagtcctggctgggcacgagacgctcagggctcactcgaccccacggaaaccagagggaagcctaattttatcacgctgtatttagacggtgtggattcatttgaacaaggaagttcctagagttgttgagattttttttttttggtcaatgtttaaatactacttttttttcaagcttgccctagataccaactgtttatctaacacacaattccagtgttgccaagcctcatgccaatttgaagggaacagccaaaacttatgcattcatataaaaagagtctctaggctcttatatctacattataatttttatcctaatcacaaaactattccgaatggtagtgaacaaagtaattatttcaatcaagaaacataatggccagccacatctatgaccaaattgacctaagctttcagatgttttccaaaacatcggactgccacaggtaactttttacagggtcttcatataagttcctattttattattttattttattttattattttttgagacagagtctcactctgtcacccaggctggagcgcagtggcatgacctcggctcactgcaacctctgccttccaggttcaagcgattctcctgcctcagcctcccgagtagctgggattataagcacgcgccatgatgcgcagctgatttttctatttttagtagacacggggtttcaccctgttggccaggctggtctcgaactcctgacctcaagtgatcctcctgcctcagcctcccaaagtgttgggattacaggcgtgagccactgcacccagcccaagttcctcattttaaaagtggcagaggtttgtcaaaaagttaaacagagttaccgcgtgacccagcaactccatgcccaggtatgtgccccaaagaactgagaaaacagatactcaaacaaaaacgtgtacacgagtgttcccagcagcaccatccacaatagccaagaggcagaaacaaccctaatgtccatcaatggaagaatggaaaaacaaaatgtggtttatccatacaatggaattttatgcacccataacaaaaaggaggtactactccatgccacaacatgaatgaaccttggaaacatgctgagcgagagaatccagacacacaaagccacgtatcctacgattccaagtataagaaacgcccagactcggtaaatcctgcagatgcaaagtgcagcacagcggctgccaggtgctagggcttgggagctgggaagtggctgcttagtgggtgtagggtttccttctaggggtgatgaaaacgcttcggaattagacccaggggatggttgcacaacactgtgaatgtgcgatatgccactgaactgttcaccttaaaaatcattaagttatgtgaatttagcttcaattaaaaataaagcaggctgggtactgtggctcacgcctgtaatcccagcactccgggaggccgaggcgggcagatcatctgaagccaggagtacaaggccagcctggccaacatggtgaaaccctgtctctactaaaaatacaaaaaattagacaggtgtggtggcgggtgcctgtaatcaccggtacttgggaggctgaggcacgagaattgcctgaatccaggaaacggaggttgcagtgagctgagatcgtgccactgcactccggtctaggcaacagagcaagaccctgtctcaaaaaacaaacaaacaaaagaaccaagtaggaagaaatgtggccagttcctcctgggcagtgttgtacagaacacaccaaatttctacagtgactcctaccagacgtttcttgggaaagtaagcaaagtcctttcctgaaattctggtaaattttcataaaaatcaatacttccctaatttaacattcacattttagcttacagtataactagttatagaattgttcattaattctaattgactttcgattatacaatctaatatctaatttccattttctatttctagtacataagcaaaagaaatgcccttttggtcttatggaaaacgtgtcctatttaataagacacaaatttgattcaaatttctctttctcctcctcccccttaataatacactaaaaataactgtaataacatcttacacatcctgaacgcctgtacctagcaacctcacttactcagactatagctgacaactaaaaacctgcacaaaggctgactccttagccctttccatcaaacgatatctgcaggctgaacgagcttaattacttgttggtttggttttttaatgtaacgaagtaaaaaccaggagcaaatgtgatacaggaaagcacaccaacagctacatacatggatagcaaaagaagccaaaaaaattattttttaaaatgtaagaactggaaaaacagaatgatctcagtttttttaaaaaagcaaagattcctatttttatagagaaattgctatattagtaaaagccaaataacaagaggcaaaaataactgagtcatcaagaaaattacctcttatttggcacagtccatttttatgaaagtgctttatctatttcagaaacataaaatcaaatgtttgaattggttaaaacagaaaattatctgattgattaaaagagaaaatcctctgctcttcagaaaactcaaccatccagaaagtgctatcactgacatttatatctaacaacatggcaaatgaggttggtttcatattcaaccatttgctgtccccgaagctctctattaaggatctggctgatcagaaaacttaatatttaatcaacctagagcaggcctagaaaagaggctactgtttaaaaacaaacaactgattatataaaacatttacatcaaattataattcagtattaaatctcatggaatcacgcctttcaggaaaacgtctggacactagtgaaaatgaaatggctaaatctcaatcaaagtatattattaagtaataaaagattttatcattcaactttttttttgtctctacataaaaaaagtatttttgtctctacaaaaaatacaaaaattagtcagtcgtgttggcatgcgcctgcagtcccagctactcaggaggctgaagctggagaatatcacttgagcccaggaggcggaggctgcaatgagctgagatcacgtcactgcactccagcctgggcgacagagccagacgctgtctcaaaataattaattaattaattgtttaaaaaatcaaagaatagcttaaaattattactaagctaagaaccttgctgctattacttgttcaggaaagctccacacaccataggcagtggtgctaaatgcaacagaagccttagtgcgaactggaacttctcccaggagtctatggaattggaaacttaatagctactaaatacagtaacatcatgactggagctatgaaagcaaacatttccatttgaacttcaagtggcagaagggacaaagttgataccttagactcatcagccctgaaagtgttcctaatcacaatttctttcaggagccagaaagaacacagcgttaattatgttaatccagctgagacgttcactatgaaatgtgtgttagagaaaagtcctttgaaatttcttatttgcatggtagttctgaaagtttttaacctcctgcagttcctggcacacggagtcagtcactcacttgtcctcaggaagcacaggacagcagcaggttcggaatcacactttctctgtgtgatttcacaactcgggtctttgtccaggtgagattctcactcgggtcagagggcaaaggtatccaatgacaaccctgtccttcagaaccaagtagtgttttcccatcagccgtgcaaatcacagcaaatgtcatgtggctttccagcagcctctttgctgtttgttgaggaaggataagaaaaccatggaggattaaaatcaccacattcaaattactataaagaaaaggaggccaggcgctgtggctcacgcccgtaatcctagcactttgggaggccaaagtgggacgatcgctcgaggccccgcaacacagcaagacccccatctctaataagaaaaaaaaaagggagaagaaagaaaaggaaaaatgcagacaagccagaaaataaaattgaggagattaatacaatataataatcaggcactgcagatcacacctggaacaccgcctcacccaggcaaaggaggaaaagctttcatgtgtgctcatcatttgagcaaaaaggaagaaaacacacacagaaactcaggagatccagaagagacactctgaacaaagaaaatggaaatgacagggaaccaaatgatccacatcagggattttaagagggaaattatgcttctgaatgaaaaaaataaaatcattcaaaactttttataaatctttgacaaaatccaagagtttcctttcaatgttgatgacatttaatttttttttttttttttttgagacagtctctgtcacctaggctggagtgcaatggcgcaatctcagctcactgcaacctctacttaccaggttcaagcgattctcctgtctcagcctctgagtaactgggattacaggtgcgcaccaccatgcccggctaatttttgtatttttagtagagacagggtttcggacgttggccaggctgatctcgaactcctgatctcaggtgatccacatgcctcagcctcccaaagtgctgcgattacaggcgtgagccaccgcgcccagccctctaatttctaattacaacatctaaggtagacactttccagatgcattaatgtgggggacaactagaggactaacacgtccccttgcacactcaatatagggccagtagatccagaagctcaccgtcaagagcaacaagagcaagcaagtccttcctcaacagaatcatcggtaagaacactgtcagtccaggattcactcagtcctacgagtgaaaaacttgccaacacagtgaaattcattttactggcaactaaccttccaatctctctctaaaataatgttcacatgggaactgaagcacattaaaaaaataataattattcacttcacattttctccaagccatttcaaaagtgtttctcagactttcaaaatcaaacaggattcccagaccaggcaccatgggtcacgcctgtaatcacagcactttaggaggccaaggcagctggattgcttgagctcaggagttcaagaccagcctgggcaacatgatgaaaccccatctctacaaaatacacaaaaattagacgggcatgatgttgcatgactatagtcccagctactcgagaggctgaggcacaagactcacttgaacccaggaggcggagtttgcagtgagctgagatcacgccactgcactctaccctgggtgacagagcaagactctatctcaaaaaaaaaaaaaaaaaaaaaatcaaatggggttcctctaacgataccctgctttattcaggaaacgtgatcctcaggaaaccatgtgtaaattatacttctagaactcaatcttacgtatttatatttaaaggaagtaaagaatcttttatgaagttacaaatctcacacacgccctgcaatttagtggctctataaatcggagcttccctatgctaaatgtgtctaaatgagagttcgtagttgaaacaagaggacaaagaaaaaaacacttttcaaattaagaatgagcactatgtcccaatcacgtgagaatctcagctatacttagacaatggtggagattttaagcatatctatctcaaactttatattttaccaatatgaaaaaagcagaaccagagagattaaattatttgcccaaaagtgcttgttagtggaggaaatgtattaagaccaaaagctaatttacaaaaacaaattaaattttcaaataagatcatgctataaaagtgcttccctttcagaaaccaccctcaccacacccagtttttaggcagctcattcacacacacaaaaatcacattaatgaacatcagaagcagtggcctttccttatgggaaaaagaactcatttatgaagttccagaatgcgatgcaatccacactttaaatagtaacacaatagggtacgaactaactgaatcaacatgcaataaacactttcacttaaagtgtcatagccttaatggtatattgcatttaatatccatacacaaggaaataaatcacacgcatgtggggtttcttcctttctccaggctagagtgttagaaaatgtagttaatatttcccaaacaactcaaacacgaaaataaatgattcaaaagctgctttttccccgctttggaagggggaaaaaaaaaagaacagattttaatagcattacataaaaatcctggaaattatgcacaaagactaccctggagctttgccagaaacaggcatgctggttttccatgtgtataaatggtaatcaaataagaattaccaggagctacaatattattaagataaatatacttcttgaaatctccatcttacaaagcttaaaaacaattgccagaactaggccgttcaaccccacatttcctgggcctcccctaagcactcagtcctctgtgtttctgccctgcgccccacgccctcagcgcagcacctcggagcccacagtcccaagctgtccacactctggcgcccctgggcccattcacattcccaggcaccatgcgctggtcagccctctcggccaccacctttgctagagcctatcaagaccctccggagcctctatttaatgaaccactcagtcattccagcaaagcggttactgcctttcctctacctggaggcttgttctgtgtagatgtttggggtgtggtttcacacataacagggtactcacatgtggagttacatatatatatatatatatatatatatatatatatacacacacacacactatatatatgtataaatacatatgtacatatatatatatatatatatatatattttttttttttttttttaagacagagtcttgctctgtcatccaggctggagtgcaggggcgcaatctcagcaacctccatctcctgggttcaagagattctcctgcctcagcttcccgagtagctgggattacaggtgcccaccaccatgcccagctgatttttgtatttttaatagagatggcatttctccacgttggccaggctgttcttgaactcctgacctcagctgatctgcctgccttggcctcccaaagtgctgggattacaggcatgagccaccataccaggcttatatttacttatttattcattcatttatcagcaaatattatcacacatatattatatgcctggctatattcccagcgctaggaacacagcaggaagtaaaacatggaaaattcctgctcttaagatgcattccagtggcgtggaaacagattataaacaaaattaagtcaaatacatatgatgcaagctggaaaagagagtggctggcccatagctccaggaggcactgttgaaagcaaggctcctactaagggaattcctggagttgggccttctggaatgttccacagcggtcctgagggatggggtttgctgggctgggggaggactcctcagtctgcaaacatgtcatctacgttttggtttgggattttttgttttgttttgtttttgtttttggtttttttttttgagacagaatctcactctgtcacccaggctggaatgtagtggtgcaatctcagcaacctctgcctcccgggttcaagtgattctcctgtctcaatttcccgagtagctgggactacaggtgcacgccaccaagcccggctaatttttgtatttttagtagagatggggtttcaccatgttggccaggttggtctcaaactcccgacctcaggtgatccgcccgcctcggccttccaaagtgctgggattacaggcatgagccactgtgtctggcctgtaatattcattcatttattcattcattcattcagccaatattatcaggcatgtattatatgcctggctatattcccagcactaggaacacagcaggaagtaaaacatggaaaattcctgctcttaagatacattccagtggcgtggaaacagattataaacaaaataagtcaaatacatatgatgcaagatggaaaagagagtggccggcccatcgttccaggaggcactgttgagagcaaggctcctactaagggatttcctagagttgggccttctagaacattccgcagctgtcctgggggatggagtttgctgcaggactcctcagtctgcaaacaggtcatctacattttggtttgggatttttttttattgttttggttttgttttgttttgctttgttttgtttttggagacagagttctcaccgtgtcacccaggctggagtgcagtggtgtgatctcagctcactgcaacctctgcctcccaggttgaaacaattctcctgcctcagtttcccgagtagctgggattacaggtgtgcgccacgacacccggctaatttttgtatttccagtacagacagggtttccccatgttggccaggctggtctcaaactcctgacctcaagtgatccacccgcctcagcttcccaaagtgctgggattacagacgtgaaccaccacgcccggcctttttattgtttttttatcacgatttacctacattcacagacacctgcccctcaacaggcattagtgggaagatacagaaagaaattctacattgctctcaattgtaggaatgcaaattaaagcttccaaggaactcgaagatgcacaaaccgtttcttgggtggcattatttcctcatagaaacatgcatatactattcattttcttttcaaaaaagatgagggtaaactttagctcagtctctctgaataaacatatcagacaaacagaattaatgagattttaatacctataatttctcaactctttaaaaaggttactaaaagggtatgaaagttatcaaagaccactggggttgcatgaagaggactcagcagccaacttaaaggggctcccatgggccccaaatgggacaatctgagcatcaaaaatcatgtatctgtaatggaatgaaatacatcaaataagctaaaatccaagagtttatattgattcttgaaaaaaatcacctttggaggacgttaagaaaccatctcagctgggtgccttggctcacgcctgtaatcccaacacttcgggaggccaaggcaggaggatggcttgagcccaggagtttgagaccagcctaggcaacatggcaagaccctgtctctctcaaaaatttgaaaaaatcagctgggcgtggtggtgcacatgtgcagtcacagggaggctgaggtacgaggagcacttgaccctgggaggttgatatagtttagctctgtgtccccacccaaatctcatcttgaattgtaatccccatgtgtcgagggagggacctggtgggaggggactagatcatgggggtggtttcccccatgctgttctcgtgagagtgagggagttctcacgagacctgatggtttaaaagtggcagttcccccttcgcatgctctctctctcactctctctctctcctgacaccatttaagatgcgccttgtttctccttcatcttctgccatgattgtaagtttcctgacgcctccccagccatgcagaactgtgccaattaaacctgctttctttataaattactcagtctcaggtagcatcttttttgtttgtttgtttctgagatggggtctcactctgttgcccaggctggagtacagtggcgcgatctgggctcactgcaacctccaccttctaggttccagcgattctcctgcctcagcctcccaagtagctgaaattagaggcgtatgccaccacgcctggctaattttttgtatttttagtagacacggggttttgccatgtcggacaggctggtctcgaactcctgagctcaagtgatccgcccgcctcagcctccgaaagtgctgggattacaggcgtgagccatgcacctggcctcaggtagcaactttatagcagtgttagaatggtctgatacaggtggaagctacagtgagccgagattatgccactgcactccaacctgggcaaaggagtgagactcttgtctcaaaaaaaaaaaaaaagaaaagaaaaaaacaaactcagtctgtaaatggtatagaaagggaaagaaccaagcaaataaaagcatctaaacacacacggctcccaggatcctaggatttcacagtggctgagacagcaggatacgtgagggcagggtacatgacagcagggtaaatgcagagagctaaagacaggtatcgttgttttggctgttgctgccactgctaagaaaattattccaactttcagtaacactagctcttctctactgacaggtattatgtgccaagaacttttctaagaacttgtattttctcatttaatcctcgcagcaattctgtgagatgggtactagtgttttctaatacagcctttgggtttaaatactggctccaccatttagtatccctttctggctgtgtgatcatcacaagttacctaacctctctgtgcttcagtcttctcatctataaaatagagatcatctcaaccctatctgtaatacagtcaggaagtctagtacaatatttgttcaggtgatttttttttttttttttgagacagagtcttgctctgtcacccaggctgagtacagtggtgcaatcacagctcactgcagcctcgaccacctgggctcaaacgatcctcccatctcagtctgccaagtagcttggaatacaggcacatgccaccatgcacggctaattatttattatttttagagacagggtctcactatgttgcccagactggtctcgagctcctggactcaagcgatcctcctaccttggccttccaaagtgctgggattatagacatgaccactgcacctggcctgtacagattatttgatcactgtctacttccctttctaggcgtcatgccccaagagggcaggggccacccctctatctccagaacctagtcctcgccttgccaatggtaggaacccattcaatatttaatgaataaacaaatgagtttacagtaggatacagtacagttgaaaaaaaccactctagttcaaaccacggccaatagctggagttgcacagctgaagatctgcttataattcctcaaccatcgaggggcccatcatcttaagaacctccaggctctggggaactgaagcagcctaggaacgagcctgctgaacccccgagggttttcagtaaagaggctgccaagttcggcagctagagtttaaccagggcgagctatcagtattttgtattttggacacttgccctttttattacgagaaactgacacaatcacagtccctagtgtgttctaggtttcggtactgaacgacacaagatgtgcgccagattgagcgcaggaagaaagaaacaccctttagtgcaatacgaaatgtgactcagccagcggggagcgttagttattgatggaatggctgtccaccatcgagtcactatgcaaataagtgcttttcttgcattatcccagttgattctcccaacgaccctctgacagagacaccatcattcctataaattgcagcgcccctaggtagcttgcccaaagtcccacagttaggaaaccatacaaccgagaattaagcccgaatgtatcagaaatcaaaatccaagcacccaaccattcaagggtgagcccttccaaaaaaaatttacagaaacaaagttgatggttgtttctttgtttgtttgtttgtttttgagatggagtttcgctcttgttgcccaggctagagagcagtggcatgatctcagctcaccgcaacctccgcctcctggattcaagcaattctcctacctcagccgcccgagtagctgggaccacaggcatgtgccaccatgcctggctaattttgtgtttttagtagagacggggtttctccatgttggtcaggctggtctcgaactcccgacctcaggtgatccgcccgcctcggcctcccaaagtactgggattacaggcgtgactcactgcgcccagccatgtgtttgttttttgaggcagagtctcgctctgtcgcccaggctggaatgcagtggtgccatctcggctcactgcagcctccgcctcccaggttcaagtgattctcctgcctcaacctcctgagtagctgggattacaggtgcccaccaccacgcctggctaattatagtatttttaggagagacggagcttcaccgtgttggccaggctggtctccaactcttgacctcaggtgatccacccacctcggcctcccaaagcgctggtattacaggcacgagccatggccagctcgaagttgatggtctttatcacacactttgaacatgagcaacaaagatttaccagaatcacaaaagatttttaaggattttgtaagaaaaggtcaatgtatgaactaaggtcacttgctatttccacaggcaatatgtaatgggtgtgacaactccaattggcgttgtttcacacacatgagaatgcgtgtttgggtggcacatacaaaaccctcagtcttcccatcttgcagcccagctagcgaagcagtactcaaagtgtgatccgcagatccctagaggtccttgaggcctttgcaaggcatctgtggagtctaaactatttgcacaatgacactaagacagcatttgccttcttcagtgttgacacttgcagtgacagtgcagaagaagccatgggtgaaactgctagtgcctgagcaggtcccgatgcagggaaaccaaactgcactagccctcagcttgtccttcactaccccacacttacgaaaggaaaggcagacagcttcacttaagaatgtccctgatgggccgggcatagtggctcacgcctgtaatcccagcattttgtgaggccgaggtagggagatcacctgaggtcaggagttcaagaccagcctggccaatatggcgaaaccccgtctctaccataaagacaaaaattagccgggcgtggtggcacacatctgtaaatcccagctacttgggaggctgaggcaggagaatcacttgaacccaggaggcggaggttgcagtgagccaagatcacaccactgcactccagcccgggcgacagagcgagactctgtcacaaaaacagaaaaaagaaaaaaaagaatgtcccagatgaagctgtcaacatgaatgattggttaaatcgcaagcttgagtaggtgtcttctgaatagtctgagtgatgaaatgagaagcacgcctacgacgacgctgctgcccatcaaagcacagcggtcctggagaaaagcagctgtgcagctgtttggattgcaagctgaactggccacctttttggtagcacattatttacacgtgacctacagacaaaccacggtcgttcaggcttgagtacgggcagaccattcctgggaatatgaatgagtctgtcgcttcaaggaaaataactgacagtatttgccgccaatgataaaaaattccagttttcaagtagagttttggaaaacttacatcagccactgtgatgaactcaacatcttcagactattagactttactgacgtcaacatgtggaagagctgcatcattcaagagaccaatattttccaaatgactagtgcatgacgttataaaatcacacctgggtaaaaacccaacagcatttaatataatagtgtacaaaaaaagataataaaatttcagattccatattgcaactaacatttaagaaactaccactcaaaataaaaaatcagcggggtgtggtggtgcatgcctgtagtcccagctacttggtaggccaaggcagaaggatcacttgagcccaggaggtcaaggctggagtgagctatggtagcaccactgcactccagcctgggtgacagagtaggaccccatctcagaaaaagaaaaagaaactactactcacttgttgaatgtttctacagaatcaaagaaaaatatccagaatcacataaaaaggctatgaaaatgctcttccaactaaagccagattttctacacatttttcaacatattgcaacaaattgaatgccaaagcggttaagaaaattcagcgaacacacttaaaagtgttttaacacggtagatttctgttgtgtacattttatcactcaaaaaacctcagccgtgggtcgggcgcagtggctaacatgctgaaaccctgtttctactaaaaatacaaaaaattagccgggtgtggtggtgcgtgcctgtaatcccagctactcgagaggctgaggcaggagaatcgcttgaacccaggaggcagaggttgcagtaagccgagatcgtgccactgcactccaatgtgggcaacaagagggaaaaaaatccaccaaaaaaaaaacaaaaaacttcaaccgtttattaatccagacattaaagagatttgcaaaaatgtatggcagtgccacccttctcatcaaattttttcattttacaaaatatagttacttttataaaaatgttacttacattaacatgcaatgggtgaaatgaattactattttgaaataaatttagaaaagatttttaagcttctcagtttgtttcaatttctaatactgtaaatatcaatagacaacctatataaataatgcacataagcctgggaaacatagggagacgtcatctctacaaataatttttaaaattaggccgggcatggtggctcacacctataatcccagcactttgagaggctgaggcgggcagatcacttgaggccaagattttgacaccagcctggccaacatggtcaaacaccatttctactaaaaatacaaaaaaaaaaaaattggccgggcatggtggcatgcatctgtaatcccagccacacgggagactgagacacgagaattccttgcacccaggaggcagaggttgcagtaagttaagatcacaccactgctctccagcctgggcaagagtgagactccgtctcaaaaaaaaaaaaaaaaaaaaattagttggatgtggtggcatgcgcctgtgtcctagctactgaagaggctgacatggaaggatcatctgagtgcaggaggtcgaggctgcagtgaactgtgactgcacactgtactccagcctgggcaacagaggaagaccctgtctcaaaaagaaaagaaaaaaaacctacagaaacaacaatttctactggattagaggaaggcatataagctaggtgcagctatccctgactgtcggggcccagcatttcaccctgtttcccagcttctgccctctaggtcacactactgccaccactactgctacaactcattctgcctccactgccaccagcagcctctagcgggtttgatgttcccacctatcccagaacattgagccttcccacttaactccgcagaaaggatgccaggaattttttacaagtgcaatgctagcaaaggctggggaaaatgagacaaaaaacctgatttccaagagcagacaagttttacaaggggcagtcttcttcgctgaagttgactaaaatttagccacgggttggcttggctggtgtggttcactgggtacatccacaagactacaagaatatcactgctgtctgcagtcttcccaggggaggaccaccctacccttggcccacaccacggatggcggccccacatccaccctctgatgcagcccagtcccttcccttctgttccgcggcagcaccggtgcctggccacttcccttgccagttcccttcctgtttcaaaaactctcatctcttcacaaaattccctccagggatgctagttcctgttggaaaaggtcttgaggtgtgtcacaggcaaagtacaaatgatatgcccagggccagatggatgacaggcccctaagctcagctagtccagagtcaggaggggacctgcagaattctaatggtgaatgattacactcttacagttttggaattccagcaaaaacaccaatactaaaatcaccaaccaagacaaagacgagacttacggcccacgcaggcttctgcacactctgtgcccagacatggacagattaatgtgggttggttggttggtttttttccaagattactattccacagcaaagtacataggcaacgctgaccaatatgcagaaacataattactatctcaccaagctggccagaagacaaaaatcttgaaacttcttgacttgctctaattgttccttctccatgtttcccttccttaggcattctacctgaaaagacagccctcccttccttcttcatcccattggcaattcagcaaaccttaaccttctcttgctttaccagaggttacttctactcgaaagcttgtcttcagaattaacagctgtgtccttgtcactgtaagccaggtctcaaagagcctgaacaaatggtcactgggggcagcttgagtgtcgactctactgctgttttctgtctcccaccccagctgtggaggggaactgtgtgcctcatctcatctctgccatttgctatctgagaggctgtatttccacgtgcataacagatcctgctcaagaatgcaggtcaaggctgggcgtggtggctcacgcctgtaatcccagccctttgggaggctgaggctggtggatcacctgaggtcaggagttcaagaccggcctggcctacatggtgaaaccccatctctactaaaaatacaaaaattagccgggcgtggtggcgcacacctgtaatcccagctatttgggaggctgaggcaggagaaccgcttgaacctgggaggcagaggttgcagtaagctgagatcacgccatggcattccagcctgggtgacacagccagactctgtctcaaaaaaaaaaaaaaaaaaaaaaaaaaaagaatgcagtgcaggtcaacacagaatttccaagcaaggagactgagctctgctaacgggttagcatcccagtggcaagggttgcaggcttaggtggggacaagctaacgggggaaggaaggggaacacctgagcatgcaactgaaccccaaaccaacacctggctagggttctgtcagctggcaggcccgtgctcagggttaatggggcgcccagatttccggcatgagacaggtgtttgtttgcagaggctaacgcatacagaatgcctccgtccactgtcggtctgtcggcccaccagacagggtctacataggaactcctctaaggcaaaggtctcgatcacagaggtggccaacaggtgacaatctgcccaaatgcataccagcgggtctcctccccaagttgctccacaagcataaagtttggctggggaaaaaagcttttttaatttctgcatctgacaatgtgatcactccctggtattcccctcttcagagatatgaccatgggtgtggatgagagcggaggagcatcttcattctgtcttcctaatatttacacgggaaaagaagatgcctgtagatattttctaacagtttcattttctgtctttgtgaccctgtatctatgacaggaaaagccaacagctcgagataacacgtctcaccattttttgcttgtggcccaaggcagaatacaacagccacggttccctcaggcctagcggtttcatcccaaatgctgtggaaggtccctcaccttaatcagaccgtttcttcattttttttttttttttttttttttttttttggcgacaaagtctcgccctatcgcccaggctggagtgcaatggcacgatctcggctcactgcaaactccacctcctgggttcgaacgattctcctgcctcagcttcccaagtggctgggactaaaggcgcctgcgaccacacccagccaatttttgcattttcagtagagacagggtttcaccatgttggtcaggctggtctcaaactcctgacctcctgatctgcccacctcggtctcccaaagtgctgggattacaggcatgagccaccacgcccggcccatttctccatatctttaataactgtccctcacacttttttttttttttttgagacagggtctcattcttgtcgcccaggctggagtgcaatggtgcaatcttggctcactgcaacctccgtctcccaggttcaagcaattctcctgcctcagcatcccgagtagctgggattacaggtacctgccaccacacctggttaatttttgtatttttagtaaatatggggtttcaccacgttggccaggctggtctcaaactcctgacctcaggtgatccgcctacctcggcctcccaaagtgttgagattacaggcatgagccaccatgcctggcccctcactttttagattatttccaaaatcctagcagtatgctaaaaattcctgcaaccttctcccagtgactggccaccctagataagatttctcacactcgtacaccccatctgctgtatccccttcctgctttatgtttgttcacaaaacactttttctattttacttatttatggtttgactcccctgttgtcccctctattagatctcccctatttgaaggcctggtttttgtttcttagagacagggtctcactctgtcgcccaggctggaatgcagtggtgcaatcacggctctctgcaacctcgacctcgtgggctccagcgatcctcctatattattgacttaaaaattcttgtcccctattacaagagcaggaattgttgtctgttttgtttacggctgtattgccagaacccagaaccgtgcctggcacggagtaaatgatttgctgaatgagtaagcaagccaggggttccgggcctctgtactctgcaagtccatcctgcattctccattcataccatagcaacttcaaaggcccctcacccattcctgactccacattgtcgccaagtcacttccagaaacttaaaatgccatttcccattcacatggtcaagcccttcccctcctgccagtcgtttgtttaaatctggcttgcagtcccatcaagctgctcttcctaatgccactcagatcccatcacctccatcactgctactgtaactttggattgggccaccatcacccctacctgggatttactcgacacctcattaatctctttccaacccacactcactagctctgaaagagtgaactttctaaaactgcaagtcagatcacctaagccccctgttgagtggttccctgacacctatggggtcaaatgcaaactccttcccacgctacccatggccttccttgtcctgatgaacaactaacaatcgtccgcccccacagagaagcacagggcccagccatacccacctctccgctctgccctggtgctcttctgtccacctggagagccacagcctgatctcaggacccagctccagcaggagccccctctaaagcgctccccactcccgaacatactccacaacatttttaactgtgagctcacggaggttgggaactattaacgcaggtcagacgcgccccaaagtggggccgagcccaagagggttcttggctttgcccaggaaataattcaagggtgagccggtggcaggaaagaaaacacctttattgaagaggcaggcagtgttatacggctccatgactgctcctgcagagctgggctttcccaaaggcggaaagtagcagctcagggcagttttgcaatcatacttatacctacttttttttttttttttttttttttttgagacgcagtctcgcctaggctgtcgcccaggctggagtgcagtggacatgatcacagctcactgcaacctccacctcctgggttcaagcgattcttctgcctcagcctcccgagcacctgggattacaggcgcacaccaccacaccaggctaatttttgtatttttagtagagacggggtttcactatattggccacactggtctccaactcatgaccacaggtgatccacccgccttggcctcccaaagtgctgggattacaggcatgagccactgcgcccagccttaccttatacctacttttaatttcctgtagagtaaaggtaggcttaggcagacacttctaggaaaagggtggtggcttttgggttgtcaggtcacggccatggaaagaggcagtaactccgggtgtggccatggcgacagtaaactaacaaggcacactggtgggcgtgccttgcagaacgctgcttctgccccatccctgtatcagctagtcctcaattcggtctggcatctgaaccccgcctctggagtcgagtcccacctcctacctcacgatcacggatcctgctccacgatcacggatcctgctccacatccacagtgccaggtgcacagtcagtgccaggggcacgacacagatttcagagtgaaggaatgtgcagaaatcatgaaactacccttctgcaaagcctgttcggataaatttgaatgagaggagcttccttctgtgctcccaggctagttctagaagccccttctcattctatggatgcccattcctgcagggccgctactggctgctttttaaccctgggatcagaaaagggggtaagagggaaaggctaatacacccagtattggggttttttttgtttttgttgttgttgttttttaagacagagttgctctgtcgcccaggctggtgtgcagtggcgcagcctcggctcactacaaccttctcttcccgggttcaaacaattctcctgcctcagcctcccgtaatacccaatattgtatagagaaaacatctgccaccagcccaaaggcagaggctaaaatcgatcttacatgtagataagcttaactatgtgtgtgaaagggtcttctacaaactgtgctgtcatctcaatttagctttgtaaggacagtttccaaaagggccaggaagttgtgtagacatactctattcctggagtcctatccacaaaggtttgtaaaatgagctcaagaaaacaaaatcgtggtctcagagaaagagctaaaggaaagaatatcacttttaaaaaatcagcagctaagctaagccttctatcttccctactccctacagtactaaaacttttataaatatacaatgtacacaaatgtcaagaaaagttaatttaccaaatttacactatttgaggtttaaaaaaaaaaaaacacaaactcactctagcattttttttttttggctctgtgtctgagacccctgatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctctgggccaacatatttaatttaacgtactgccgcccagctccaccgtcccacagtctccaaggacagagctcacaacacctgggccctaaaaatgccaaggtggcaagcagggggttacacccacagccccgtccactgacaccttcagactcaagagcgagtgccaccgccctaaacggaaagacactcatcacggcagcatctttcaagtgaacagaaagtgtagtttctgaccttgttaacatagtccttaaagtgctctaggttaggggaattctcgggtgaaaatagttttcgtctacatccataaaatcttcaacagcaaagttagtaaaataaagaaaaatcagaagaaagatgatgttcccttgccagagaacaaatacataaaagatacaggagctcagatcacaagccagagaaagagaatgccaactggacacataggatgatctcacaccaacgacctatgcaggccctacctcaaccactggacgtctctgactgacactattacttctgccgtctctgattgaaactattacttctgccatctctgattggaactattaattacttcttccgaggattccctttcctgaggcttttaactgtttaagtatgcagtgtgtggggaccacaaaatacaatacagcttcacaaaagcaggcttttaaaaaaaatcagtgttattttctctacatacttccacaacagatgttcccctcaatcctgaagattttagtaaaacataaggactgtttaaaaaggaggaagtgggggaagaaatgtagcagattacttaaaatctttctttttcgtcctacttattttaatatcattttccagatctcaaagacttttgtcctatattagaaaaaacaagcagcccagtaaaaacatcaagaatagcagtaaggagcttcaaaccagggaccaggcaccagatccaaacctgagaggatgagggaggggaataccagctctccggcaggtacgtttctcccttccaaatcacctggtggctggagaagctcaatatgaagctcttcacttaaggcaaatactatgataataaaatatccttaaacaaatgatggctgaaagctgaaaatgcaaactttttttaaaaaaaaaaaaagacctagataaaagacagtgtgtactcagaggtaagtaactccgtctaattctccagagacctgcaggactgcgccgacttcctatccctattttgaggataagcaaagtgaggcctagagaggagaaagattttattctccacgttttcgcaaaaagggcagagagaaacatttggatgggacttcagggtgaccaaatgaatgcaaaggcaatttccttaagtgctaaacagtgctgaatgctgaagggctccatacccttacattcaccggacgtgcccccacatttcagccaaccagtggttatgcacgttcaaagttctccttccttctaaaggtcgcgtctaggtcatctctgcacagcgtccctttctgcagtgtgaacagatctgtgatatttgacccgctgaaagaaaagtcacactgaccctgagatccccccatggtaaggcattctgagatacctgagctgtctgcagacactgaggctggaagcttttttttttaatttaatacaatcaggatcagggaggggggatgccgaggtaaagcagtgcacatacctttcaactggtcagcaaccacgctctggcccagccgttcaataactttcccatcttccatttcgtaccggtcatctaagtattttgcggtggcctcagaaatgtgaactttgccggccactcccagctgctccatgagattggccaggttcacatcgttggaccacacgtcaaatttaaacctcctcatgcccaggatgccgcaaaggacggtgcccgtgtgcaccccgactctcatgttcaccatctccttcttctcctggcagaactgctcgatggccttgatcatgcccaggcccatctcgatgcagcagtaggcatggtcggcccggggctcgggacagcccgccacgcagtagtaacagtctcccagggtgctgattttctcacacttggtctcctcacacaggcggtcgaagcgaccgaacagatcgttcaggagacccaccagggcgtgggcagacttgttggcactcatcttggtgaagcccacgatatctgcaaataaaatactgacttcttcgatctgctgcatcttaaaagggcggaaggctataggagctttttggatggaagactttttcttcctgttcttggggctcgaggtggcatgcctcttgacagaattctcactctcctcatctccctgcttcattaagtcatcggctatgattcttggcatcacggaatgaatcatcctctctttgagggctttttccacttccaggtccttcccgtgcataatggattgccccaccttgaggaaggtgctcctggacctcacctgggacatgacgaacaggtggaccccgatggcgtggatgcagccgtggagcagccccctgctcagcagctcccagtgcagggccccggctccgggcgaggggaagcaggcttcatcccggaaatggtagccaaaggtctcgaaaaggacagagtaggccacccccagacacaaactcaggtacaaaggtaagtgcatgacggtatagagcaaaaagagcacttcgatgcacatggagaagctccccacttgagataagcaagtatctgtgggccgggctgtggccgtaaggttggagctgtcgccgcgtcctgagacaggcgtcaagacctggaactgcgcagccagggtcagggcgaacaccagcagggtgagagccagcgaggtccacgcgtaatgccgggcgtacagcttggtgaaggtaaacagaaagaagcccacacacaccaggaggaagcacagcgcgggggcgaccatgacgatcagtctggatctcatgtggaccgcaaaatagatgctccacagaaggcaggcgaagccgatgtagaagagcgcataccggaaccggcgctgggtctgcgggaagcagcgctccaggcaggcctcctccaggttcaccgagtcgaacttggggtcccaccagcggctggaggccctctcgaacagctggggcagcttcttctgcctgcgcagccggcctccgccgcccactcgccgggggacgcccccggagtccccagagctgctgcagctagaggagatgctgtatttgcagtgcttggggtggctgttggaggacagctgcttggggttgatcttgacgcgcacgctgttgctgtccccgctggagtcgcagctcacctcggtgctgtggtgatgcagcagctgctggtggggtggggaagccatgttgtcgagtcccggggcctgccccggccggggtcaccagtacctgccagcaaaacggggagagttagcggcgctcccacctaggcatgcacgcctagaggcccgggacctgctcctgtcctaaggggcggctccagcacgcgacctggacaggcaccatctgttcctgtggttcccggctcagcggtgctcccaccgcccccaccgcccccaccttcgaggcgcacgagaaccgctcgggacggacctagaacgcccgggggtccccgccgcgtggccgccgtggctccgggaccgctttgctcgctcgccttccgcgcctctcgccccgagggtggcctccgcgccgcgcggcttctcctcctcgcgcgctcgcctcctccagctgcggctccggagggaagttcagaccttgagcgctcccagccccgcgagccgcctgcgcacaaacaactccgctggcggcgcggagccctccatcctgcaggagccgcgctccgatgcgtcaaaggcggcgcgcggccggccccgggcccggaccccgacccggagcagcgagcttcggcgggcgcccccggctcgcgctccccggccgccccccgcgctccgggccggccctgcccgcggcggcgggcgctgggggtgggggcgccccgggctgcgagtgcgcggagcccgtcggcgcggcccgtctagtggggcctgcttccccccgagtgcgccgccgctcccgccgcggccgcagctgtcccgggaccgagcgcgtggaaccacggacgcgggcccctcgccgggcggcggtgcagacgctgccgcagagccgggctcccgcgacgccggccgggacgcccgcccgcccgcgcccacgccgggggccgcctccccgagctagagatgcggccgccgccgcgcccgccgccgtgtcccccgcggccgctgcctcatgtcggaagagctgccgccgccaccatctccggcccctgccccgcccgctgtcactgacagacgcgcgcccgcgccgcccctcgcccagccgcagcgcgcacgcgcggcccgcgctcgccgccaccgcctcctggccccggacacgcgcacgggccgcgcgccgccccgccttggtgcgcgcgctgggctggggctgcggggcggggcggggcggggcggggcgcgcgctcggctccgccccccgccccgggcggcgccgcttctaggcggcgggctgtggccgctgtccgcgctccgggcgctgtgggcccgccctccctcggcgtcccagaggccgcgcgccgcccggggtcccgaccctgcggagagacctgaaggcgcctgccgtggaagaagccgctggccgcaacgtttgggaaatcaaaatgttgccttcccactcggcacgcctttgggataaatcgaagtttccaaccgttggatttccctcccgggaggctccccttgctctgtaagcaatgaatgcgggccccggggcactcggcctgccctggacctgctcacggggcgaccttcacgggcctagcctccaaagctgggcccaccgacgaccacgttcccccgccccaggggtagtttaccttgctgtccttgagcccttctccccctcctcatgaactactgcttttccttttacacaaatgagactttcaaaggagtccgcgtcccataatggcagttgtgcattggcctccataaacattgccacgtgtaaataaaatcctattctctctagcatgcagatcccgaccccttctccccacactccacagtgcctcctgccagtcacggggctctcttccatcccctccctcgcctcccaggcccagcgccggggcccacaccaggtctcactgttgaattagaaaataaaagtaaaatgtgatctgtccatgcaatggaatattattcggctacaaaaaggaatggagcaccgatgcatgctgcagtgtggaggaacccgggaaacgttatgctagtgaaagaagccaaacaaaaaaggccacatagcgtatgattccatccagatgaaatgtctcgaattggcaaatccgtagaggcgacacagattggaggttgccaggtgctaggggaggaagataagcagcttggggtttcgttttaggatgatgaaaaagtctagaaatgatccaacaggatgaatctacatactgcccttgaatcatacactttaaagtggtttaggccgggagcggtggctcacgcctgtaatcccagcactttgggaggccgaggtgggcggatcacctgaggtcgggagttcgagaccagcctgaccaacacggagaaaccccatctctactaaaaatacaaaaattagccggacgtggtggcacatgcctgtaatcccagctactcgagaggccgaggcaggagaattgcttgaacccgggaggcggaggttgtggtgagctgagttcgcaccattacactccagcctgggcaacaagagtgaaactccatctcaaaaaataataataaaataaaataaagtggtttaaatggtaaatgttatgttgagtgtattttaccacaataaaggaggaaaaaactaaaagcaacatattgtggtggtattcctgcagaagtgtgtaatctcaatccaatcgcaagaaaacaccagacaaacccagattgagacctgttctacaaagtgattaaccagtacccatcaaaagtgtccttggacactttgggtcttgaaagacaaagactgagaaactgtcacaatctaggaatcgtccctaaggggatagatacaacaactaaatggaacatgggatgctggttgggaacatggaacaggaaaggacagtagcaggagagcgggcaaaattcacataagatctgcaatttcctggttctgatcctcttactatggttaggtaagacgttaacatttttaggggaagctgggccctgtgcagtggctcacacctgtaatcccagcactttgggaggctgaggcagacagaccacctgaggttaggagttcaagaccagcctggccagcatggtgaaacccccgtctctactaaaaatacagaaattagttgggcatggtggtgtgcgcctgtaatcccagctactcaggaggctgaggcacaagaatcacttgaatccaggagacggagtttgcagtgaaccgagatcatgccactgcactccagcctgggcaacagagcaggactccatcttgggggaaaaaaaattaggggaagctggatgtaggatacagggaaactcgctagtatttctgcaactcttcaagtctaaaactatttcaaaataagtttatctaaaaatttaaaaaataaacctttaatgaacatcaattctatgccaggcactctcacatacgaggttcagaaacgcatggtgtgtcacatgcattcgcttagtaaatgggataacaatagtgaactaacattgaccgaacacgtcataaatgccagaaactactggacattttcacctgtgacacatttggtcattgccacaaccctctgaggtagatactattgtcccttgtttagagaggtgaaacccaggattgaagagaaacgcaccctaggtctcccactaagggtgatgagttcagatggaaaaccaggtctcagaattctgaggccatgacgccttgtgtgaccctggcactaccctctgcaagcctcacgatggcccagcacagactgtacctgtctcatccatcagcccaactggatgggaggccctcagagccaggactcacagcttccgtcttcccttgctggctgcaacgctgtgctccctgcttcctggtttcctgaaacgatctgaaagcttgcctgtctgcacttctttcctcctccctaaatcatttgtggtaacttatgtgtttgtaagttagtcacgtcggatttttagacacaagtaatggtcatactcacctccctacttctctggaagcaattcggccacattgcctgctgtggaaacctataagctgacaagcctccccagtctccaggtcagggagtgaatcatgccatcaaccccgggggactggggctgtggtgccagcactgtgtgtcaggccctggaggtacaaggatatgccatccatatcttttcttttcttttctttttttttttttttgagacggagtctcgctttgtcacccagactagagtgcaatggtgcgatctcggatcactgcaacctttgcctcccggggttcaagcaattctcctacctcagcctccagtggagctgggattaccaccatgcccagctgatttttgtatttttagtagagacagggtttcaccatattggccaggctggtctcgaactcctgacctcatgattcacatgccttggcctcccaaaagtgctgggattacaggcgtgagccaccgtgcccagccgccatctgtttctttaaggggcttaggaacgatgtccaggggaggggttgggttaagaagatgggatcaattaggctttctgaaggattggatgtgaaggagagttctataaaggaggttaaccatcttctcataatgccaagacccaaagggaagtcactggagggttctgggttcttcttgacctcccagaagcataaaggtacccgattcacagaagatacggggcagatgcaatagctttcttcaaacatccaatccagggtgctgccaaatccacagagagtttcttttttccatctgtgatgtgtacagaactcccacctggacacagtgggaatcagaatgtgtccatgaaaactctgcaaaagcttgcagaatgccttgcctgcctcagtgtctcctcctcaccctccctcacatgcaaattcacatgatgggtgaggaccttggctccaggatatcagaggtcagactgggtggcaaccatgacaggctttgagataagttgcataatgattgagttgtagccattctcatcacaccggcccctgaggactcggcagtgcctacgtgatttcatttgtcaggtggaccacaatcttggagaaccatctgctggaagatgggattccctgctatggcctgatcatgcgtccaaaactgcagttacaagctttgagtctttttctctttcaactgatgagggtgagtttgtaggaacgtacctgcttttttttttttttttttttttttttttttgagatggagtctcactctgtcacccaggctagagtgtagtagcatgatctcagctcactgcaacttccatttcccaggttcaggcaattgtcctgcctcagcctcccaagtagctgagactatgagcatatgccaccacacccagctaatttttgtatttttagtagaggcagggtttcaccatgttggccaggctggtcttgaactcctgacctcaagtgatcctcctgcctcggcctcccaaagtgctgggattatagatgtgagccacacgcttggcctttacccacattttttctctaccattgactgctgttcacaagcctccagcagctaccttcacattgacaggaagatcaggcgtctcagcaaagcaaaagatcctttggagaagatcaccaaaatacctgcaggtgcctccataaccaggtgtattccatctagccacatccatagattctacatccagccatgcccagtttagaggccaatacaaattcattgaatgactgcatatgggagttatattaatatatttttatttttttttaatgggttcaaccaggaggcggagcttgcaatgagccgagatctcgccactgcactccagcctgggcgacagagactccacctcaaaaaaaaaaaaaaaaaaaggtttcaagaaattctcctgcctcagtctccaagtagctgggaatataggcatgcgcccacacacccagctaatttttgtatttttagtagagacaaggtttcaccatgttggccaggctggtctcaaactcctgacttcaagtgatccacctgtctccgcctcccaaagtgctgggattacaggtgtgagcacccagctggcaatcacattttaaggcaaggaggtgccgattggtggccccaacaagatgagcttggttgaaagagcagatgggagattcgaagtaaagcatggtgtctgtcactcagctttgtcacctggcacagctcctgctggagcttccatcccatctgtgtggaataatggtgaggagcccaggattgggtgtaggaaaaactctgcaggagctgtgaagtgggttgaacggagtcccctcaaaattcaggtccaccaggatcctcagaatgtggccttatttggaaatgggcttttgcacacataattagttaagaaacagttgtactggaccacgatggcctaaatctgatgactggcatcattttaagaagaggaaccgggcacagtggctcatgcctataaccccaaggctttgggaggccaagacaggaggatcacttgagcccaagagttggagaccaacccagacaacagagtgagccctgcgcttttttttttttttaatttgagatgaggccttgctctgttgcccaggctggagcgcagtggcgtgatcttggctcacggcaacgtcctcctcccaggctcaagtgatccctccacctcagcctcctgagcagctgggaccacaggcaggcaccaccatgcctggctaatttttgtatttttagagagatggcgttttgccatgtcacctaggctggtctcaaactcctggattaaagcaatccacctgccttggcctcccagagtgctggaattacaggtatgagccactgcacccagcccaaaaatgttttttaaaaattagctaggtgtggtggcacgcacctgtggtcctagctactgagaaggtccaggtgggaagatcgcttaaccccaggagttcaaggctgcagtgagttgtgattccgccactgtattccagcctgggcaccctgtctcaaaataaaaaattaaagttaaggccagcgcggtggctcacgcctgtaatcccggcactttaggaggccagggcggctggatcacgaggtcaggagatcgagaccatcctggctaacacggtgaaacccatctctactaaaaatacaaaaaaattagcagagcatggtggcaggcgcctgtagtcccagctacttaagaggctgaggcaggagaatggtgtgaacccgggaagtggtgattgcagtgagctgagatcccgccactgcactccagcctggggaacagagtgagactccgtctcaaaaaaaaaaaaaaaaattaaagttaaaaaaagaaaaagaagaggaaaagacacagagacatgcaggggaggagaagacagataagacaagacagaagacatataaagacagaggcagagataagagtgatgcagccaccagccacggaaccccaagcggtcctgggagactccagaggctgacagaggcaaggcaggatcctgccctagaaccttcaaaagaagcgtggctccacggacactttgatttcacacttctggcctctagaaccatgagaaagcgaaataagagagatggggccaggcacagtggctcacgcctgtaatcccagcactttgggaggccgaggcgggtggatcatctcaagtcaagagtctgagagcagcctggccaacatggagaaaccccatctctactaaaaagataaaaattagccaggcgtggtggtcggcacccgtaatctcagctactagggaggctgaggcaggagaatcacttgagcccgggaggcggagattgcaatgaactgagattgcactactgcactccagcctgggcaacagagcaagactctggctcaaaaaaaaaaaaaaagggagtaatggaattttcttgtctctacaagaaaatgagaagaacagcccaagaaacccagcatccaaataataaagggtttcagaaagaagagagaacacagaagggagaaactgctgagcaaccattcaagaaacgttttcctaaatgaagaatgtgattgaaaaggaccagcaagtggccaacacgatgactggaaacagacccacaccaagacacagcgcagcgcaacttcagaactacagagagctacagggagaagctccggcaagaaaaagcaggtttcaaacagagtgtggagaatgaggatgacacctagatgcaaccatctggggatggggaaggggcgcagacaggcatgtaaatctcccagggtgattctcgtaatcacgtgttgtttagaataatcaggccaggtcattttgtcggggatcccacccccgtgtcaccatctgctggtatttttccttggattaattagtcaggttttccagagaagacccttcaggcttgctgccactcagctgagaggggcagaaggctggaagtctcagccttcagtatcaaaaccttcgctcagcaaaccatccgtagggatagtttcaatcctattggcgtgctgccaacccttaccctgaagtcctatggcagtcacttgcagatggggctggatctaccatgatgaacctgaacttcctcggaagcatgcttctgtagccagcatgggagaaacttgcaggcttgttaggaagatgcgtgtttattttagccacggggtagtaccaaaataccattaacattactcaaaaataagtttgccggctgtgggcggtggctcatgcctgtaatctcagcactttgggaggccgaggagggcagatcgcctgaggtcgttagttcaagaccaacctggccaacatgatgaaacccccatgtctcctaaaaataactaaaaatacaaaaattaggggggcgtggtggtgcacacctgtaatcccagctactcaggaggctgaggcaggataattacttgaacctaggaggcgaaggctgcagtgagccgagatcacacctctgcactccagccttggtgacaaagggagaccccatctcaaaaacacataaaataagtttgtgagccagacaaatatgatcgcaatgccaatagataataattttttttcaaacagaaaaactccaggagaagccaggcatggtggctcatgcctgtaatcccaacactttgggaggccgaggcaggaggattgcttgatcccaggaattccagaccagcctgggcaacatgatgagatcctgtctctacaaaaaatttaaaaatcacctggtcatggtggcatatgcctgcagtctcagctgctcaggaggctgaggtaggaggatcgcttgagcccgggaggtagaggctacagtgagctgtgattgcatcactgcactccagcctgggtgacagagcgagaccttgtctcaaagaatacaaataaaatcaataactaataaaagtcttattgctctcggtagccataagcttacggttttctaggaatcatgttttcatttggaacagcacccacgtactctcagacacagccatgagcagctatccaggaggaggagacagtggatccgcattctgtattctctctgggtccctccccatcttggggtggtgaggcatggctcttctttggcaatttatagtgttgctgagagacacacacactgctggaataaatcactgggcgtctatgctgtgaattgagccccgaggagcgtgtggttaatggaccttacttcaacactctggtctgtctgagagaagcgttctctcttcccagcatgtagtgggttccagggaggaggtgagcaggggcaggaggtggaagctggatggcttcccagcttctccagggccaggtcttcattagtgtggcttcattattgcatgtgcagtgctttcccagaatatctgacacatccatgctcaaatgtaagtacagaaacgaatccgtaaggcaggtaggagttactaccaactttctgcaagggcaccatttgacccctttgcccttcgtaacctagggcacacatcgtctcatttggagggaacctgaaggccatcacagctggaaatgaaaccgagagtatctcacagtagccccaaatccaagcctcgttctaaatctccaaaggcctaggggatttggggccttgacgggaaaaatcaatccccctgcatcataccaccacgcccaggcactggctgcttcactgtagctcgctctggctcagttcatgggagccgtggaaggagaggtgtgggtctctgggttcccactgtgttgagacaatctattcttactccaaagagctattcaggccaaaaagagttgactagggcttgcaaggtctataacctttttctagtcaacctaatgcttttttttctgagacggagtcctactctgtcacccaggctggagtgcagtggtgtgatctcggcttgctgcaacctctgcctcccaggttcaagtgattctcctacctcagcctcccgagtagctgggattacaggtgtgcgccaccacgtctggctaatttttgtatttttagtagagatggggtttcatctctctcaaactcctgacctcaagtgatctgcccgcatcggccccccagagtgctgggattacaggcatgagccacaacgcccggccaacctaatgctttttgggccttaattccctgataaaaactggaactctacttttaggctatgtctacagtactttagagactatcaaaatagctttgtattgatgtcgaaaaaag

SEQ ID NO: 406 - DNA, 65124 bp, Homo sapiens
gattttggttgtcactcacttctggcttttctacaaaggacttgtgataatggctccaaatatctgtgacggtatgaggtaagtctcacaaagagtccaatttcaaaactgatcagagaaataaatgaatgcctaggacaagctttacaccatgtaggagagttggatgttctgagtctcgtctcagtgcagaccagcagtgacttttatctccgttccctcatcatttagcatagcatgaaatacagagaagatcagtaaacatctgctaagtaaataacccaggagagaaaactgaaaactttatacacaggaagatgttacataaaacaaaaagaaacagtaccactgtgggttcttgactgctagcaggcatgttacgaagggggatgtcacatccaagaaagtgttgtctatttaaaatggaatactccaaggcttggacatcaatgctgaaaggtgagaaaaatgcccagaatcctataaaaagttcataaaatctcgctgtagcttcatcctttctctatttcctgattccatcatgccctctcttcactgtcaagcttcttggaaggttcattcctgcagccacccctgcctccttgtcagttccctaccatgccactcatctcctgattccagtgctctttcccttatcaggagactttcacatctaattcctggttaccctggtcttgaatataaatgcaaatctttaaaagccatcaaaacctgtgtatatcttttctagccatttaaactaaaaaccaagcattctcaccaagaaaaaaatcaacaacaaagtaaataccttgaagctctccaaaggaggcccatctctcttccaattataatggctagtgtgacatctgcgtaaggttcttcagtagatgaagccgatcagctgcctcttaaaagctcgatgaacccccaccccaaatccccagttattttcgtaagttctctgtattctgtcttgacactgtctctcatcctaatttcactggtgtgggtttttgtgtgtgtgttaaccctagcctagtccactgttatccctatttctaacatctccacaccctaatgcaccttacacatcacgcctctcctcattcataagcctcagccattcctcaagaaccaaattaagttcaaacctctctacaaacttctgagctccacattcatgataatccatctttctagctctttctaccactccctcttatagcaaatatatggccttttatgccagagaacctggactcttgtctctgcctcttacaagtcatgtaaccttgggtaacttgcttaatttctgtaccttaccttcctcatctgtaaaatctgtaacttttatatacagatttgctataatgattaattaggttaatagatatgaagggcttaataagatgcctgatgtatatagcaagcatccagtaaataataactcattattaattatgtactccagaaaaattcagtaacaatctgttcccacacaaatgacacttcgttgccatggtacttttacatggctgtttccttgttcctagttcaaataatgctatttattcttcaggacccatttcaaacaacatttcctccaagatagagttcacatatgaactaaaagtcagtcttacatcggagcaatttgtttgcatttgtgggaattcttttttttcttcttcttctttaaaaaaagaacaggttcattgaaatatattccacatgccataaaagtcactcattttatgtgtacaaaccaatgatttttagtaaatttatagagttgtacagccatcatatacgtatgtacataaataaatagttattttcttacgccctatttaacttactctcccagttctaaaatctacttacctgattttatttttttatactttaagttttagggtacatgtgcacaatgtgcaggttagttacatatgtatacatgtgccatgctggtgtgctgcacccattaactcatcatttagcattaggtatatctcctaaagctatcccttcccccttcccccaccccacaacagtccccagagtgtgatgttcccctcctgtgtccatgtgttctcattgttcaattcccacctatgagtgagaatatgcggtgtttggttttttgtttttgcgatagtttactgagaatgatgatttccagtttcatccatgtccctacaaaggacacgaactcatcattttttatggctgcatagtattccgtggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaataagatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttattttgagaagtgtctgttcatgtccttcacccactttttgatggggtttttttttcttataaatttgtttgagttcatcgtagattctggatattagccctttgtcagatgagtaggttgcgaaaattttctcccattttgtaggttgcctgttcattctgttggtagtttcttttgctgtgcagaagctcttcagtttaattagatcccatttgtcaattttggcttttgttgccattgctttattgcttttggtgttttagacgtgaagtccttgcccatgcctatgtcctgaatggtaatgcctaggtattcttctagggtttttatggttttacgtctaacgtttaagtctttaatccatctggaattgatttttgtataaggtgtaaggaagggatccagtttcagctttctacatatggctagccagttttcctggcacgatttattaaatagggaatcctttccccattgcttgtttttctcaggtttgtcaaagatcagagagttgtagatatgcgacattatttctgagggctctgttctgttccattgatctatatctctgtttagtaccagtaccatgctgttttggttactgtagccttgtagtatagtttgaagtcaggtagcatgatgcctccagctttgttcttttggcttagaattgacttggtgatgtgggctcctttttggttccatatgaactttaaagtagttttttccaattctgtgaagaaagtcattggtagcttgatggggatggcattgagtctataaattcccttgggcagtatggccattttcacgatattgattcttcctacccttgagcatggaatgttcttccatttgtttgtatcctcttttatttcattcagcagtggtttgtagttctccttgaagaggtccttcacatcccttgtaagttggattcctaggtattttattgtctttgaagcaactgtgaatgggagttcactcatgatttggctctctgtttgtctgttcttggtgtataagaatgcttgtgatttttgtacattgattttgtatcctgagacttgctgaagttgcttatcagcttaaggagattttgggctgagacaatggggttttctagatatacagtcatgtcatctgcaaacagggacaatttgacttcctcttttcctaattgaataccctttatttccttctcctgcctaattgccctggccagaacttccaacactatgttgaataggagtggtgagagagggcatccgtcttgtgccacttttcaaaggggatgcttccagtttttgcccattcagtatgatattggctgtgggtttgtcatagatagctcttattattttgagatacgtcccatcaatacctaatttattgacagtttttagcatgaagggttgttgaattttgtcgaaggccttttctgcatctattgagataatcatgtggtttttgtctttggttctgtttatatgctggactacattttttgatttgtgtatattgaatcagccttgcatcccagggatgaagcccacttgatcatggtggataagctttttgatgtgctgctggattcggtttgccagtattttattgaggatttttgcatcaatgctcatcaaggatattggtctaaaattctcttttttggttgagtctctgcctggctttggtatcaggatgatgctggcctcataaaatgagttacggagggttccctctttttctattgattggagtagtttcagaaggaatggtaccagttcctccttgtacctctggttgaattcggctgtgaatccatctggtcctggactcttttttgttggtaagctattgattattgccacaatttcagagcctgttattcgtctattcagagagtcaatttcttcctggtttagtcttgggagggtgtatgtgtcgaggaatttatacatttcttccagattttctagtttatttgcatagaggtgtttgtagtattctctgatggtagtttgtatttctgtaggatcggtggtgatatcccctttatcattttttattgcgtctatttgattcttctctcttttcttctttattagtcttgctagcggtctatcaattttgttgatcctttcaaaaagcagctcctggattcattaattctttgaagggttttttgtgtctctatttccttcagttctgctctgattttagttatttcttgccttctgctagcttttgaatgtgtttgctcttgcttttctagttcttttaattgtgatggtagggtgtcaattttggatcttccctgctttctcttgtgggcattgagtgctataaatttccctctacacactgctttgaatgtgtcccagagattctgttatgttgtgtctttgttctcattggtttcaaagaacttcttaacccaggaatacagtgaactgataagacagagccctgtcgcagaggcacaatccagtggagaagggaatgctaaccctcctgggtcaccatactcaggactcaggaaccatgtcttcctcaggtttgcattctgagaaagttctcctgcagaaacctatgcttactacatgcttgattatatttaagtaaatttgccatttttaatttaatgaaaattcaaaacatgtaagtcatttcaacatatggtatgttgctaaataaaaacctttattttaaaaataggttttaattattaataatttatattactttcctgatccacaatgtggtctagcacagaggtgttagccattgcatgaaagataggaactgagcccctcttctctcttcagaaacttggaagcaagaaacaaaagtcagacattcatgtctttactcatctacacaaatttcatattttacctttttaaaatagctttacttatatatactctacatactatacagttcacccatttaaagaattaagtttatcctaaagctgcttccttacgtattttaaatttggcctaaaagtttctcagcatgtagtgaactgtaacctaactggatgctgaaaagactgaaacctactcttgtgccaatcacagagtttcagcatatctaaggtggtcagttgttcaaactgtgttcaaataaggcaaatgccaaattataaccaattctatttctgtacctcatttttgtcttctttacatcactttcctttttctgcccataaatctttttcaaccacgaggcagtgctggagtctctctgaacctattgcagttcagtggctgcccgatttgcacatcactctttgctcaattaagcactgttaaatttaatttgactaggtttgtcttttaacaaagatgtacagttcaatgttttttgtatgttttcaaacatacaaaagttgtgtaatgatcaccataatcaaatgtacaattttttatcatcgtccaattagcagacactaccattccctcctacccctccactctcagcctaggcaatcaaaattctctacagttatgtcactcctgaatatttcatataaatgaaatcatataatatgtcttcttctgtgactggcttctttcaattagcacaaggttttcaaggcacttccatgtgtaacatgtactttattcccttttattgccaaacaatatcctatggtatggagatatcacattttatctattcatcagttgatagatatttgacttatttctgctttggggctattatgaataatgctgctatgaattttcacgtctacatttttgtgtggacatatgttttcatttctaatgagtatatacctaggaatggaattgctgagccatatggtaactctatctatgcttagcattttgaagaattgccactgttttccaaaatggctgcactattttatattcccaccaacaatatatgagggatccaatttctccacattctggacaacacttgttactatctgactttttgattatagctatcctagtaggcctaaaatcataactaattgttcctttgagttgcattttcctgctggctaataatgttgagtttttttatgtgtttgtctaccttctttagagaaatgtatattaagatcctttgaccatttttaatggtgtttttattatctttgtgtgtgctttattatctttatatgttctatacacaagtccttatcaggtatataatttgcaaatatctttgcacattcttggctttttcttttcactttcttgatacccttggaagtatagatgctgttaatattgatgaaatcaaattaatttacctactttttcttgtatttcttatgcttttggagttgtatctaagatggctttgcataacccaaggtaacaaaggtttactcctacgttttctatttagttttataatttttctcttaagcttgggtctatgatccattttgacttaatttttacatgtggtattataaggagtccaacttcattcttctgcatgcagatatccaattattccagtaccatttgtaataaagattactcattctgcattttttcaacccttttcaaaatctagtggctcataaatgtaagggtttagtttgtggacacaattctgttccattgatctttctatctattgctatgccagtaccacattgtcttgtttattgtaattttgcagtaaattttgaaattggtaagtttgttctttttcagaattgtcttgactattctgggcccctcgcactgctacatgtttttaggataactccattcatttctgcaataaaagcttgctgggttttgatagagattttgtttaacctgtagatcatttgaagattaatgccattgtaacgatattaaatctttcaatccaagaacatggaatgtcattccatttatttaggtctaccttatttcaacaattctttttgtttgttttcagactacaagttttagatccttttgttaaatttatttcttagggttttttttgttttgttttgttttgttggttggttggtttgttttgagatggagtctcactctgtcacccaggctggagtgcagtggcacaatctcagctcacagcaacctctacctcctgggttcaagcgattcttctgcctcagcctcctcctcctgagtagctggaactacaggcatgcaccaccacgcctggctttttttttttttttttcttttgcatttttagtagagacagggtttcacgatgttggccagcctggtctcgaatccctgaccttgtgattcacccacctcggcctcccaaagtgctgagattacaggagtgagccactacaccaggtcatttcttagtatttttactcttttgatctatagtaagtaaaattgtttttatctttgaatttttaaatttttaacacagttcaaatcagtgtgtctgatttcatctccttctctaacaaaccagggtgccagaactgcttcagtttctctgccttctctttgtctatgatgactaatgtatgaaggtatctgctgcatcaaactttaaacttcacattatccttatttctcttgaccttgacagatctggcatcttttcacctggctgtaagcagaaagtccttgatctccttaactttttgaggcatggcagcatgtgaggcagggagaggacacagacccacacagcaagtggtgagaagccaacagtggaattgttttcttaattccatttgttgattgtttattgctagtgtatagaaatacaactgatttttgtatattgatcttgtattctaaaaacttgctcaacttgtttcttagttctaatagttaattaattgattccttagggctttttaatacaagatcatgtcatctacaaatagaaattgttttactttctttctaatctggatgccatttatctttttttcttgtccaattgccctcactagaacctttagtacaaagttaaatagaaatgggaagactagacattttgtcttgttcctgatcttagacataaaaacgttgtcttccgttattatgtgtgatattagttaagtttttcataaataaacttcacagtttgaggaagttcctattcctagtttgttgagtgttagcatgaaaaagtgttgaattttgtccaatagtttttaaaaatttttttagacaatcatgtaggctttgtccattttttacttctttaaatttatttttattgatacacaatagatgtacactttttaggtacatgcaataatttaatgcccctcactataaattcggagctgcctcctcgccgatgattccagcgcctgacagccaggaccccaggcagcagcgagtgacaggactttttaggtacatgcaataatttaatgcattcatataaagatcaaatcagtgcaattggcatatccatcaccttaaatatttgtcttttcttcatgctagaaacattcaagttattttctcctagctactctgaaatatacaatagattactgtaaactacagtcaccctactcacctatctaacattaattgatttttggtaaactaatctaatcttgctttctggcatcaacctcacttgaccatggtgtatagtccctttcatatgttattggattcaatttgcctacattttgttgagaatttttatctatactcttaagaaatattgatctgtagtctcgtgatgtctttatctggttttgttatcagggtgatactggcctcatagcatgagttgggagatcatccttactcttctattttttggaagagtttgtgaagaattgatattatttcttctttaaatatttattgggtttttaaaatacatttttaaaatgcaacttgggtagcatgtccaataggaacaaatgagtgtccacccttgaatttcataaccctggaattaatccatgtaatctatgatccacaactgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggagctggccacactttcccaaatcaggtgaggggcttctggaatgggagggaacaaggtaggtttgtttgccacgtgcctcgaaattctcaatccattttaaccaaactcttccgagtgcaaggaagaaatctacagaaataagatgcaattcaataaactttcttcctgaggcttttagttaactcttgtattttagccatcatctgagcgggaagccggtatgactctgcaaggcgttcgtttaaaagttgtgctacttttgaggtgaagttaagagtgtctccatccacgccctctgcttcccagtcaatgtccctgcactgctcacgtccctttagctctctccctgcaaaccatagcggtgggtcctagacacgggacatcgctccaaccttggccaaactctcccaccctcagggttcccagatgtcctttgaataatcaaactgaggaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttctttgggcaaccatttgtgacctggctattgagcccacctgggcctcttctctttgtttgctgatagcctcgttaagtattaaaaacctactcccccccttcaggagccctcttttaatgaaagtttgggtactgggatcagatttgggacttggctacatttatttcctgtgtcattctgagaagagaaagtaatagaggcaagaaatttggcaccctattgatctattttattactttgttgagcaacttgtgcttcccgctgaagatgctgcatcccaacatgattctcttattattagttaccacctgagggttttggatctccaggtgtttatttcacatagcatatgctttaacccccttataagtcttctctaaggaagaaactgccatacttcccttgtcttctccggtgtttccctagctataaaggccccacctgcataacctgtcctcaggctgtgatgtattcccgggtgccctggtaccttctccttcctctccaccacccttcctgacagtgcaggggcaggaaagcatggggagaagggaaatggagactcccacttaacttgctgtgtgatagtaagagcattatttcacaactctgaacctcaagtctctgcccataaggttccctccagtgatataattccttaatttcttttgttttggttattgctttaaaataaaagtctaagcttaaggctaggttatagaaactgcccatcataattgctaggtctcaacatttgcttaagttttgtgattcttagtttcaagtctgttacccactctctctccccgccaccttttttccccctgacttcattgttctttgttcccatcctgaggccttgatttctggttctgctcttctttgaccttaaactgaatcaactcttccatcatccaactcagaataaaattggttttcttccaccggttccactgatgccaatggaagacttgtcttccttgcgatttgcaaaatgtctttcagtcacaggtgctgcggcaatgctgctgtcccacagcattctaagcttcagtctttctctctcttatcgtgggtcagtattcagaaaagggcagatttgtgggttgttcaggtttctcacttttctttttcttctttctagtttgggatcagagttgtgtgagtatttgtgtatataattttgttttggttttttgttcctgctgctacttacgactgctgttattatttcaattatgactaattaatactaatgactaattttcccctatgctagagggaaaataaggaagaaaagtttactctgctacttacccaaagcccaggtaaaatgcttagctgagaaggaatttaaaactcatagtttaaatgcatgatgcatgtctgctgtcattttatctgtgctgccacagtgtcctttcaagcagataactgagagttgctgtattttgctttcgaatttgttacagggacaaaaatagtgacccctcacatttaggtgttttggctgcttaatgcgagctcctgccctctagccgcatgcttattagtttacctagccctttttctggtcagtcatgactggagaatgccaaagagtctcccaagtaggctaccaaattaagaattgtgtttagaagtttgaagtcagtccaagtgttgtaaagattaaaacgttgttttgaagatatgctgtgtcaataaacaaatatggagccagagcaacacaatgtgaccaagtgtccaagcccagcttaggaacacttttctcccatgttatctagcaaactgacaaatcagctttccaacacgtgatgattggaaaatgctattagtttccttcaaaattctcctaatgtttctttttcaaaattgcctaagatcattggattatgtggtttgtgtttcttttcactgtagctgcttgttaaagcagtatactcaatctctgataagcaacagtaaatttgatcgatttgtatcctaaatttagctatcactttacattttgttttattcataatatgaactttagcttctaaaaatcaactttttaatagcttaatatataaagccatcttaaatcaaggaatatctatagggacttaaggtaatattcaactaaattggcaagtgactaccattatcctattaaagctctaaaatgcaatatttcaatcacagaaaaaaaatcttataatttaaagaactataaattgccagatgtttccctagttattacgttagtgacaaattagacaactggaaatagaaaacagagtatatgtttggaacagtcataaaaggactagtgactattgctgctagctgtggttgtattaacattaaaatatttgctatgggatttttcttcttatcaaagcagatgctcagatgaggaaaaactttcttgcatatgaaaatcaaaattgtcttccaaaatatttaagtaacaaaaaattcattatgtagtataaatgctgtatgattacattattcttatagttaatttagaagggtttgaatttgtttttgttttgtttgtgtttgtttcttcgataggtgcattctctaactgtcttaagtagaaacaaatgtctagaatctctcagtgattatcagtctccttcctattaccaagaatgtttttattgtgttgttaatctcacatgtaatttttttaacatttaaaagtttggaaaatgggtaaaaaatgagtgtgccttgtttcctattattacaatgtgccttcctatttcaagtcccaattctagatttccttaaaacttaaaatcatagaattaataatctttcagtttaagtcaacttttgtgtgatttcttgtccacttatacacacatagatgccttcatcttcaccaaataatgtagaaattttatttagttcaatggatttaagtactctgtatgcttaagtacaaaataagaatattgagaaatacacatatgattgtgtaccttttttttttttttttttgagacagagtcttgctctgttgcccaggctggcgtgcagtggcatgatctcggctcactgcaacctctgcctcccaggttcaaatgattttcctgcctcagcctccttagtagctgggattacaggtgcatgccgccacgcccagctaatttttgtatttttagtagagaagaggttcgccatgttggccaggctggtctcaaacttctgacctcaagtgatctccctgcctcggcctcccaaagtgctgggattacagacatgagccacctcacctggcctgattttgtacttttaaagagaatttgttgttgctaatttgctaagtttatttagatattttctgattctatattagtcaaagctcctcttatctactttggaaaatgaagaattatgtctataaaatatatcaacaacagctgcaggtacttacagaggaaatactgtggatctgagtgatattaggccctgaggatacaagccaaagtataaaaatggtctttgccgtagagagatagtagtcaagctaagcacatattttggcatgggtctctaatagcctaatgctagtagggtgggaagccatttaaaaatggcccctccttctgtcctgcctttcagaccagatggtgtgtctaaagtggtcacactgtttggttctggccacttctgtaataaccactgctcctttcccctcctcgtgagattataactcctttgacagtatggatggcacctaacgcatccttgttttcttttactaaatgttccacggagtcacttgcttgcctgtttgttgcttatttgtttgtttttggctaaaactacagaaaatgttaaatacattttcagacctttatattttaaaaaagaaatgttaagaaataaataatttttctaatctcatttagatacactgtcctattacacacaatgacaaatttgatgcttttgtcttgctaattgaagagctaagcatgaatacagtttttcagtctacagcagcaatgacaagggtaaagtggagaaaagagtaaggaaagaaaaaattaaaaagaataaaaggttgaaatatcaaatcggtggttcttaagatgacagaggcaggtgagacaagaatactggaatcacccagggggcatatgaaatctgtacatttcatccacaccttcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttaactaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttaaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggaggatcacttgaggccaggagtttgagaccagctgaggcaacaaactgagacccccatctctacaaaaaataaaaaattgccagagcatggtggcgcacaccatgtagtagttgggacctgtagtcccaactactcaggagactgagttgggaggattgcttgagtctgggaggtgaaggctgcagtgagccatgatcacaccactgcactccagcctgagcaacagagaaagaccctgtctcgaataataataataataataacaacttttgatatctctattttttcccataaaaatccaaaattttctgtttactttttggtgctctcatgctataaagtaaattctcccttggattggacaagttattttctgttttctacatacacatagactgttcagcattccaactcaaattacatattactttttcagcttttaatataaatgcttatttactacaagcatggtttacaaaaatgtagtaaaatatagttactaaccagtcaatgctcaagccagtgactccccaaatgattcagtccctgagctgtttcacccagtgcaggtagattctctgacagccatcagttggatctgtccgaatatctcctgttttgacaggggcttattgatgttggtcaaaagacaggtgtgtatgggttccctgggatcatgtttgaggggaaacctgtgccaacaggactgagcagccactttttcaatggtattgagaaaatttgtaggagataaaatttcaccagctccttgaatctagaactgtagatattcaggtagcactgacattacaacatctaatttgtaagttatgggttagggcaaaatcaatccagggctgccatcatgacaagtagtggaagtttgaaagaaggagaaatacccaaaagatatcttacacatagcaggcagagtttcttagtactaataaaaaataaagtaccagtgatcaccctctatagcccctaagagtcccctggtttcactaagccccaatatttgtggctgtggctgaatgcaatctgcacaaggttttctttttaacagttggaaaaaatctcatagcatagcatttttttctttttaacagttggaaaaattctcgtagcatagcatttttttctagtaaatttcatatacttaacaactttatcagcacatatattttccttcacacttacaatttcatcaacacatatactttactttttgactcaaattcttcttgccatcaattcaaatgctcctgcccttagaatgagaattttccattaacccagctttaataatctaactctcccattcaaatgatgtcacttcatataaaacacattttatcatgatgtctcccagccctcagttacacagttaattgctgccactttatcatgaatgaaaaagatgtgattcttgggtaatgatttcttgagtatgtcctggtctattatctactgagttaccagagtggatttttgagagaacacacagttattcctattccttttaatttccattaacttaagccatatgatagaacattacagttgttatatattttgtataaatataaaatgtaatatataatttatatattttaaaatatttagtggcaagtaaagatagtagtaagtgaaaaaatcactgtataacatatgaatcgtaagtgtgatcccatgtatgtgtatacctggtagatgcttgtcaaggtgccattaaggtcttgggttattggcatcttaatgaaattcatttaattatgttaggattgatttgttagtaaaatcacttacatgttttttaaatgcatgcatatctgtggagccaataagaaaaattaggaacaatatacaacaaatcttaagagcttttgaggatgattttttttctttctttcttttgtatgtacctacaaaattttctataatggatctctattgattttatattttttactttctatttgtcttggaatttctattactttatttataattcactctagattttaggtactagacaactactattaactctctggagaatggtactataaatctgaccctttctgtcatttttttttcctgtggtacactagtgtctcacaaagagtccacagaattcacacggtcatgatattttatagaagaaatcattttatgggaactttcttttgttaatagatccttccaatgctaacattattctgtataacagtgctaaagttggtatgcctaaatgctaaacttggtatgctaaagttggtttaaaaattaacctatatacaatcttcttgaataactcttcaactttaaataaatttcttatttaaaaaatcctcctatatataattaaaaatactgatgaatttgactacataaaaataaatgcttatacagtaaaaagtaccataaacaaagttatcatctaaacaagaaacctgggaaagctatttgccagccattacatgtaaaatttaagtttccttaacataacatgagctctttaatgtgagaaacaataaacaacctaattgaaacatgagcaaaagccatggctgagaaaactcgtagaagaattactatggaaacaataagaaaatgaaaagaagttcaacctcattcataattaacgaaatgcaagtcaaaacaaagatataccttttacttatcagataaagaaaaaatgatttgataaaacccagattcttggtattataaattggtataaccttaacggaggacattttatgaatatctatcaaaaacttagcatatacaaacaatttggttcaacagtctgttagaatttattatatagatacattcatataagtacaaaagtgcatatatgtaaatattattattgggacatttttgtagcagccaaaaggaaaactgaaaaaaaagattaaggctcattaatagcagactggttaaataaactatgtgtgagtacaatgaatgaaatattgtacagccatcaaaatgaatgaggtagatttatatatgctgatgtaggaaatctgctagccatcataagtaaaataaatgaaacaaagaagaaaatactatgatgtacaaaaagaaaaaactatagatatacatatttatatgcatgtgtatgcattttttatgaatatacatatttatatgcatgtgtatacaagtcctagaaggagacataggtaactattagtagtacctctgggaagtaaatgcagagaaaagtaatagagggtaaggatatgtttacttttattttacatccttctgtaacttgacatttatacgacgcgttagcattacttctgggaaaaagaaaaacagaaaaggtaatcttttaaaaaggtattttttaaattatggtacaataaaatgtgcataagctttatactaagtaatagaatcatttaagtttagctgtagattcacaagtaaaaatccaatctattttcatattcttacatttatagacatttcttacatgtctatagaaagaaatggctaggaatgagactgcactattttaccctaaaacgttctttttctctttgcctaatgtatatctacaagggcattggggaagatgttgaccacaggcaggaagatgatgagatcctgtgcccaccacttaatgcagtctagctctatataaggaaaaatatgttcttgatgtgaaccagatggtttcactcccttcaaaaacactcttaagatgcagtgtggaagcttactctgtaaattaaaaaataaaaacctgactatattcagtggaatgcgttaatcatttttttctttttaggtttgatatttgacaaattgatctaaaatggctgggtttttatctgaataactcactgatgccatcccagaaagtcggcaccaggtaaatgccttacatctacagcagtgggtctgtcagcagttttctttaatgtgtcagcagtggggagagcgcaaaaacccacacacaccattatcttgtgaaagaagtagaggaagcagaaaataatgaaatcccagtgttaccacatcccctccaatatacagattaagagcgtttgtatttatatggttttaaacataaataacatcagaattactaagctatttccattcatgtactgataatgaatcatgtgagaaagtcctttggcaaggactccacatggccacaggtgattcctttgagcagtgttcttcctgtatagggcttaagaggaccagaagggaaatgattgtactctcttgtcagctacttcctgggcgatttgggttctttgataccccagtgctcactttcggaagtgttaagaccataaaccttaacagttgaccttctcaccttcagaaaacccaaatgtctcggagtttcattctcacaaacttccaccttcctccaatgatgagatataggaaaaaagacaatgtgaaattggagatggaggtgccctcttagcctctttacaggcatgagtcacatggcagggcattaaactctctcacaacctgttgtggagctcagcagggttagccaggactgttttgtctatctaactcttcttacatgggcctatgtgatatttttcataacaagagtccgggatttacctaactaataagatttccccacgcccctccttacaaaaactcagttcaaagaacaagccctcagcttctcctagtcccctccagggaaaatgaagagtagcttgtcctattctgaatatgttgtgctcccattttatcaaagtagaggatagatacgtaggtgctgggtgggtagataaatattagagggatgcttcttctttgctgtaacagattggcaagtaggaatcattttctggaaggtactccacagtggtggtgttagaaaactatttagaatgcctttaatcttggagataaaaatagtaacactttacagagttctgtcaatggatatctttagggatgttttgttttgggaggttttttttctgattttgtttttttcaggtatagcgaagcttgggaatctggactgtgcagattttctgcaaaaatccagctctggaaagagtgtattaagatgcatatcctaggatgacacaaagacagtatgctttattttacatcttaaaagtattgaacagaaggagttttgtccatgatatcccatcagcccactagcaggaaaagcaggacacttacccagggggttcctgctggaaatgattcttggaatcagccttccttctactctatttgggaagtctttggtttctaacattcacacatttgtagcaaagcttccaaaataactatgatgttttgcttaggaataacaaaacatggaagaaaacattctgtgaaattttaaactttttcaaacctttaagtttcagatgaataagcaaaacatacttaagtctaagaagctattttttgtttgtcaaagaactgatgttataccagttctaatattaattagcaactttgccctggttttcctgtaaaataatctccaaggccctatctcaatctgtgggcagtatactgaaatacaaaaagtgttcacaaaaggaccttctgaactttgcaatctccctttaaaacttttaccaacttaaaactacagaactctgatctcttattgatttaaactagtgatatgtaaacagcacttcagagcttgtttcacaggaccaaaaaatttatgctgaaatctactcatgacaaatgggaaaaccctgattagcacatttaaatgaataaataaagaaccgtattcaatggcttaaaatttatagacctgcatcatccattatggtagccatttactatatgtggctatttacatttaaatataaacgtattaaaattaaactaaaaattcagcccctctgttgcattacccccatctcaagtgctcagtagacacatgtggttagtggacaacacagatttagaacatttctatcataggaagtactactggacagtactgctgtaaacacacttattaataatgcagcagactttcttggccacttggtaagaaagttttctgctcttttaaacttatttgggaagtttttaatacttttgaaattatgatttcctcagtgttagattatctgatatacagctctcacagaccattttttgtttttcctgtttgtttgcatattaaaatatataggattcaatgtttcacgtgcttttctaaagttgcagttcttgatttcttaaaattgtgaaaagaagtacccacagttatattaagaactaaaatatatggctgttggcttggttaccaacattgctgacagctccaagtaagcaaaagtaaaaaagatgtaggatcatttttaaaggccaatattttcttccttactcattaccttctgtaaaattctgtaagattttctttagttttccagtaatgataaacatttcaccattgcatagacataattaattgattttttaagcagttggagagccaaacaaaataaggggtagaatacttcttattttattttttaataaaaatgtacatattagaagcctttatttttatttaaattgtatgtcactgataaggtttggatatttgcccctccaaatctcatgttgaaatgtgatcccctgtgttggaggtggggcctggtgggaggtgtttggatcctgcaggcggatctctcatgaatggcttggtgccctccccatgttaatgaaagagttcttgctctgaaactgtgacacctcccccctctctctcttgctcctgctctcgccatgtgacatgctggttccctatcaccttctgccatgattgtaagcatcctgtggcctcaccagaagcagaagctaacaccatgcttccttgtaagcctgcagaaccaggagtcagttaaagctcttttctttataaattacccagtttcaggtattcctttatagcaacacaagaatagaccaacacagtcacggataacagtagtttttcatttttcatcaatataatgatcctgctgtattcttaaagttcttaatcactatttgtcactaatacgataacattaataaaatttgagtctcagttactttccagtcacttatacctagcagttcaataacatttagttcctggactaatgatcatgtgttatataaggcaaaaaattaaaaacaaatttgtctttgagtcatcaaagcatcaagggtttgaaatagctatataactagctgtgaaaaagggatataaatatccagctgatatttcctttacacatttaatagtatcatttttcaatgaaagcataaataaaataagtttggaaccagtttggaatttttaaatattaatcgcagaatcttactaacagaaaacaaaagcaagataaatgctagtcatttgtgcctgagtttttttttcaataaacagaaatgaagcttgctttaggaaacatgtgtactccaaataacctactattcacacaattctcagtaacattctttctttgcttaaataatacagccagatgtgcttagcacataactctatagaaaataataatttaaattagatttaaatagagatagatagacagacagacagatagacagatatttttgagacaaagtctcactttgtcctctaggctagagtgtagtggcatgatcatagctcactgcagccttaaactcctgggctcaagccatcctcctatctcatcctcccaagtatctaggactacaggcacatgcactatgcccagctaattatttttttaattttttgtagagatgtcgtcttgctacattgcctaggttgctcatgaacccccagcctcaagtgatcctcctgcctcagcctcccaaaatgctaagattacaggcatgaaccactgcacccaaccaatattaatatttttaacaattgaaagagctcaaagaaataggttttaaatttagaggccctgttttgctgacaggaaaggcttttagctggaatcaagagtgctgttgtcttttcccttcaattagtcattccttttaagacttttaagatttaaatgtatgagtcattttttaaatcccagaaagatctagtatatctcataaatgtaataatacagtgcagacctggtggaaaataattatttatctgaaactgggcctcagtgcctttcctgaatctaaacaaatgttcatctcacccagagaactgggacaacaggaacaaggtattgcaagtccaaaatccaatccaaagcagcgttcttcctccccacctctaggcaaggccaaaatacttctgcacacagtatagacaccagaaaaaaacagagccactgtagatgaaaccagtcagggggtaagagctgtcttttgatctagagcttgcacctttgctcctcagtaatactcccaggtcaaaaaggaaaaataagatgggcagttggctgcctcctggtccctccagcctggtcagtgaacagagtgggaagataaaacagctaagtatcttccttaacaatgcaaagcaagaaatccagtctgctttgggaaagtgaaagcaatgcaaattcagattattaatcataagagcatctcatgtgatatacaaaattattgtatagcagtaatgggtcagccgtattttattcaacactgaaccattaatgaatgctagctagtcttcctttcacttacagaatgtttatctatacatgactaaacaaagaaggagcgctggaaatgatcctgtgaaaaatactggctcacaatgtatcagctgagtttggggcaactgaggtagtaggaggcgccccctggacttctgctggaatttagatttaaatagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacctattttgcagttttattttcttaggacaatgcttcagtatctttaactttcatatttaatcattttttttcttttttggtttctatggtatcaccatccatcaatccatattggttggagggggggaatatatatatatatatatgtatgtctcccaagagaaagtaattctgcaatcttcctcagcaattcagtctaacaattaagaacccttaagctaaatagaaaaattcatttcacaggcaagttttactcaatatgtataattagttttagttaactttattaatgaaatgtcgcaaatcaattaggtttgcaataatcagatgccgaggacccaagaggaaccattcctctcacaagaggggaaggtgatacacaatttagttgggaagcaaatgtaattagatttgatcaattgagtattcctgtcctgatgtggagtcagtcacatacccaagcctgagaatatatttgaaaagaggtagaaaaaaacccagtatgacttagaaaatgtccttgtggtcctattggccacaactggcagccaaaaagggctttgaagccacaggtagacaggttttgttcagacagggctatgttttagatttctctttcaaatctgaatggttttacgtagggcaatatataaactttcctatttgtcacagattctagcactctttaatgccttatactgggtgtttcacacagttatttaactgcccaaatcccaatggcacttcagtttgcaactatcatgacctagaagttagttattgaacagttatgaggtaacttaaagtttcttccctttgcctctagaataagaatatcaaagaaatgtcatgatgataggaatactactgaaagaggatattaaacactaggtattcctacttagggctacagtttgcagcagattctattgtgtttcagtcaataagtgtttttggacacctacatgccagacactattctcagcattgagcacaaagtcgtgagcaaggtagacaaaaatgcttggcctcataaaacttacattccagtgcataaagatgagaacaatcacgtaaaatttataatatgttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatggtcaaggcacagcgagtatgccagggtcttcagaaaccacagagaagagtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcattttatgtcagttccttctggatactcagctacattatttggtgcttttggtatacttcaaatatgcattgcctatcactgacctgtaatcctgtgtctctgggcctgaaaatataacttttcatgtagtagagaattagggctgtgcaacattgccactagattatttttaatgaaagctttgcccttttagataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctggatgagagaaaactatcctcactttgtgttatttttcaatggtagcattttctcataatccccatgcttttttcatgtcctgctattctttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctcccccaaacgggtagctgcctcaccagcctccattagagacatcccccagagtaagaaataagaaataatcatgagtagaatgagaaaaaaatgcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcagaaaaattggaccataagaaagttagtttacccttgtattcatatatacatgtgctttgtgctaaaaattgttatcatttagtgagaacctgtgactatattaattaatttaatttaatcttcatatttctctgaccgttagagagtttgtgacttggataactttcaaacaactagtaccctgatggaaatccagaattttgttaacccagatcacagctgcatacttaaatgctatgcaacagtggcacttacccccaaaccgtatcctatggaaatgcctttttagcaaattaaactgaattgtgttcagagatccacaggtctaagcaacattagggaaggggtaaagtagtcctcagcaaggcccttttcagagcactccaccagtgcccttgtcctcctgggcagagctcctcagctatactccctttcctagtctaccctatcccacaacggaaccatacttctctcatggaagccctggtctcacagaactaaaaaggaggctcctagaaatggggttgtgttgagttgacagagatgtgtggctctttaaactgaaatataatccaaagagaacaagatctagtagaatttcaggtcctaagcctggttaaatttcaggtcctaaggctggttaatagtacaaatacagttatttatttataactagtgcaaatacagttatttatttataactatacaggaatttatttcccagtaccttctatattactaacatcccataaaaccagccatgtaaggaactagaacattttgagaatatgcaatacataaccttaaacaagaagttttcattcctaattaaaaaaaataagctagttcatcacaacttccttcaaatccttctgccactgatttctctcctgaaaagagatattatacggcattttagagaaaacaaacatctctaagtcacaaggagtggaataatcaaagttgcattttaagcaagattatggttttttctttgagttctctgaatttgaatagtttcttaaccttagttttttaactgctctgaaaatggtttctgtccctggtggactcttgtttcaatgcagttattttgtctggtagagtcacagagttaagctgtcattcagatcagaaaaaataaaagagagagatgaattaatctcaatggcacagtctccttattcaaaaaataaaaataaaaataaatctcaagtccaacaatgaatcatctttgagactctcccaagtgatctagttttaagggcaaaaactttggggaaactgttgggggagcaactggtgcccagtactgtttcacacacgtggtttttcttatctattgctcacacacttagacataactggaattattgcctttgtattgttgttgccattttataaaggaagacaaaaaagatcagacaaaataatagtgaacatctattaattggacacttactggtgtcaggcactgtgtcatgcactgtgtcaggcactgtattttcttatttaatccaacaaaaaaaaataggctaaattatcttattggctcaattttctttacagaaactgagcctaaatttcccaaatggctaaccaatgccagggccagcaactcaaatttgggagtaattccgacacctaggttccaaccatttttctcccagaaataacccaccaaattcaccagagtctaagatcttactgttactgtttaattaactgctacaattgcagcattttaaaaaaatataaatgagcactgtgctagtatttaattatagctttatactgatactgggtacaagtataagctaacaccattttgaattatagtagaagagtcaggagctctgagaggaatgttcaggatagaataaagcagatattttaatgtctcatttcagtgaggaaaattgttaattcatatgccaccagccatcggcagaaatgtaacaggaaatgaagaaaaacttaattactttaaatacagtggtctgtagtacaaattattgtgccgtgaattagtttccttctgctgtagaattgatcattttgattatgtagccaagcagtgtaagacattactaaaattattcttgaatcctacctttgagatctatataaaacactaggcaatttgcctgcaaatacatagaaaacaatttttaaaaggattgggatgagttattttcccctctgttaaatattagcctttgaaatgaacccagctgatctgccaaataacacttggaaattgttgtgttttaataaagtgacagactgagagggaagccacactagacgtccttatgcttttagaggccttacagggcaggaacattatgcaataatgccttttaaaagaagtgagcttcctagtattacaccttgcctggcaacaaatgtagccacttactgaaatgcaggcgtaattagaatctatgaaaatctagcatcagaatcccaaacctctatgcaatactcagtaaattacagcttttatgtctgtaatattttcaaccattctacttaaatatgtgaatacatgagtgtggagttctttaggaggcctgctgcatatgctagggaaaggtttcatcatttctaatcaggatggctctgtaaatgggatgcctcatgttcaggtttctggaaggctcagagcctgggcttctactggcagagggtagacccaaatggactactctagtgaaaatctccaggtgaacatggaacgcagtgaaaacctggggtatccaacttgcagtataggccaccagcaagtgtcacctctattataactttaaccaggcaagctcagtctcatgcattagtttataaaattgcaacagagccttctaagactgaaaggacattagtttttaaacctatatattatgacctaattaaatgaaattttattttaaagccctcataaaagtagtaaaattggtgttttaaataaaccaaatgggaattcaaccactttaatttttcttttgttccaataggaaaataaatgctttaaaatttgaagttgaaacatgggttttaaatatattgagataaaaactattttgcataggcattttgaagaaaataaattttgttctcgtgatttgtgattggccattgatttccgtgtttaagattatgaaggtgtgctcagctgtctactagaaataacaggggagactcagtcttgtttcaaatggaagggctcctattcggttttctccttcatttcttaaagtgttgtgatttttttattccctggtgttatgtcttgagattttaaatcttaaaacatgcaattaggtattgaagttgaaagctggaagtctcagccagctagtaatggttttttaaaataggtaatacagacctctagtggttgaacagtttgaaagcctctgcaagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagtaagaagtctggatctgtattatttttctctaaaagatcttgtgaacagagctgctagatctctgtattatatgaaacatatatttttgtacacagttttgcctcactggggctttgcttcctttgtactccagaggctccccatgaaaacaatctgcagccacctcaacttgcctgtgctgttctcaggttctgtccatggggagccacacttcagtgagctcagcgattggatggctttttagtctacatgagagggaaactccatgtgcctctagactagtgcttctcaaactctaatgaacacccaagtcatctggggaatctgcttgaaatgcagattctatctcggtctggggtggggcctgaggctgtcttgttcgtaaactcccagttgatgctaacgctgcccatccagggccacccagagcagcaagccggttctatgacagctctctttattttttagttacatattttgtttttactcatttcttctttgtttgctcttttactttaataacttctgttaaatttttaatatttggatctgtaaaacatttaaagttctctttcacttcactatgtacaagtatctctgggaatctgttattgaagttttgagaagttgatctcacattttaaaaatagattcagtgtcatctctttatcttgaaaagttcatggtagttgtgagcatctctctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagaggctcaaagcataagtgtcaacagatcagaagaaaacatgggagaatgtattttttcataccaaattattaaaattccatcatctaaataacttcctatcatagcatgttgtcgacctcatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcgtaccggtttggcctaaataaacatgcaataaaaaagccataggattttattatttttttactcacgttactactttagtgtgttggaattttaatatgtcagaagaaagatatctttgcattaaaaaatcattttcttttcaaatgttaatgtactgattataactaagtgaattccatatatttataattgtgggcagatgttctcaattaatagttttattcattctacttcacagtttagtgaaaaggattattttaaattaaggtgtaaataagaacaaatgagatttttattactacaaatcacacagaatttgttggtggtgctataatcctgtgtaggtatagctttggcaaaacatttcagataagcttgttttttgccccatgggttctgggacgaggtgagttgtctgtttgtcctataaggttcagaaaggtaaaagggcaaggtcattaattggctagagggcaacaaagaaggtagttatccctgtgtggtcaagaaaaagtggctcaggttatcttgctcgggagagaaaatgttcattcagctccagtccttttggtaaaagcccactctcagtgtatgagtgttcctttgcctaatcatgtagactataacatgttttcccctatatgactccatcgattaatcattgcagtattatccccacttcataaatgggcaaagaggaggatgaagccgagtagttcttccaaaatcaagtagcatgtaagatgtaggagcaaaactcaaatccagagacttctgcttccagccaagatggaataacagggactagatttacctccccacctaaaacaattttaaaaactggacatacatatgaaacaatggttttcaagagagtggacatcagataacaaagggcagtgatccctggaggataggaaacaaatgacctgggattgtcccagcccactgcctggagggagtttgcaggcatgatacagggatggtacacccaggcagaactcgaggtcctctctgagttaaggacacagagctgggagtccagagaggccaaggaggctagagttcagagtaccagagagttgagagctgcacagagaacccagagatctgcaaatggtaccccttgtgcttcagtgcatgtgggcaaataatcacccaaacgtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccgtaaaagtcagactcaaaagaattaaattatttgcaagtaactcaactgcttttcagaaaacaactggagaaattttgtaggaatacaaaagcatccaatatccaacaaagtaaaattcacaatgtttagcatccattataaaatcaccaggcatgcgaagaagctggaaagtacaacccataaaaagaaaaaaatgaatagaaacagacccagtcagtaatgacacagatgataggattattacactattacattaaatggttattatgactatttcatatgttcaaaatgcttgatggaagtttgaacatattaaatgaagacatgggagatataaaaaagactgaaattgaacttctagagatgaaaactacaatgtctgagatgaaaacttaaactgagacttcagatgctaagactacatttgtttcacatccccacaacattcttccctggacgctgagtttcctcccagcagctgaatacttcatgcttcatcctttcttaatgctgaactctcagaaaaagtccttcattctaagaagaggcgggagggtgccactctgtagcccctttctcatctcactctggtccctgctggcctggaacagattccactcccttcatgcactgatactccactctagactgagcctcttcatgaggtagccatcaagccatccgcagtcatcaacatggcaccttctgagtcagttacaagagtttgcatcatcagaccaccattttccgtctctgttttctgacttaccccaaaactctagttaaaactcatgaaatattatctcttcacatgaaatacaattaatatggaagtcagcatttttgcatctcccaacgcttcacatccaaggagctgtgtatgaaatcatgaactatgttcttccagccaaccaagcaattaaccaaagtatacatgtccatgttgtccttgtacagagtttgaaatatgctcatgagaattaaactatttttcagtaaatctgaaaaatcaacttgcttgtccaggaagttttattagggatagaatcccaaacaatgaatgtgctagccaagtgttactattaatcagaaatactccatattcatccaggattaatcctgtgtaactccctcagtcagtgtagcaatgtgttctcttcctgcactttttttatgtgtgtgtattcccaaatctgcagtgaatgtatttaggaaatacattagtatcaaaaggacaaatgtagccttaaaacataaatgtacagataatttcctatttgtagcaaagttcacttcagaaacacttgataagaactattcaaaaataaatattttcagtatttatttaaaatattttaaaatgtaaactcctcaccagtcatctagccagggccactgagtgtggctctatgaaatagcttcagtccctttcactactgatgaccttttgaacacaagataatatttgtcgagtaaatgtcaaaatagtataagaatacccaaatcatggattctatgctgtattcactcacatagagacttcactttggagcacttcagagcagcaacagctctaagagatgtaacagtatgctttccaggatagaagaacgaaaagggaaaaataagttgctagcaagaacaatgaggggtaggggtgaagttcaggctgccattctgaaagcttcctcagactgagtcaggcacatctcacgaagtgcagactatgcaagctggctgtgtgagatcaagggtagacagttgactcatcctgtcacatctctgtgttttaccgtaacctccaactattcagccatgaatcgctgcatgtggaatggaagggggaatgtctaacaaacagagacatacttcaagtcttcagtctagttaaaacattggaatgagggtctgcaacatctttctggggcttggagtctcgtctcagttctaaaatgagatggttggcctggatcctaagtttcaaattggcagcctttttaactaaatctaatctagaagagttctgttaggttccacagtgttgggttttaaaatatatatatatattagttgaaaacattttaaaataggatctttcacatgaaatttgaaattttaagtttatattttaaagttagctgttttcccccacctcattacaattggcacagttgactatagctgagaagtgaccccgtggcccccctccaagaaagggggagggccctccattcaccaccatgtccacttcacctatttctcccagcctatatatgtatttgaatatgtgaaccctggaatgcataatgtctagggaccataacaacaatagaatgctatgaatctctgacttacaaggactctcttatgaatctctgacttacaaggactctcttatgaatctctgacttacaaggaaaacaaaagactgtagagaatagtagttcaaccacattttaggttaaaatagactttacttggataacctgacaaccaaaacatctttgataatatagtaattgtgtatgtttaccagacaaagggtatacatgtatattcttgtatttctcttaagaagaaaatcaataaatttgacccatgaatttctttctatagcagacatttttgtgacttcctgactcacaggagatacagctaccctccaaacctaaatcaaaagtccgtaagttgcagaatgactttttatgtaaagagaacatactagtttctgataagatataaagaaaccatgtaatttatctagggaatgactctaagctgatcattgacttatttacacaactatagctactggaatagactgattccaaaaatatattttctctgaattagaatctttttcatatcaaaatatccaaaattattagcatattatgttattctcacaaagtcctaatgaacttcacaaatctgcctgctctattctgagtacaaaaaatatttagcctaatttgtttttccattattttatatagtaataaagtaataccaaaaatgttattgccagaaacaatacagtgttgtataattattagaaagtgaactcatgaaattctattaaaaaacaacaattaccacatgttaagtcagataattcacagaagagacttatatgaatactaggggagctgtaggcaacaaaatttttctctgaatcctgcattttgaaggaagtttctgtcatttaattagttgaggtttgattcaccaaccaaaggtctatagtgtgatatattttcttcctccaacataaagttaacttaaagtcatttgtactttatgtgtttattctttcacttcttccccaaaagtaattctttaaattgctttatgggattaataacaaattatatcattatatatttttgtattattagggcttctaacttcattataatcaatttattggccatatataataatgcaacaaattacatctgtaaagtaaaattttatgacgcaatttacttagtatatgtataagtctcattctgctgcccaggctggagtgcagtggcgcgatcttggctcactgcaaccttcgcctcctcctgggttcaagcgattctcctgcctcagactcccaagtagctgggattacaggcatccgccaccatgcccagctaatttttgtatttttattagagacggggtttcaccatgttggccaggctggtctcaaactcttgacctcaaatgatccacccgcctcagcctcccaaagtgctgggattacatgcatgagccaccacacccggccggagacaggttctccctgacctgtgagactgcaaaggtggtgtttcctatgagtccagccagataatagactctgctaacattaattaaattaatattcctttttaagattctaggtgctgaatatatatctcttggtctataaattagcttcgcacttcagctatttagcaaacttgttttttattgtatctagtgtattcatactgaatgggtataatatactgtcttttgaaaaagttattttgtacacataatcttaaaacactcttccaagggcaaggtagaggcttcataatattatttccatttgtcagatcaatgaaggtttaatgatttgtccaagatctcaatttctagagaagcgaagaagaatcccccaattctagttctaagtttcttttttcccttgctaaatcctgcagtctactgatttttttttttttagacggagtctcgctctgttgcccaggctggagtgcaatggcatgatctcagctcactgcaacttccacctcctgggttcaagtgattctcctacatcagcctcccgagtagatgggattacaggtgcatgccaccatgcctggctaatttttgtatttttagtagagacggggtttcaccatgctggccaggctggtctcgagctcctgaccttgtgatccgcccaccttggcctcccaaagtgctgggattacaggcgtgagccaacatgcctggcctgcagtcaactgatttatgttcatcaccttcttaagttaaattgctcttttactcattgcctttggttttgtgtgttaagattcagcatcagcattcatgatatcttttcactcttaattctgagtgtttccgtccgtttttttaatttttgtactttatgggctttttcttcatttacccccaattatgcgggaaaggctgtgtgcctcttttgaaagctctgatgttctcaatgaagagaccttttaaatgaccttgtttgtcccccaccgagttgcatatcacaacttcaaatgtctcactaaaatgttacccatttggcatcagtatacagaaaaggctgcactctgagataagaaagaacagtggtgttttcatagtaagagaatagagttcttaatgggaaaggggagagtataatttccactgatttagctggtctttcaaactttatgatgcttttctccttgaactagcctataagaaatttgtagggaaaataccacaggaatcaaattttgggcatagatgtctattaatattgctccttacaaagctttttcccagaattgtttctccttgcctacaaaaactactccatgcctttattagtcagaaaagcagttttgtagagaaggcaagtaacagagaatcaagctaagtaagtgaaactctgtaattgtcaaacttccagaaagtaacatttgtaactaagtatggtatctttgtcctctctctttctctcttctctccacttggtttctaatgaaagccttgattacatgttatatttaatgtactgttccacaaagaagaaaaggcctaatgtgaatgcaagctgaatttacacttaaatattgcagtcagttcagaccggaaggatacagatcgatgccctctgatcctgtcagattccccgaagtgtctatggcagtgataccacaagagggcagggtttgacttccggactaggtggcttcctcccttcagtgcagaccttggggccacgacaacagccatcaatctcttgaaaccctaatgatgaatctgagctcaaattccctcttcagccttatctgtgcagaatcctgaagttatgaaaaatgcttacagaaggtaatttctagaatgatctaacacagcagatatttagtaaactccctgtttgagagctcctactaagcacccaacacagctttagactttggtcacccaataggattttatcttttgtgagggatctgtagttttccccggaagatataatgcatgaaataaaagcctccaataaaattcagtatacagttaatttatttcataaaaggtgagagatataaattatcaaaggttaaaacaaaaagtaggaaccagagcagggtttttcagtagcaactctattgacattttggattagataattttttggtgtgggagactgtcccacgcattgtaaaatggttagcagtatcacttgtctgcctgctagatgctagtaataccccccacacctccctctcccacattgggaaaatcaaaaatgtctcgagacattgccaaatatccctggagtacaaaatcagtctaattgagaggcactagactggagtataaagagatgaccatgccaaaaagtaaaaataataataatagagccttgaaacattacttacagaatgtcaaaaacgtaaggacctgctctctattcctgtttcttaacctgagcaatgggaataatgatgccttccctcataggtctcttgtagaaatgaaagcaattaatgcaacacttggcacatagtaagcatccaatgaataataagtgatcagtgttactattgctaatattaagccactattataagtcctttctgttaatcagcagaaacaaaaagaagtataaaataatggtacattaaatgaacttaaacacttgtatgtcattttgtgctaaagttatgaagctgaaaagattgaattgacattttccccattgatagaaatcatctcaaaaatgctccatcttccttgtgaaagccaaaggccagcagtttccacatacccagcatctgataagtagttaatgatccagaaataaactgttaggtgcttcagggaatttctgtgtatagagaagttccatgtaaatatttctccgagaggtggatggagaatgataattcacttttaccctctgaatttgatttataagcttcacctatctggcaggagataagaaccaaagttaactgaggagaaaaaaaataaatgatttcaagtgaccatgatcttcagctggaaccagttgaaactgcaaagcaactgggctgaagaagttcagccaaaattatttgtttataaaaactagagagtgttagatatttctatcacattggcttatttgaaatttctgctggctcaaatgaaattgtattcttctatttcctactgcggggttccttccctaaccacaattgcttttggattggagacttgtaactttgagaacaagagcctcagcttagctagctggaagaaccagaggagagttttaatatctcctgaagaaagaaaagcactaacacggttattatagttcaggacaagtggagtcaaagttgacagtttctgacttgaacagttttgttgctggtaataaaagcagaagtcacgtgctgaacgtgaaggtgagcagaggagaacttgcgatggcaaagttaaaaacaagaggagatgatggtcttggtgtggcacaggatgttaaaaaaattctcctgtccttaaggagttactgctatttgagtaatgtgccacttccctacatagccttctatgcagaaatgctatatttccacttcacaacccagaacgtgcattttattttacatttagaggaggaacaaacaaccagaaggcaaaaactggtgcattattttttgcaattctcttggaaagagttcgtttttaacttctgctcagacagcacacaactactgggaatatattttaatttcaaatctgatgtgtgacatctggtaactcatttattgctaatgaagttttcacaggaagcagcagtcaccagtagctcatcttatttttcagttggcaaagtgttgtttaccttttattggcctggcatcggtgtctcttatcacaggatatttaattagaaaacgcaagtagcctaacatagaaaagaaatggagtggtagataatagtagatagaatggtctaaatatttttattacagtgatgtaatatcactgtaatttatgtttaaaaattatgtaatactcaaaaggaattctcagagctggcgaaacagtctggtccaagcagcctctcagcagtgcctttcagcctcccctctctgagtctttccaccccttgctggtactttagtttcttccacttctagcaccacgtgtagtttcccaatttctcttacccaaatttgctcgcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttgatgcttcataaatgttaaatgaaaacattttagctgagggtacttttgttgtttgttggattggttttgcctgttcatcaggattatcagcatttaagccagagttgcaaattaagttgcctacagggcagtgcttttcaaatattagtgtgtatcagaattacctggagggctcattaaaaacagcttgccgaaccccacccacagagtttctgattcagtaggtctgtggtggggccagagatttacatctctaacaaatttctgggtgatgctgatgctgttgtttcagggaccacactttcagaaccattgctagaggggccaactaggggacgtctgtgagtaaaagcacctacactgtgcttccagtacagcagccagccccagtgtgatgagcacttgaaatgtcgctagtgtaactgaggtgtcctggaagcatacattataccctgggttttgaagacatggtacaaaaaatgtaaaatatcttaataattttatatggattacatgttgaaatgacaatagtttggatatattggattaaatattttatcaaaattaattttacctgttcctttttacatgtcaaatgtttttaatagaaaaattacaattatatatgtgtctcactttctatttcttttggacagcactgaactaaagaaccagaaaatagaggggtgtattagtgaactacagaaaattcaagtcccaaaagctgtaaatactctgaggaccaaagaaaatatatacgttgttcagatttgccctgaggggtcagtttgtacccaaacatttgctgccacaagtagtaaatgtagaagcaatccaatatctactattttacttttctttcagggttaatcaagtgccttgttataattcttcaaactaaaaacattattataataatgaaaaatatttctgctgaacttccgaataaaaaaatttagtaatattttgaaagtctgagctttatttaattcattttacttacccttgtattatagaacaattatatttttaaaaatgcttttatgtcttccaaagaactttttatttttagcagtccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatcaataaataaaaagtaaagaactataatgcatacaaaactgtgatggaagaaaaggaaactatgtgataaaatcaaataaatatgacccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttccaaactgtactctttgacttggtagtgtcaataaataacgtaagggatgtctgacaggcttacagcctttggccataaatggaatgaaacaaagtagtccagatagggctcaaactcataacattgacctcgttagtctagaaccacaaccagctatccaaatgtgcctgggaaatatttctttgagtaatagttaattttttaaaagaaagaaaaaaacctgtgactatgataatcttatgttgagtttctttattcatcttgagtaaacagtaaatttttttcactttgttgtttcaatacaaagagttcttgtgtttaatatagaatattattaaattagtgtgggattaaaaatatttagatagctgatttaacaatatgtgatagcattaatcaactgccttgttataattcttgaaattgttattactctacttgtcaagcaattttgcccttctcgtcaaatgatgcatacctgttcaatggaaggattataaaagttcatgcttcggaaaattttttttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccggaaaatttttttaagagtataaccaactccccgaggatacaggggtccagggaagctaaatgactgcttcaaggtcacccagccagtgagtgggaaagctaaaattagaacctcagtccgctcccacattttccaccaatttgcaggctatcgttaaagaatatttcttctgcaatcagaacattgagcaatttggaaaaacgtgtacagtatatcgaatattctagcttcatttaaaatttatggttatgtggcttgtataatgttaaaagctttaatctaaaatgaattgccatgtggccaataaccccaacataatactcataatgcatataaattctctaatattatcataatttcttaagggtacaaattaattagtacctcttttcctgcccaataactttcctcacaccccttaaaatggaatttgaaatgagataaacagttgctgctgctgaattaaagtttcaaagaaataaaagtgaggtggcttcatatacaaaatctgtagtttttttcacaaattggatgaagcaattgttattgactaagcccatattggtgctgcccttttctctgttgaaaagaaaagcttgtgagtagtctccaagagccatattattaaaaatgatgtttcctccccatgatggctgagatactaatccattgaaatgtggcgataattcttgtgagaaaattctatgagtctataagtttgaagaatttagaagtgtaagaggacaggggttcatttacttacaggccttcttccaagttaggttttattttccttttctcctagtctctggagtctcctctctccagacaccctggaaagccattcatggcctttcatatttaacataagagtatttaatactaacactaacatgtcgaaggaagatgtttaaagcatgtgaattagacttgatcatatatgtttcattggcacctgtttctctactttttggaataaaataaaaacgacaaaaacagctaagaattttggatagtgatgtgggtgggagggattggggcattcatcacaactgagttgtttaatttatagtaagtgggaacttttagagttgagagaagtttaattgtagtttagagtttcattattagacagtagtcttaaacaattcccaagaagctaaaatgtgggattaacattttactttcattgtaattcatatcctaaatataaatgttaatataaattataaagtttctgaatttcctttcataaaactgggttctttgggttcttagttattttggatgaaacaaggggagggctagttggaaatgatggaacatttaaccactgtcaccacagttagtcacaattggtacatgcagaattaataaagcagcttgccttgtttttatttcttgtgaggtcagatgacagtggatgatattgacttgggaagatggccagaagccactatttaccatgtacatatatcagagagccatttattaagtttgaggagattggatcttaagtacttaattagaatgacattaataattttaataaaatgttttgcattgagagaactattcactcagaaatagcaggggtgaacaaaatcatctccaaagaaatcatttaacatgaagttagtctaggattaccaaccaagagcatggcattctcccatgtatctgacttaaaagcaatacttgtctcttgccccatggtgccaggtggtctgccatgcttccctcttcgtggctgccaggattcccggtatagaggcaaatacaacctgtaaaggctcaaacgcttcatcaaaagccatgactataatccaaagctattaggtttaagcaacttatttggaaattatcaccttcaaataacatgtagggcaacctcagtagagatgaaatggacgaagcaggcatggaaactgcccttcctgccttaaatacagaatgccagatcacagctctgaataaaagttaagaccacattgggccagatcaggactaacactagatacacagctgagataaagttccagtgactttggcagtgtgaaagtcaggaccagtaggcacatatactgaaggcaatttaagctgtgtttcctgattaaagccagggactgaaaaatcactacctattcatgatgaaagactagaaaacttctgaagaccagacagagtttcagagtggtatagttactaatctactaaatactgcaaatatatagtatctgcaaatatatatataaggttgaaaactaagctcagaaatgagcattaaaaacttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactataaatagtaaagcaattgggtaggggctcttaacagacagatattcaaaatgttaaggaaaataaaagaagaagtagacttcgtaaaataggaacagagggctaagaaataagaacaagtagatctgaaaaagaaacgagtaaaaagcctagaaatattagtgccaatttctatgggtcaatgatttcacaagtgaatagctaacagttatttcctgtggccttacttggcagagagaggtgggggaagcaacataggagcagaaacagttcctttctaagtctgacttataaaataggaacaataaagacaacagtttattgaacaggatggtttattgagctgtccagcactataagcaaatggcttacaaacattttcctactctttttgatgcttgagagagatactttgatagaagattattccaaaatataattacttggtcatttagttctctctttattatcataggaaactatggggaatttttttttctttagattgcaaactagttttaaaaagagcttgtaatgaacaatttaattagattggttttggcttgcctaaaagcttaagaaggtattaatattctaatcaaaagtcttgggaaagcattcttagaataaaaaaaggaaagaaaatcttcattcttatgctttaagaaccaggaaagctgtcaaaggatataaggtaactcttacaaaagcaattgtaaaataaacgtggtttggccacaatgagccaacacctatgtttgccacagacttagattcccacctcactcatggcaaatttattcagctgcttaagattattttttactcatacttcgaaagaacaacagcctggaatttttagacttttaatggcaatggaaggaacttacctatgataaacatttttctttactctcacgctttcttaacccatggctgttctgagtcaatgtttgccttgcattcaaaaaataatagtaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacacagatttgtacgtggcaaaggaggattccatttcaagtctttcaaccccaaattcatcttcctttctctaaggggaaatggtgctatggaattcatgtaagccacagagcttggataaaaggaatagtaagaccaaaaataggaaaagtaggaagaggtggatcctcctatgtttttaatcagggttctatctacctgtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaagagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagcgttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggctagacttaaactgtgtagaggaggagaactgtgactttattccccttgcatcctggacacccacacatggtaggtgttcagtgaatatgtgatgagttggtgaatacccactgaatgtgctatttgcattgctacttccttgtgcttccttccactgtttctatcgcctaaaattcttctccctttttcctccaccctcgagtaggaaaaaatttgtttctttattgggcagggagttctggtcattatacatttatgtaaaatgttcttctaattggcatattccatgctatgtccagattctttcaagcgaattctcattaaggtaataatacctcaccgaagtttccagggatgatcccctagctgttcaaagctaccttttatatattaaataccagtcaatatgaatcaatggtaactgaaaaaaaggctgatagcttgtgaaggagttggagtacaaaactatgcctataaattgatcctcacaaaggcagactttttcccacagaaattgtattatgaatgctagttatagtttgagactagttaataaaattctactcactccaaacataggattaatggaacccacatgagttgtgtgctgtcaaagtcgagtcaagaggagagagaaggagaagaaaatttcctccctgttctcatagctcagggcacccaagggattctagagcgtaaagtgtactcccttctattttttactgcccttattcccaagctgaaccaaatatttacctctgccctcattttcagttatggagttcactcaggcccttttcaaccttcgaggttccttaacctttacattattaattctttttctaagcaaaatccagctgatctctactagatggttaaaaggatagtaaataggtaaattaatccacattaagccacaaatgactgctagccctaaccctttaatgactaattaatttttaataaagaatatgtgtctatataaatgaatttatacttctaagttggcataagttcagaaaaaatagtaagatgaactggaaaatctacaaggtatagggaaatcctctgggtgaggaagaactagtcatacctccctaaaagcctagccctagtttctgttacattatttcttcttttcatcttctgttttctaaaccacaagtttctaaaagcaccaaggaattttctacctgtttatttcgttttgtttttgtttctgtttttttgtccaaggtgaggcccaagttgacactgagtattctctgtgaaactctgcaaggagcaacatgtgatttcacagaaattagtctcgatacactatattcatggctgtaagttctatgctgctcacccattcatttgtccattcagtcactcattcatgagacatttatcatctgcctcctggaacataccagggcctacaccagaaaacaaggaaacaagtaaacactagtaaactttaaacaggctctccccacaagcaactgacagaccagtggagaagacagatatgtcaacagatgattacaataaagtttcaaggccgggtgcggtggctcacgcctgtaattccaacattttgggaggccaaggcgggtggatcacccgaagtcaggagttcaagagcagcctggccaacatggcaaaaccccgtctctactaaaaataaaaaaattagctgggcatgatggtacacactggtagtcccagctactagggaagctgaggcatgagaatcacttgaacctgggaggtagagatcgcagtgagccaagatcgcaccactgcactccagcctgggcaatacagtgacactctgtctcagaaaaaaaaaaaaaaagtgtcaaacctacatccaaaatgtcaaagtgctcaaaaaagttgggaaggcttcaccaaagatgtgacatttagggtagataacacctgtttgtggatactaatgtcctggtgagtcaaagaagaaaaggatgtacattatataagctggatgcaaaaaggaacaataatgaggacatgcaaccaaaaacttacatagggagaacaactttacttactcagggaaggcaaagagaccacttaagaactccttcacatgtgttatgtcttaaaagctgactactggagttgtatcccttgcacagcatccctttgcaccaaagtgaacactactctaagaacatgtgttcagctctcctgaatgccaagcacaaccatgcttggcatggcagtggtgtcttatttctgctcctctttttccccagggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgatgtcactctcactgaaccttcagcctccttcctgggacttcctgatggactgttatccagggcagaatgtgttgattttctaaatcacataaatgaatagcttgactgttgattatgtagaaaatcagagcaaatatttgcatggctttgtgcagcccattcttgagcatctgattctccccagaattctaaaaaacctgctgctttctcaagccctcagtaaagacatgctttcttgataatcctagccaaacctattcatttgacatctttgttacacaaatggttaaccacagagttaacttcagaaatggctggcaggtatgaaggttagaagattcatgcacttttgctagactgaattggaagttaaagagtaagtagttactgactgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgtttttaatcaatttggaaaccaagatttacttatagaaaaaaaggaaaaggacctagataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaatgtatttatcttcattacttaaaatagatgctaatttattttaaaataagactaccttgaatgagtatgaatatatttttatttaaattttgatacaactgatagtttaatactattggttatagattttttatcctgacattgaaaagttaaagaaaaaacattttgttctactgcatgtcatggaataaacacatcgttttgaatttttcagtttttcacataacaaagaaaaaaattaactcttgctataatgctagaataatacattattttacaagtaatttaataacagaatttttctaattgtatacattatcattgtaggaaagttagaagatatagaataacataaaaataaaagtcatgtttagcttccccggtcaaaaatcattattttaacatttgggaactttattttctacttttttcattcattatacacacatatatgtgtcaatcctgatactgaagtcatgatgtgtatagtactttgtatacagatctttcacttaatgtcatagcatagtagtttcctacccaattaaatatttttctaaaacattttaatatttgtataatactacaaaatatggacatacgctgatatagttaactagtcaccaaattggaaaattgagctttttctgatttttttagtatcataaattacactgagatgagcattcaagtatgtgaatctgagaaatttcccatactcctagaagtggtgcaactgaaatacacgtatgaacattttttaatagtctaactacctgttatcaaatatttcccagaaaacataacaatttacaataccaccaactaggtatgaatatatatcaccataacctcagaatggggtatttactaaattttttttttttcagacagggtctcactctgtcccccaggctggagtgcagtggtgtgatctcggctcactgcaacctcccactgctagattcaggcaatcctcccacctcagcctcctgaatagctgggactacaggcctgctccaccactcttggctaatattttttacttttttacagagatggaggtctcactatactccctaagctggtctcaaaactcctggcctcaagtgttcttcccaccttggcctcctaaaatgctggaattacaggcatgagccaccacacccagcctaaatttaagcagaaaagaaagatttaccgtaaggatccagctgccacatgcaagggccaggatgcaactgtgcctgaaaattgtacttttaacatttctgctcccatcggacagttgcttcattcttctatttaaaggatttcagtgcttctgaagttcatacagggcagaccgaagtgctcattctggtcaaataaactgtggccaaagggttggagttatgcgtaaaataattgatggttgctgtgggcaagggggtgtcatctcagagagaggccttggccactgggcagaatttccacaaagcagactatattaccttcacattcccaaatataaagtttttgtgaacaaatatggttccatatgccttataatatttatattatttttatattatttttaatttcattaatgtaatgccagccactcaccccaaaggtcttctactattttcacaaaggatcacctcaaaaaaataaattttaccttatcccaagtgatagcataaatatcctatataaaatccctccaggcctccaggtcagctttataactgttttttttttttttcagtagttgaggattttttgtgtgtgtttgtttttgttgttgttttgttctgttctgttctgttctgttttgttttgttttgttttttgagacagagtctcgttctgttgcccagtctggagtgcagtagtgtgatctcagtccactgcaacctccgcctcccaggttcaagcgattttcctgcctcagcctcccaagtaactgggattacaggcacgcatcaccacacctggctaattttgtatttttagtagagatgggttttcactaggttggccaggctggtcttaaactcctgacttcaggtgatctgcccgcctcagcctcccaaaatgctgggattacaggtgtgagccaccatgccctactcaatagtcattttaatccaagtgattgtaagcattttaaacttgctgaactatttcataggttatagttggcaagatttctgatagataattgtatttagatatcccctatatcatgtatttattaatggtgttaataacatgttccattcatcaaattatattgggattttaccccatctcacttgtgaaatagatgttactaaccttgatgattattctttctttttcagtgagatcaacataatcttggagttgagaccctacttaccaaaatgttaggataggatgccattatgtattcttcatgaaaatatttacaggttaggtagactccttatttttggtacatttaaaaaatacatacagaaaagaatatttaccatagagatctaggtgcccaacagaatgcaaaagctacatttatattgaaatatatatttcaatatacacccatttacacccatttctgaggtgtaaatttcaatatacacaatattaaaatttacctcattctaagcttttggggaaaaaaaggctagtcatttctaatgctggctctttctcattgtggaaattcatctttttggacatcagttacatcatttttcaagtatggtgagttggcttggtgaaagaaggcttttatattttatattttattttattttattttatttttgagatggagtttcactcttgttgcccaggctggagtgcaatggcatgatctaggctcactgcaacctccacctcctgggttcaagcaattctcctgcttcagcctcccatgtagctgggattacaggtgcctgccaccacacccagctaactttttgtatttttagtagagagggtttcatcatattggccaggctggtctcgaactcctgacctcaggtgatccatctgcctcggcctcccaaagtgccgggattataggcgtgagccaccgcgcccagcgtgaaggcttctatttagttaataattcactcattcatggatttaataagtgttgtattgtttccctactctgtgctgggtaacaagtgctgtgtaacatatagcagcttagcatgtaggataaacttgttgctcagctgctgtgagcagtgtgaaggagagccaagtgagaagcagcttgattgcaaatcacagaaaggctctcagagttttgataccacaggtttttcagtttcataactctgtatactggtgcatttttttccaacaatatgtgccaatctaggaagcccaagaagagaaaatagattgaagcaggtcacaaaagtgtgaatgaagaaaacaagtttcaaggaatttcggatacttggtatgaagagtgagatatctgagggtaaagaaagtaaatcaagagtaagagagatacagagagactgagtggacaggaggctggaagcagtcacacactgcccccaaggccagggttcagacctcacaggagagatacatacagtcagggccccaggaccatgttggatccactggacccagaccaaccagaggaagagggaacccaaatattagggtgggaagcaagtcataaacagtagacagaatggtatggggcaagcccttaaccatatggattttatatagttcaggctgtatgactgtatattggagctaatcagagagtcaaattttccaaattcaaaatcttgactgagtcagttaacatatgacatctgtaactatatccagtcttgtctacttgtgtagtgaacactcatggaaccatctgaacagtgtccattctcccctcatcgcaggaatagttctgccccactcagggacagcaccacctcagaatgaaccattttcctacctaactccatccccaggccacagttaattggtccaggcttgaagtggaccaatcacagtttttcatgaggatttttcaaacaggcgctgatgaagagctggccccagtgttggcatttctgagacgtaagctcaacaccagccacatctctcaccacgtggaagaagctagtctgcaacagagtgaagtaaacagaaaaggcaagagagccctgaaggtgcttgagtccttgattctacctgcgtcttatgtccagctaaatccctgcccactcctctctaatcaagggaccagaatacagtgatctatagctaagatctgcaagtgtttcttcccgcttatgatcaataagaatttcccttttgtagtgtccagcacatcatccattggccacccagcagaagtgataccgtctacatcccaaaacttattggtccctatcttaataaggggtcacaagtgctaccccacttccatatgtctccttgtgagatggtaacagccaggacattcaatagtgtgtgttaagggggaagaggtgtggagatatagacgtaccaatagtgagagggggctgaggctactacactatctactattgcaaattattgtaaactgaagtctctccctgagatggcacaggggtaaaatacacttctgttgcatgagcaattataaaaaatatgatttagaccatgaaatcataagcagagagaggaaattagtgctcctcaccacttgagggcccaaatgcatggcttgcatgttgcctgggctctctttacttgacagtgacctgggagttctctgggtatcatagagccagtgagcacagcatccaaacctgccgaaatccaatggaaaaggccttcatttaccaagctaacacaacttacatgagaaattatataactgaagttgaaaagatgcatttcagcaatcaggaagagccagaattagaaatcagactgttttttttttccagaagctgagaataagagaagttagctttagtaatatttaattctaaatcattcctatactaggaagctttgtataataatcctttaagagtttaaagaccatgagatttacccttcaagcagtgtaataggaaaatatttatctatatgcacaagagacgtaaatttgatgaaaaaatgatgttaattttaaaactattaaaagccagtttgctattatgattattttgcttcaagtatccaaatgatgatgagccaaatatgcccctgagcccagttcttgattcattccacgtcctataaagattctttagaaaaattgaacaagatgagaaatagggatcctggctcaacctcccagtgagttgggatttatctcatggaactttttcccaagcttgatgaagttctgctgtgccatatggacatgtacagttgctaaatgataattttccaaaaataagcttcaattctccaaaatggcagatagaaagcagctggtgttactcaacagagataagcctcctagagctcaccacagagaggagagcatcatgtctgcagatgccacagcagatctgctgagaatcagccagcgccatgtgacacaagaacccacagatgcggattcgtcctgactggtggctttcttctggccattgctgttacagagaagtttctaagcagtactcaatgcacacaaaactaagtagaggctatataggcaattcttcaaataagcaatcattattctcagtaattcttgtagtaagtggatggtaggaggaaaaaaaaaatacctttccactgatgatatcacctttatagctatttcttgagtctccctatcttttccaccttcttcaagaaatagtcccctattacaatttgcatgcccactcttgctgcagaatttgtataggggctcaactctcattattgccaactatatgatttggaccatggatgtgagaagacttcagcaaatcaatccatcacattcctctggctgcaatgagttgggcacataacctaaatgaacacaattatggtgaatttcctggttttgccaggagctatcagacaaaaagcttgttctttcccactctatagtggatgtgaggagttgttgtagccatttgtcactccaaaggagaggtggtgtttccagaagttgtcacagtgtgtacttataccataagtatggagccaacatagtgaaagactggacaaagaatggaaatgaatcaagtccttatgacatcattggagagttgactttttgtgctagaaatttgcactgtcctccagatctccctatcttaagcagttggggatgggttttctgtcaaaattatccacgagaatttaatcttctgcaaaattattatagttatcatttattgagttctgattataggacaggcatagaattctctgcttatatgcattatattatttaatcctcacaacacccagtcatgctatttctgttattatcctatgagacaaaaaaaaaaaacacagattttacataatcagtccaatgtaacatgactggtaaatgttggtgttgacatttgaaatcaggcattctgactccagaatctgtgctcttatttgctaagctatgttgctttcctctgctcctcacctctcccctgaccccccaaaaatggcattacaaaatatgagtcatgtaggtactttccaatatattatccaagcctatttattcaaaatcaatacagtaatattttactttgtctgaaaccgatctcactggatttcaagatagaattttaatagtctttgtccttgaaaattgggctcactaatggaaagcactaattgaccttaaaaagcataacactggattttacatttattgtaatgtgattttggatgagcttatattgggtctagcaaataaacaggctacaactgttaactgtcatagtaattagttaaatgctctggtcctttctgcagccaggaatttagatagcacttactaaatgggaggggaaaggaaattcctaaatttattttcatatcaaagttttaacttcttacagcctaacagaatgatgttctttaaaatatatatgttttaaagaaactacattatattctgagaaaaatttccttttaaggtgtgcagtacaggtttggcaacagattttggtgaagaatagaactggaataattaaaagtatgacttatttcaactgtgcacagagacccagaggataaagatgttatgatcataccatgagtcctaaggacagttgtagcagcatcattgaaaactacctcaacatggatgctatttaagaccttgagaggtaaggagagagttgcaacagaaaagataaaatatgcttactgcttcaccttttgcttctggctgcagaacaagtagaaaggagcaattacacccaaaacgttaaaaaaaaaaaaaaagcaattaggctaaaggctgaggaaatgatcataacatgatggaagttccagcagccaagatgaatcagaaagtagctatgtagcctatcatgataggaaagctgggcatagacatagatcagtgttttccaaccaagtgtgggccaggagtggtggctcacgcctgtaatcccagctactcatgaggctgaggcaggagaatcacttgaacctgttagatggaggttgcagttagccaagactgtgccactgcactccagcctgggcgacagaccaagactcagtctcaaaaaaaaaaaaaaaaaaaaaaaaaccccaaaaatggaaaaccaaccaagtgtgattggccaaatccccaggggacatttggccatgtctggaatcacttttggttgtcgcaacttgaaagaggagagtgccactggcacttagtaggtagaggccagggatgctgccaaacatcctgcaatgcacagaacagtcccacacaacaaagaactatctggtacaaaatatcaattgtgccaaggctgaggtccctggggtagatgaggaagggaagagcaccatgtgaatgctgcagtaaattgtgctaaataatgaagtgccagtctcccagttcttataacctctaaagtgtctctccctctctctttttcctgtgctcacactcactttctcagattgcattacatgtgaacttcatccaaatgacctaattcatggggaaattgtgttaaaaaaaattgggggggcaggcagtgtcatttctggggctaagtagacaagtctattaagcttctgcaaaaaaaaaaaaaaaaagtttattcactcattaacgttaggaacaaaggcagctggtagcatgggataaacctaaagggttataacccacttccatgggagacaaaatgaaggtgtgggttccagtgggaaactaatcctcagagaagacactaagtgcagaaataaaacatgtaagcatgtggtgctgctggctgctccaccaggacactctacagtatcttagcatttgctatgagtctgatgaaaatttttattgaacaaaatcaaaggtgtattttatttttactctaaatatttccataggggatttgagtggctttcaatgaaaagcacattaaaacagggtaatataaaagaaaccagacagatgaatcacaaaaaggaagaagcaaaaccattgactgtacagacaaaaaggtgttgtgacagataagaatattgggttcacaacttcttgcagccaggttgaaaaggcatcactaaaactccagttctttttatcaaaacaagtgcagaacaggtccccatatggagcagtcttttcgacattgaattcctaaggaaatttctcacgttggactgtggatagagacatagagtcacagagggatcgtttgtaagcatcattttttatttcagcctgattcttagttggttgttctcggaatgttcttcttaaaacccaagagcatgacaccaattcaatgaagcttggtgatgtaagggtatccagcactgtgagataagagtcacccaatggtgtacttgacaggcacagcaatgtccttatgatgtcaatggggacctctgggtccactgaaaccttagataagataggcttagactccctgaaacagtgcaagatctccagaaatttccacagaagcctgaggagcttatgtgttcgtggtctcctttagtttttgccatctgcttttccagttcagtttagagattatgatctcactactccacactgtaagatgccatattattccatggctgtaagatgccgtattccatgtgaaacagctccaattacacacacacacacacacacacacactcaacagcacactaacatgctatgtcattagggattacctttgattcaaaaagtcctttgtcccttggaacatttctcctctggactccatgcagtcccagacttcactccatctcacagatcattcccttccttctctgcatcctttccttttttatcaccaactcccttgaagaagtaaatccactttgtatttcctcacccctagcaccctagccattcgtctcattaactactcccttctgaatgtcacacatcctttctttcctgcaaagtttcctcttctcccacaaacagactttcaggatattttcttagagaaattccaggccacactatgcagataatgaattcttcacctcgtcactatcaatccaatggttctcaaatagtagtacccagtgctaatggtgggaagcaaaaaattcctcaaggaatgaagtgtcttcatattttgatttattaagaatccttgctccatcaaaccccatgttttcctgcctatctgatgcatcacctcctgctgcttctatttgacagggacgacccaatggttcacgtgtggcagggcccctgtgccctgtgtgagcattcaccctgaaggcatgctcatggggctcatccaatggatgtttttaagtccaacaaccttctcaacttttttcttatcaaattcaattaacacatcactggacttagtttttatgttctc

SEQ ID NO: 407 - DNA, 164397 bp, Homo sapiens
ggcatgatctcagctcactgcaacctccacctcccgggttcaagcaattctcccacctcaacctcctgagtatctgggactacaagccctcaccaccacgcccagctaatttttgtacttttagtagagacagggtttcaccatttctcaccatgttggccaggctggtctcgaactcctggcctcaagtgatccacccacttcggcctcccaaagtgctgggattacaggtgtgagccaccacgcctggctggcttatgatttctttatgatggatgaagtgagatagccttgtgttctcccaagtaacacacacatgtatgcacacacaggcatgcacatgcattcacatgtgtgtgcatctgcagagggccagacttatcttgaatgacccttgggaatctgggtcttccacatatgagttttctcctcctttgaactccaaatctagtcttttgaatatgcttcagcatgattgttagggaaatggggggcagtgcctctcctgtgcttggccctatgttcagtctgcacatggaaggtggtgtgggattagaggaaatggcccagaaggctgtagtcttttagctaaaggttccagtggcaggtatcccagaactttgaggtcaaaggaggttttgtttagctcagcaaatatctcctgggaaaaactttccccaggcttgatttcatactgacctcaaatgacttgaatcagacatgcaggaattatagctacaacagagcagttaagattacagcatgcttcagaaaaagataagtaaacacagtttttatgtcacttgcatcttcctccatacctgcttggtgactttgcacctgggctatgtgatagccttttcctgcctgcagcactcaggaatcacaagcctcccagaaccacagaaactttttatctttgaagtctgtgctgaattctagggtcctctcctgctgcagccactgtaggacccattcaggacacttgtgacagagcacggcttctcagtgtgcacacagagattgtgctccattcccttcttttctcctttctgcttttcaagggaaaagactgacacctgagcataggcatcttcacagatggagggtggaaatttatacacattctgcattttctggtcatgttcctctctgtcctctgggtcctctaagggtcttaggaaaggtgggtgccctactttctgagatgctcctagctagggtcttcctccaccctcatcccctctcgggctggttccagggccaggttcacccatcctgggggtctgggggtccaaggatggacttcttgggagagcaaaggggtcaagcctagttgctagttgcacagattgttgaagttggaagggccttaaactacttttggttctagcctctcatttgacagaaaaggcttcgaagggtgcccttcacaacccaaggaagtggctgaaagggccttgggatctactctgaggttgcctcgtcccacttctgtgacttggtttaggaactttctgagctttggttttctcctccatgcattgaagatgatacctactgcctagttttcttgtggggtcagtgataatccagacattctacaggggagaaattagcaggtgttctgttaaacttagctcttctagtctctcccttcttatttttcttatgatacccaattctccacatagatcatcttccccactaggctataaattcctggagatcagggaccccataaaattcaccttgggtttctcagcacctggggacagtgtctggcatctaccagtgaggtttcaaataacttgtattgtgcaacctgtcagagcacgaatgtccccaggagactagacaacggccctcggggaaggccccacagctggcaagtctgggacctcacagccagtttcctgccgttggtccctttcacagaagcacaggagccgtaaggttcatgggacttttatttttactgtttattttttgaaagccagtgaggatgggcaagtgcttggtcccttctgggctgcattcctatctaagaccagccctcacccgcctcccccagcccaccccctacctgccagcagctcagatcacccgggtgaaaaataccaccctgttggccagcgtccctgtcagcaccagctccagtgccaggccgcaaggcgatctgaggaaaggaagggccgtgattcccagcaggccgtggttcagccccttcctggcatcctccacccagccggaggggctgtccttctcccttcctgccttgttggaggggtgccgttctggggtctttcccagcccttcctttcctccccaggtgggatgctttttctctctgggtgggcctgtccttatatcagcaccaaatgatgcccaggtgggtggcccttgggcacaccgtccccgcctcccctctccctgcaccctccccttttccccggctgtcaggatgaggagggcacagcggtctcagaggtattgaccctgagggtaaatcggagaaaggaggccagggggatttccgcagctcaggggccgtcatcctgcagtgtcaggggcattttttctccactgggatgtcccacttcccctcctggaggcagatttcctgcagcctgggttaggtgctcagctctggcccctccagtgggacccttcctgtgcacaggtctgaggagtgcacctggccactcacctgtcttttcttctgcagccagcagctggcttggggcccaagactctggacttctgactccccagccagctgcctccctccctgggaagtcctgcccactccccccgccccaacagctggatcacagtggcatgtctgggaccccacagccagtttcttggctgcagagcctggtcattttagtcctctgtccacttgtgaatctgcagaactggcaggcgaggcccgaggaggtgcaaggggcagcggcttccaggtctcaggagtgctgtgcctccctcctggcctcctcctcccttagctaggatgcctgtcccctttccctccttttcctcctcctcccccgcctcccctcctcctcccctgcacctgctgctcctcctccacgcgcccctcatccaaagaaagactcagtccctgcgcccccaggagcgtggggaaggggaggggaaggtaggctcctcggcgtccccccgcaggctgcagccaggatcccgggcctggacggcgggcgtcagacgctgtgcgctcccaggctgagcaccgagaaggcggcgcggtgcttgcgcagcagcaggcggatcttctcgtcgtccgagtcggggtccagcggcttgttgtactcgtcgtcctcgttctccgagggtgcgcggtccccgcctgcgcctgcacccgcgccgcccggggcccggggcgtggaggacgagggctccagggcgctcttcttccgccacttggtcctgcggttctggaaccacacctgcgatgagaaagaatgtgaagggcacaggggcacagcgcgcacgggacgcgagaacagccatcctgcttttacagctaaacaaatggctcaacaacggagtgactgtcacattcacgtttctgttggggaaggacaataaaatttaaaaacgtgagcgcggcagccctcccctccgccccccgcccccaccatttgcttcctcttccaccgccgcctcctccccctctccctccccctccccctcccctccccctccccctccccctcctcctccttctcctcctcctcctcctcctccacctgggaactcggtggaagatgcggagtgcgcgggtggaaggcttagccccggtgctcattggaaggtgcttatgagcagtccctactctgggcttcatagaccctcaccctacttcataaataattgttcccctagttagttagaaaagtaacgtaggtccattgcttgggatagttgaagagggcaggaacgcaccccagaagcagaaagacatgcaggagtgtctgcttcttccccccagctctcgccccagggcagctgagcggctgatgaggagggcgcagcgggttggagctcggggaggccccagggccctgagcaaagcctagacccaggtgccagctgcccctgctgcatccttaggcccgtcgccgagtcactgagccagcatcaaagtggggaaagttgcccccagactctaaggcggtagaaaccggtttccccgggtctatttagggggcatttggggcccctgcgtgtggagtgggagagcctgggctcaccctccctagccctggcgtgggcgacaaggctccaggcccctgaagcccatctgatcctgcttagtagaaggagacgttgtcttcatcttaaggattggtaaactgaggtcagctccttttgctgactggagcatcaagcatgaatctgggccagagactgccgaccgtgcttggaatttttggccaaatacggggggagagggaaagcctcaggttggagtcccccacatctggggttgaaccccagctctgccagctctcccagctctcccagccgggagacactgatcttcatctgcgaaatgggtgatgataccgaccccccgggttgctgagaggatgaaatgaggtgccgcacataaggctctgagaatggggctcagcctttcccggctatggttaattaccacaggctccagggttaggcaggcaggcagtgcccagacaccaggacagctgccctctggggggctgcgttgtgtggccacctctctccaacgcagtggcctcctgtccggcaggctcctccctgcagggcaggtgccatctcccgcacagacttaccttgacctgcgactcggtcatgcccagtgagtatgccagccgtgccctctcggggccagccaagtacttggtctgctcaaaggttttctccagggcaaagatctggtgccccgtgaaggtgggccgggtgtgcttcttcttgtgtatgctgtcactcagggggtctggggctggcaggaggaaggaagtgtggggttagtagaataagtggggaccctgcggctaggcacgtctggcagggcaaccaccatgcctgcccctctccctcctgcagaggtttccaggacaccaagattcctttcccctgagcagcattcttgatattggggaacagtgactgtgacctctgccccgcctggatgggcagggctccgagagggcagctgccctagtgtaatgggacttaggggcagcagagcctcatgcctctctgtctaaagttctcaatactcgctgatgttgccttcccctgaggggcaacaggagttccctctctgtcccagggatgtcccttcaggtcaccctcctcctataattagggaccagggcctgtgaattccctccacccccggcttccgccaacttccttgctcttgagactcaacttcccaggtctccaggaaaccagggaggggcaaacctgacgccccaagctgccacttccccatgtcaccaggcctggaagttatgtggcttcaaccaccctggagagcctggcacagaggccagagaccctgacccccagcctggccagggcagcaggctcgggaaggagctgtgggcagtggttcccacatgtcaggcctcgttctgtgcagtctgacagctcaagttacaggtgaggaaactgaggcacagagagaggaagagccctcctgagagatcatgttcaagtctctctgcctttgccttcattagccactgactttcttggctatgtccctgtgtgtgtacctgcattcaggactgaagaggtggtgtgtgggatgtggagaggggagggggagatggagggaagagagagtcagctgaggcttaaagcacccctgaagccaagcctaaaacaggatctgagagaggaggccttcacccccaggggcacagcgatgggtggcagcccatggaggggtggctgtcaggcactgtgaccggcaaggcagagtagcaaatggggggacaggtgtgcttttggggttccctaggttggccccaagcccccattggcgtaggagagcccggagatcagacagaaatggaggcccctgcctgacgtgggcagggcttcggtggcacggagaagattccaaaaactctcacctccctgcctcccagcagagcctcacctgccctgccacctcctccagtaaccctgactggcatcacgggcccaccctctgaaaaccttggctgagggatgggtcggctgagaagaggccccctgcttccccacagccaaggccaagttcagctggactcagcagcaactccccgagacaggctacttggtgtggctgctgttgctagaaacccgaggatgtggtgggcaacagccccctggctcaaaggctggacccggatggggtcagggtgcgttctgcacccttgagtgatgccagggctctctgggaaggtgagctaggacattttcctcacgggggtagcatttgcctgctttgggtgaagaagtggttgcatgggccctgggctgcagaagccagctgggctgcctactggacctcgtgcagggcaggcgtgggctgtggggccttctctacatctggaactgccgggggccctaggagggcagctgaggtggctggcatgtgaggggggtggctcagacacctgtgtccaagcactgctggatgggaaggaggagagggtggaactcagcctgcactgagctgaggctacgagtccaggggttaatggcgactgggggagagggcggaggtgcagggtgcccgggaggaggcccctcctcgtcctctgccccccggggcctggcgggtgccgggaggtggctggggaggacccgtactcactgttgctgcactgccgcccgcctcgccagtcttggcccgtgtccgcccagcagttccgggtccgggtcgggtactcgttcccagccttggaaaaattccctacctgggggctgtagtagaccccctgcgagctgagccccccaaagcctgccacgtgggggtagccggagaggaggctgttgttcggcgcagccacgggcctgctcaggatgtccgtgatcccgtggggggttccggcggccagctgggggcccagccctggggggctgagcttgtagaaggagttctgcacagagtactggcacaccggggccttcatctccggaaactgagccagcggcgtgttgttcagcaggaacgtcccctgcaggttggactccatgatctcccagtcaggacagggaaggcttctccaggcccctaaaacccaagagcccactctctagccccaaatctcatggcaggcctggaggcttaggaccgtctccgagctcctgactgcctcccacctaaggcatgggccaggccctggcccaggaaccggcacccgatcagctgctcggaagtcaggtgctcggggcaggtgggaggcctccccagggctcctggcctctctccttgccctggccggacagggtggccccctaagcctcagctcagaccccctttctgcctctgagtcgggggaccctccatgagaagttttaagttcagagaaggaacatttccctgataaagatacggcccattagaatacaggccggagactggctgagccgccggagccgcgccgccattggtcggggcgcacacgggcctcacattggcttttcctagacaaattgcactttgaaagattgactgtacaatcagccagggtgtgtgtgtgtgtgtgtgcgcgcgcgcgcgcgcgcgcgcgtgtgtgtgtgtgtgtatgcgcgcgcgcgcgagagagagacagagaattagctctagaagccctactcatcgccggagggtccatttgctccccgcaagtctagcatctaggaaaaggtgagcgtctgggggcccctggaggctcccaaggcaattggaagtcactgttcctacagctgctcccctagggaagaggaggctggactcagaggccactgtccggagctgcgccggcccctttatgtgcacatgtccaagctccacaggagaacgcagccgcttccttcccttccgcatgcggggatggggtaagtggcataagatgggggtaagtgcggggatggggtaagaggctgagtggcattgctttctgggggatgcaagtccctgtggctggcttgagagcctagggtgggagcctgctgggaagagggcagcgcggggcgtaggcagccctgacagtgccggggtgtgagtcctccaactgcaggaggctgaagagagggccgccctgcacgcatgttcttgcctccacctctggtcggccttccgtgacctccctatcagaatctcttcctcatttgtgcctctgctggagcaatggccatgctctgtctggcgtggtgcccgggtttgaaatccctgatggctgagagggtggtggagccccgtgccgggcactccgtcggtgctcagttagtagttgatgcagtggactgggctgaatcacagaacatgcatatgcttttttttttctcgaataaatttttacaacatacaaggctctattgggggaagctctcattttacaaacaggaaaaccaaggtatagaggaattggagcccactttccaggtacatgggtgatttctggaccaggcaggattcttccctgcagtttttctctaaaactggaaactagcatgccactggcctgaacatgtaaaatgctaggaaagactgtgactgccagacagatggacttctgctcctctctgtgcctggtggccccagagcccttcctgaccaggcgtgggctctgcagggcttgctctctcactccccagaggccgccctggtaggtgggagactagaggcactgcttcactgagcttctcctgggtttccaggccgtcttggttttcagtggggagcagaggacccaaggctcagggcaggattccttctcatgcagaagttgaccctctgtagcacagggatttaggttatgcaagaaagatctcacaaagggtgtggaatgattccctacaaatttggtttaaagagaaaagagctacgtcttcgtctgagatggctttgccaccaggtcgcgtgccacagccatctggtagacctggttctggttcccggtgtcaccacccaattccccccaggcaactgtgattctgaaactgcatttttaaaagccccatgggtgctgcagatgacctgctgcggttgcccactggcctgaacggcctgtccgattccaggagagaggctgggagtggggtggggctggggtgctccaggggccttgggattgtgactccgtcatcccctcatgatgggaatttatgtggcaggaaagccgcagccaatgatttgattcttaattaatgccaagcctgacaaaggcgttggtgtctggcgcccctaggatgagaaactgaagagactttagcaaccacctaatccattctcccattagagagatgaggaaactgaggtcagcttggtgaccagccttgcaggaagtgttagcaactagttaggaatagggcaattttttccctacagcaagaacaagttcttgaactttgaatggcattgagtactggggccagatgccttcctagggaatgctggggggccccctcagtgcatgccagctgggggcctggccaagaaccctggtgggttgtggtggcccctccccagacccccaacttctccccatctcatgggagccatcaggtggaacagaaagctactctgccacctctctggaggcatctctcaggtgggtggtcctgattaaagggttgtccaggcttctgggaggactgggcattggcgggctctctgggacctgagccccacccatagactccttcacatcacaacccaggctttacgctggcctcagcacccctaaccccccaaagacgagcgggaaggagagatagagccctgtgccattagtccatttctttattaattttgacattggttcggctggtgaagggagaatggtctatacatcagagtagggtaggggattctctcccataacagagcatgtgggagagtcaagaaaagatccattttcataacaattaaaaaaatcaaggtaatttcaaaacttctaaaaagcgtctaatgtgcagactgcagcattctctaggcatcgtgtggagaccccaaactcctcccctaacggctcctactagcagccggagcgtgcagccatgccagccggagcagaggtgccaaagcggagtctggagctgcggggtccgcgggggcgctaagggggctactgggttggctgcagcagcgacctgggagaggaaggtgcaggatcgaggcgggagaggcgagccctgagcccagcttccttgggccgtcaccgaatcggtcccagccgcgctgtgcggcccccctgccgtggcccccgggatgggggaggatggaggggggcgcctctgcgccctggaggccgggccggggtggcctctggcggagacggcagccgtccgggctcgccctgcagctcctccgacgcagcctcggggaaactcaggcccggagctagagcttcctctccctgcccgcccctctaaaggaagcaaaagcagccccacccccggccgacaaggcgcctaggccgccccggggcctgcctggccgggggtgcaccggggcggatttgtgtgggaagcagggcccctctccgctcacaggccccgcggccagggggcctctgacgtggagggggcttctgtgctacttggaaggtttaagtgtgtcccgaggacactcccgcagagcggcggggcggacggggccgggccgtccacaccgcggctccaggggcgagaggagccagccctgtctctctctcctggccctgggggcgcccgccgcgagggcggggccgggattgtgctgattctggcctccctgggccggaggctctagtggaacttaaggctcctccctgatggcaccgaggcgaggaactgccagctgtctgtctccttcctgccttgacccagagcctggccccggcctctgggcgtccaggctctccgcctccgactctactctcaccggccatgcggtccggggagccccctggctcgcctctccaagaggccacaggggctgggcagaggggaggcactgaggcaggacagggaacagcctcgagcctggcacctgcacccagggtccccagcctgcaggctgcctggacttagagcaccaagttcactctgggagaccctgggtggtcctgacttctaagacctggcagatacattcactagccctactcctttccttcctctttcactgaaagacaggccacagctccttctcctgcagccgcagaagtcctcaggagctgcgctgtcaggctctgtacgtactgctaaatgtttctattggtttgcatagtatttattgtttttcatatacacaaggctgattactgtacagtttacactttgaacacggactatgatatagtgcttgaagacatagaaaacctcttctctatggacatgctggtgcaatcctgggtcagccaccggcctgtcccccaactgagagaggagaccctttcagatggggtcctggctccctttgagtcctacaggtaagcctgggggtcctcgcctcagattcttaagtccctaacacaaggaaccccgaatgcactcttcaaggtaatgattttccattggaagatgattcgtattgaaattggcagagagagagacaacataaaaaattccaatttatccacagcagagtctatacagcttcagaagtcacagtaaaatctgtgtgtagattcagtggaggcgagtggtgtgtgtgtgtgtgtgtgtgtgtcctgaatgtcatgtagagcgatctgggaggagcgtcaccagggagtcgagggggtgtcacaagtggaatggaggtatgtgggttggggagggtgggcagatgaggacatggcttaagattaaggtgttaaactgatttcatgcctagttttcttttttttttttttctttccaggaagcccacatggatttctgacagatgaggttgggaaaaagtaccctgtacgaagtcaaaacaatttaaaaaaaaaaccccaaaaccaaaacccatccccagccacaaaaagccctcattcacttttgcgttcgcaggctctcctgcgcttgttttctatccctctctctccccgcttcttgctgcttttgtgtcctggttccgacagatcagctgtcattgcaagaggcaggattgaagcctggaggtcatgcgtctacagtcagtcattcatgccaagaggggactagcaggagtcccttacagaggtcatgccgtcagcccagaggaatgtgtgcaccgctgcggtggccctcaggtccagctctcctcctgtgtgcatggcagagtgtgtggggttcaggggttgggtgtcgaggtgtgatcctgggagacacaaagagagaaggagtcacttagaatgcaaaagtgcaacgtccagcaaaaaccccacacacagagttttgtgctggcagctcaggccgaatctgactcaggaaaagcagtctccccaggcagggcgatgtgctgagggtgctgcacttgcagcccgacttcctgagatgccgccctccttctcttgctccctatgcagaggctgttcctcagagccgccacccaggcctcatgaattccttctgagtgtgcaagtgttccaggatgcctctctgtatgggccaaggagagcactgtgctctgtgcccttggagaggggcagaggcccccgtgcctacgtggtcacctggggagacatcccccagcagatccttgtacttaggaagagccatttttcttgagccagggcttgtgccaagaaggggctaggtgaggctaggtgaggccttcactttctcagttcagctctgccaacatgcactgatgtccgccatgcgccagccttgggaacccagggatggagcggatgtgctccctggccttgggagctcatgcctcaagggtgacagctccccttcagctctggcccacagcacttcctgaccgctgcctctggctgctctccccatgcccctcagatggacagagatctctgaaaagcagatgcatcctcctctcctcctcctgtattgagtcttaggctggaaaagagcagctttgctggaggaactaagcccacattcttcagcctgggattcgcagtgagaaacctctcctgcccccatggggcctccagcctccaacctggggtgaaaactccatgttttcaagaccagccactcatgttctatctgcaggggccctgggaccactggggaaaggaggatgcttcaataaggaggaggtgacaatctcttgggcagggtgggaagtgacacagggaggcaggagctcattcggaggtggagccatccccagacatagagctgttttgggtcctccaggtgaaggggttggggaggagtgttggaagggagtagggagaactcagctcttgggtggttccccagggatgggagggtggtgccaggttccttgccaggggctgctgtagaactgtaaagccaggaactgctgctgcagtgggtggacagtgctgccaccgtagagggaagatgctttcatcactgctgggccatcacatcggccaagtctgactgtctcctctaagcctctgaacacgctctaccctcctgttctctgccttcggtcacgcttctgtcaaggctgccttccattctcttttctgcagaggttctgcctgccgccctcaacacctccaccccacaaaaccttcctgatccttcctggagcaggcccctctccactctggaagctctcccttttgtattttgtaaaaatacaaaatacaaaaaagaaaaaagctgccttttctgttcaggagatggcagagtcgagtgggtaagagcatgaactctggagccagaccacccgggttcaagtcccatgctgcctgacctcggtcaagtgccttacctgctctgtgagtcagttttctctgctgtaaaatgagggcagtaatagggcctacccattagagaggtgtgatgtttaaaaaagctaagacacataggtgcttagcattgtatgaatgcaaacaattacttggctctctagaaatgttaccgtctctgtccatctgtgctttttgatgtctgcatatttccctgactagattagaaacactgagggcaagaacagcctcctggtgctccccacggtgcctgccccaagaagtgctcctcaaataagagaccatcatggaatatgcagcctgggaaagacaggctaggatctcccatctactttaccgcccaggcactgagcagaagagaaagttcagacctcagagatcatgctggcatgactgcccatttcatcccttggtaaactgagactctagaggcacagtggcaagagcaggggtgagatgaggacctaggccacctcactctgcccaggactcctgcattgttctggcctcttctcctgggtcccctcacctttcaaaagcttagaaaagagtctctttcattctttatttttatttcatttagagacagagtcttgccctgttgcccaggctagcgtgcagtggtataatcatagctcactgcagccttgaactcctgggctcaagcgatcctcccacctcagtttcccaagaaactggaactacaggtgtatgccaccatgtccagctaatttttaaactttttttgtagagacagggtcctaccacattgcccaggctcatctcaaattatcctcctgcctcagcctcccaaagtgctgggattacaggcatgagtcactatgcccggccctagacagccctttcacaaacataaactcagcaaccatcataaccatcctacaagggaaatgctggcattattgctagtttatggctaaggaacctgaggcttagggaagtcatttgacttgctccgagtcacactacaaacaagacctgcaattgtttgagtcccagagcatatatgttcttatttactctcttcacatcagtgctcacagttaccattattatttctaaacctttttcttgaagtgtagcacattcgaaagggacattttcatcctcccttgaggagactgaagcttagggcggttaaatgacttaaggccatacaacctggaagcaggaggaggccttgattctagactcacaagctccagctttcactctctgaaacaaatacagccatttgccatagctctgttctataaattagtcgctgtttgaggctgtgcacagtggctcatgcctgtaatcccagcactttgggaggctgaggagggcgggttgcttgaggtgaggagctcgagacgagcctgaccaacatggtgaaaccccgtctctactaaaaatacaaaaattagccaagggtggtggcacatgcctgtaatcccagctactcaggaggctgaggcaggaagatcacttgaacccgggagatggaggttgcagtgagccgagatagtgccactgcactccagcctgggcgacagagcgagactccctctcaaaatataaataaataaataaataaataaataaataaataaatagtcgctgtgaacacggaattagcaaatactgaaccactgctcctaagggaaatacaaggttaggctcccatgagcctctggccacaatattttggtcaactgatgaatacataactttgtgttaaatgcgtttctgtttcaagacgccttatgtaatatatagggttgactcattaacactgacttcaccaccacaagcactctaactcatccctgagcagagcttatctgatgtccattccctccttaaggaacatcccagccttcttgcacttcgcaccagacagcacttcagcactgccctcaggggccattctaaacaatgaaaccaaaaatgtgaaaaatgtggcactacacaagctgcaaggaggacacttatttatagtatgaggcacagaggcagagtgtggcattgttcatcctcagctgggattgcacgggttgggcgactcaaactttctgcccttgtgtgtgtgtccatgaatgagccaaagcacggtgagtgccagctttggggctacagataaatgttagcgagtggacgaattcgcaaatgcagaatccgtgaatgatgaggatcgactgtacatgcttgtcggggatgcggatagtaaattaggaagcctttgggccctcaaccgtcttctctgtagcctttgccctggttgggagggtagggcatttaatgctgtcccctaaccctctgggactttggcaggagcttttctccgcctctccctcaccactgctctcgccccaccgccccacccccctgccaccctcacacttgtccctgtgcctgtcactgacagagggccaagtgctgtcccagagccaggctgctccgtgtttctgacacccatgctagtgtggtccggtccttaatcacctgaggttggggggcttcagccacattgcagatcacttacggcaaattaaaatgaaattcaaggctccctccttccccctagcctggctttcgggctgcctctctcccactcaggagcatccatagagcctgagccaaagagaaatttaaagccacagccgccactgctaccataagaaaaataagtcagaaaagtgtacttttcctttccctttgctgcttttaaacattatttgcatctttgggttctttccaggacccaacagcagctactcagagtcttctaaaccagcagcctagtgggacccctggcagtgcaggggttaacacggtgacctccttaagctgctgaggtgtcaggtctaattttatcctataactggatctgccagtcctcttttttgcccaagtgctgagatatattgggaagcccagagtcagcacttttggtggctcaggaggcagcgggccctgatttttgccgaatgcagaaagctagagcctccttgctgctcggtcccagagtcaggccctggggtgtgaatggtaacggcctggttagtgctgcactggggccaccatgccccctcacctcctgctgactcccaccccgagtatcctgtactgagctgccccgagctgggcagcatgaagggcctcggggcagctcagtacaggatgccccagggaggatggagatcagagccggccgctgaagcccccagcaccacacacacctgctggagatggtcgcacagcgtcttcatgtcccttcctcatggcacggcacggcacggcatgcccctgctctgtggccacactgccccatgctcacacacatgcaccacagcccaggccccggccccaaccctgacggtctcctgacttgcagaaagcacgtcgtccaccccttaggcctgtcggctcagccctttcctagaaagcaagggagcaacgtgtttcacaaaacaccaaagagaagctaagccttggcctggtgagaactgtagctgggctccaggttcaagagacagtccagtcctcagtcttggagctcttatgttgaagcatcacagcccagaccaactctcctgtcctcttcaatgccctgtccactgctttctagatccccattgcttggtttccaagataatattaccacttagatttacagagtgcttttacttttcaaagagcatttttttctttctggcttttttttttcttttttttgtgatggggtcttgctctgttgcccaggctggtcttgaactcctggcctaaagcaatccttttgcctcgacctcacaaaatgctgggattacagacatgagccactgtgcccggcccaaaaggcattcttacaaaaccgtgcggtccctgataagtggatattattaactctgtttccttgatgaggaagctggggttcagagccaactgttagcagggttgggaagtgagaatctctgcctcgagacacaacaacaagttgtttgtcccacatcatgctggggtggctgggaggggatagggtgagacagggagcagccactccactgaagaccaggccatgcagaggggatgagaagggcagcgttacctcccgagaggctactccaaggagagcggctcggggtcactgtttcccccttttcaggctggcccgcttcactatctgcgcccccttcctgccctctatcaggtccggctgtaggccactccctctcagctccacctgcagacagcagcagagacagaaagcaggacagatcgcaaagacgggcagaacacaggcagaagatcgaaaggaggccacacggaggtggcagacacactgcccaccagggagaagagagactggagagagagctcataaagaggtgagtggagggaggtgtcatgcagacggcccggcagagcaaggcagcagtgatggcgctgggtcccccagggccgcgggcgcctcagtaccttggagtgtttcataaagtaatcaatatcgacctccagctcactgggatcctccaggggcccctctacagtcacctcctcgtgctcctgggcggcatcggcgctggacaagtctatctgtcgaaccaccttgcgaatgatctaggaaaggaagggaaggaggaaagggctggtcaggccgggctcgggggctcatgtctgtaatctcagcactttgggaggctgacgtgcagatcatctgaggtcaggagtttgagaccagcctggccaacatggtgaaaccctgtctctactaaaaatacaaaaattagcccggtgtggtggcaggtgcctgtaatcccagctactcaggaggctgtggcaggagaatcacttgaacctggtggatggaggttgcagtgagctgagattgcatcactgcactccagcctggttgacagagcaacactctgtgtcaaaaaaaaaaaggcgggggggctggtcaagccctcaagacagagcttcagaacagcagttcccaggaatgagctccgagggggaggtagcttttgtcctaggagcccctccttgagaggccaagaagagggacagcctttgccccattgcttaatggaaaaccctctgctagacagccctgaaggggccttggcagtgtcatttcatgaccaaggtgtgactgggtgtgacctccccctcgagcccacagccttctgttttgctttttgatatggatgggagtttgtgctcttccccattctactcccatgagcctaagggcagagggcatctctttttcacccacccattcccgtattcacctgtccaaatcttcaaaccctttactctgtatctgccgtgtgctctgagtgggaggtgaaacatcagtgagacactgtccctgcctgcaagcagctcacagtgcaggaggcaagacagacgcacaaggagccttgctcaagggtgatgagagctgcgcctaagcagaagcacattcgagatcctgcctcagctcctcctctattttacccatagctagcaccgtgccccacacttgacaggcaaggtcatgtctctgagttaatatctgctaccaatccaatgcattttcacttccttttaattatttaattattgtgatggggtctcactctgtcacccaggctggagtgcagtggctcaatcatagcttatgcagacttgaactgctgggtttaagtgatccttctgcctcagcttcctgagtagctgtgactacaggcatgcgccaccatgcctggctaattttgtgtgtgtgtgtgtctctctctctctctctgtgtgtgtgtgtgtgtgtgtgtgtgtatttatttattttttaaaattttttttagagatggagtcttgccatattgcccaggctggtctaaatgtctgggctcaagcgatcctcctgccttggcctcccaaagtgctgggatcacaggtgtgagccagcacacccggcccacattctttttatttgaggaggcccatggtaggccagggatgctcaaactgcttgtttaacagctgttttcagggttaggcatcatgggactaggtctgggatgtttcctgggggctggcccttctggaaaagagcagcagaagctattcaggttgactcagacaaagcggttgtgaggacaccatgactggactgcagatgaccaaagctcccagctcctgggccctccatccctcctgagcacgggggcagccagcctggctgtgctcacctgctgtgagggcagcagggagaagccactggcttctaccaccttttagcttctagcccacctgcctctccccagcacagaggggaacactctgcacccaccttcttggtgacaatgttgccctgctcatccgtgaattgctcctctgtcacctgctcccctggaatattctgaaactcattcccctggaattagagaaagggagaaaatgcaagattggtgagtgggagtctgggaggaagggtggaggacgaggaaatgaaacagcagtagccacaatagccatggcccaataactcccccagcaggaaacccggctcagcatgtagcaggagccatgccagggctcccagggcgtgggcggcgcccctgagggtctgggaggcctgaagacgaacggtcgagctcacaattgtgcacttggccctcacaacaccccctgggaacctgcaaaatgggggcaattatgcaagtctgacggaggaggccctgagagaggaagtgaggcacctgtttcctatttttacagcactttgcagtatagaaaagcccttcgacaggcagcatcacccagaatgtgacttgcttgaaaccccagagccagttggtgacagaaacaggacgatccgggtgcaatcccatggtggctcacgcctgctatcccagcactttgggaggccaaggccggaggaccacttgagcccaggagttcaagaccaatttgggcaacatagcgagcccccatctctacaaaaatttttttaaaatagccaggcatggtggtgtgtgcctgtagtaccagctactcagaaggctgaggcaggaggatcacttgagcccaggaatttacagtaagcccaggttacagtgagccatgagcatgccactgcactccagcctggactaaacagcaagacttcatctctaaaaacaaaagaaaaaagagaagagaagagagagaaagaagaaagaaacaaagaaagaaacaggatgagcgcagcctcccgagacccaaagctgagtgtttaatgtcactgtcacaatgcactgggcaccagagggcaggttctggtgggcgcacacacactctggctcccagggtggaacatgatccctgggggcctcctggtccttttcctccggcgtctcccaactctgggtccggagctccccacagcagcgtcccctcagccccggcctccggcgcccacaccaccagccctgccggcctcctgccaggcggttaccttcaggaagacccgccgccggaccaccctggtggagatggtctcctcgtcgtcactgaggccctcgctctcccccagctccttgtccagctcctggtggatgtgctttagcacaaagcacagggaccccctgacaatgtgcatcacgttctgacagctgaccaggaagaagctcagcagcaccagcgtgaccaacagctgggtgacgaaagtccacatcctcgcctcctcaccagcccggtcctctggcagccagggccccggccaccacggggggcctgcctctcattctccactgggactcctgagtcccccagggaccccttgcattccccctccctatctctctggtttgctctcttggtctctcactgtttctctctctgtgggcaggacaccgaatggccctctcggctgaagcagcccggcccaagtgcccttctgcccagcagccaggctctgccctgagtggcccgggtgacatcacgctcctataattttacctccccaaaccagctgccggagctgtccaaccgggctagaaggaagccggcaggtgcccatgtcctgagcactgaaagcacaagtgaaagtcactgtgtgagtgacacccgctgctgcctaaccccgccctgcccagagacctggaagtgggggctcggcctctcacctatcctgcccatccccatgggaactagaaagagttctgcccagggaaagtttcttactttcagaaaataatacagtccgagaaagcagctacttgtgtgtctccttgggctgctactgcggtgatccaaatgctgttccccggcatggtagggatgagaccagctaataccctgggtacttagcggtctgtttcaaaaattgctccaaaagggtgagtgatgggctcagggacagtcaagtgagcccagcaggggcccagcacaggtggtggggccacctggaagccggtctgtaattcctgtcagcccacaggcccttgcacccttcctttatggggtacagcctcccaaaactgaagcatggagctggtgtgtctatttaaggcctgttcttaaaggctcttccagggctgggctatcaacgcccactgagcaggaacaacgcgtattaaacttgtatttacagagctgattcacaaatgtagccgcagcagctgcggctggaaaaaatttcactttctagatcaggttgttcctctctgagtggcaatgcagcatggcagaaagaacacagatctgggacacagcagactaaccctgcaactcacctactgtggggtcttgggaaggctggggaccttctctgtgcctcagtttcctcatctgtgaagcacggattaaagtgctctccccaccctttctcaaggctgctgggacaatcatgccgcttatgaatgctaacactatgaatgataatggcaaacgcttgtgatagtgcatggttctatgtggatttcgcattaattcactgacacctcaccacagtcctaaccaaggaggttctatcgtcttcccattttacacaaaggaaacagaagcaaagtattctgcctaggtggaggagtaagtaaacggaggagtcacattccaaatgcctctcactccacaatgctgcttatttcaacaagaaagcacggggaaaagtatgtgcaaagaagccggggaagcatctggttttggcccagtcaagaagagtccaacttcagatatttcctcctaagtcctcagagaaatcagctgggtcacagtcatttcaggccacctcccaagtcccaagttacatgcaatctctctatctccatcactgttttcagaggtccagtggaaatactaataagtgggtgctttgcaaaccatcaatcaccttcaagggcatccttatcagccctcggggcctgtgagatgggcaccggcagcagcctgccaggccctctgatcggcgtctccagttccaggctgggcatgctggccttgcacgtgcatgctggacgtgaggatgtagggcttgggaactgagggatctggaccctcctggtccctgacattggtccactgtgtgaccctggagaaagcccttggctcctctggtccacagtgccctcatttataattgagggagttggatgtgtgatctagaaggcccttccagttcccctcaccaaaggctgaccacagaggggcagtggaaaaaagtgctgtaggcgtctttctctttccccagggattcaggagaagagacccagttaagatcatgtgtgctctgggagcaggagaactaggcgcccaggagggcctgatggaagaaacggacgggccgcctgtggtgaggagtgcacacaggcgctggccctgcccggggcacatacttggcaggggagcattctaaataaaacctgactgaattcctagcagttctatggctggcagctcagggccttccttccagagccaccctagtcctggagtctaaggttgaggtaggaaagaagggagacaaggaaagaaagagaggaaggagaggagaggaggaagcaccatgcctggatgaggcgtgaaaacagagacagaacatgtcgttcatgtacatactaaacacacgcatgtggagaacagtggtgcatgttttataagaacacaaatggaaaagacacccattaatacgatggccaggatatgcttccaaataatagtcagtgggagaaagtggggggtgcagatgaaacaagattggccacgagtagatcatcatggggcctgggaatggggaagggggattgaatcgaacaaaataaagttcaacaaactcgaagggaatccggggaagtggaagaaaggagggagggccaggagagggagaggcctgggaaatcaggagcaggagaggagacttctctctatcccagggcccctcttctacttggtgaccgccatccagagtccacgtgaatagccacagaattccagagccaagtaactttggcgacattccaatcactccctcctttaccagtgaggaccctgaggtgctgggaagagagcgccttgggcacgtcacccaggtcaccataggaggagagtaagcccaacgcccagtgctcggttcctagccctttctaaaacgcgacagaacaagaaaaccaacaaaagccacaactttggagtcagcgagacccagcttagagcccacttctgaaactgtgatcttgagcaagttgctcagccactctgatcagcagctgcccaacaggtacaggcgccttagcagggatccaggaggcagaaaggcaggccttgcccttgacttctagagaaacggaagcaccaccacaagtgttaaaggaaggggatatgcttagctcagggcttgagtgcctgagaggcagccctggagtcccggccccttccgatgctgggaaggaacagcagcacgcagctcccctcgggctctcacctgcaccacttgggtgaaggtgttcttggcctcctgcacctgctcttcttggccttgctgcctccggtccctgtcggcctgggagctctcagcctcgggctgttctgtccacgtgtgctcacttacagacaccaggaccttctcgtactcctgagatccaccgggctctagcccttcagtcatggtacttgttccctggaatgagtgtggaccttgcgtgacctcctcttgccaggaaccttgtgcagcatcttgcaggtatgagacaatcgagccgtctgcatcccagtcctgcagtctggggtccagaagaagcagcagatggccggccggggagagagaaaagacacctggtcacccatcagtctcattccttttagacactctccccacccagagctctggctcatcaaggacacagaccgtcctcccatccctccaaaggtcaggggcgcatgagcacattgctcacctcactgctgtggttcagaggggtacacgtggcccatctaatgctgtccaggtggaaaggccactggtccctccctgtgggtgaacagcttgcccttggggctcccagagcacttggctcaccctaatggtccaaacactggggcctccacactctcatcccacatcctcaaactctgccaccacctccttctgctctccaggcccttcccactcagcagtcctcatctgacaaggtggtcattctctccccctcaagacacattctcccgtggctcctggaaggtgctagcctggcgtctcccccttcctctctggccgctgttgttccatgtcctctgcttgttcctcctagctttcctgacttctgaacataggagcaccccggggtgcagttctcagacctcaccgctgtccacatccacttcctaagcaagctcattcatcccatggttccaaagcccatctctacactcagcgtgcctggatgtgtgtctccagcttggctctcctcctagacctacagctgtgtgcaccccgctgcctcctccacatctttactttgttgttgttttctgagacagggcttcattctgtctcccgggctgcagtgcagtggtacaatcacagctcactgcagctctgcactcctgggctcaggcgatcctcctgcctcagccacttgagtagctgggactgcaggcacacgccaccacgtccagctatttaaaaaattttgtagagatgggttctggctcacaggtctactttggatctctacttggcatctccaggacagtgcgatccaatccacactcaaaatcttctcccctagcctgtcccaccccatccctgctgccatccctggtatcttcatccttgcagtgggcaggtcgaggacaccactgccctccttgacccctctcttcctctcttaccccacattgtatttgttagcagatgcttctgaaatatgccctgcacccgcccacctctcagcacggccaccgctgccgtcccagcccacaagcccacggccctttcctcccgacacacctcctgcttctctgccaggttgcgccagcctcctctcaaggcaggtgcagcttaccctgctcaccattccctccctagcttcatgggcttggttactctgttagggcacgtgccaggcacggtctccttcaaagggctaggccttctgtggggcatcctccctgagatgtcctcaccctcaccctcaattccttgaagtctctcagctggcactcatgcaggcctcccctggccacccatctgtaattccagtcagccttctttccacacacacgcctacctcctgtcctccttctctgcttgatttttctttttagcacgtattatctagaatttctgttttaatgacttctaattttatttactttatcttgtttctagttagtttccctgctagaaccacgcttcttgcaggtagagacttttttctgtttcattcaatgctggcacccaggcactctttattggtgcctggcacacagtaggcactcaataaatattgttgagtaagtggatgaaattcatctgtccccatgagaaggctgaccaaggtcacagcaccaggaagtgacaaaataggcctagagcccaggcgttcatgaacccagttagcaacactgctgcggtaatgcaggggccagcatgcagcccctgcaggtgctcaataaatgcttgttgaaggaatggccgtcccaggaaggtgtctctctcccgggaaggccactatttcactttaaaccagcctaagctccatctgttcaatcctccccatgaatccaaagatttgtgtaggaaaaaaaattaaatctttgctgtctcaacttccaaacgacttcctttcccttcctgttagggtattggggccaggctgcatggatcctgtggaatggccccactagcctgggcctcagggtgggactgaggggtcacacaggtgggactgaggggtcacacaggtggggaaaggacatgagaacagctttcctttacctgaccagtcctgagctccttggggtgggggcctggaacagctgcctgggggcacaagaaccatgtccttactttagggaaaactcagcaagccaaggtgacctggaggaaaggggattcctctgtcatccgcttcctgtgctagcccaggaggacaacgtgagccccatctcatgtctgtctcatctctttctacaatggcaagggcctggcttgtcttggcatccttccctgcactcagcggaggggcatggtgtaggccctggcccagatgggacgatgagagctccaaggtgagccggtcctcggccgcagacttgcagtgtctgggaaatgcatcaccttctcctgacctgccgacgctgcttttctgctgcggcacagggcgggggcttctcagtgcgggaagcgtggggaagagagcacccactgctctacagctgaaagctccgtcctgccccagttaagcccaccagcccctccttcaaagggggtaagtggggagggcgccattatcagctccgtcacatgcaggctgtgtgactgcacacaaataacttccctgggtactggtgcttctaaatatggtcttcaactaaatatggccttcaaccggaagcacgcaaggggagaggagctccgaacgccagctccagcagcagctgacccacggtcttccccagcctcatgattgctcttttaagtgagccatcctggtgctctaatgtccctaagtgagcccttcccgtgcactaatggctctaagtgagcactccaggtaccctaatgtccctaagtgagctctcccggcaccccgatgtccctaagtgagacctcccggcaccccgatgtccctaagtgagccctcccagcaccccgatgtccctaagtgagccctcccggcgccccgatgtccctaagtgagtcttcccggcgccccgatgtcctaagtaagccctcccagtgccctaatgtccctaagtgagccctcccagtgccctaatgtccctaagtgagcactccaggcaccctaatgtccctaagtgagtcctcccggtgccccgatgtcctaagtgagccctcccagcgccccgatgtccctgagtcctcccggtgccccgatgtcctaagtgagccctcccagtgccctaatgtccctaagtgagccctcccagtgccctcatgtccctaagtgagcactccaggcaccctaatgtccctaagtgagccctcccagtgccctcatgtctctaagtgagctctcccggtgccctaatgtccctaagtgagccctcccggcgcccatatgtccctatgtgtgctctcccagtgctcctcggggtctctcctgccgggcatacctggtggggtcttggggaggcactggcttttgcagatggcacctatgctcttatatatggcatctgccagactgaatgtatgtgctcctgtgcaattagaacccagggtcagggttggcatcgacacctctgtcctcactgccaggcataatcttacccaggagcccagaagacaaaaagggaccctgctcccacagtcaagctcttacctgtcctgactcctctccgtcacctgactcacggtgggggaatgtgtgattcgggcttgccccctctgatggcctgaaacaagagacacttcattctctgagtcctgccctgcacctgtcgcgtcatcctgcctcttagaacctggcagcttctcttctgacctctgaccttcctcctgttcaagcaaatcgataaggccatttgtggcatctgaatccactgtgtcgtcctccacaagttccagagagcccaactcggggccccgcggttcctctgagagtgccccctccaacttccactcgtgacctgtggcatcagagtcctcagccttgctacactccagagaggagtcctcagcagtgaccagagaaggcgtgaggcccgcagaccacacctgcatgtcagacatctccagcatggtgtcatgctccgtggccgccaaggggatggcgtctaggacggccacctcattccagtactggtctgcacgtagcggagaggaaagtgcacagcccagggaggcaggggacagcagctcgtcctgcagtgaggagtaacctggatgggcagacagagggcaacatgctccagcagtgattcctgtcccacccattcacgtgcaggtccacgcacacgcacgaacacacacatgcgggtgcggccacagagatgcatgcacattcggggtgggttgggggctttccaagctccaggcccaatgctcaggccttgtggctgctgcctgggcatccaggcaagagaagcaaggctctgaattgggtgggggcagccagggtgtgaggcagagatgggggagcgccctgctggatggcgaagaggagattggactttcttatccagttcagagcactagataaagaagcctttatccaaaggacttgtgctccaatctgtctctgatcccatgaaagctccacttctccatggctgggcagaagtagacgttgctcctctactcaaaacttcactttagcttagctcttaggttctcagggatgtaccttaaagggaaggaaaggccacccagaaccaggggtagtaaccaggctgcccttgaggggcctatcagggtacactaaacacccatagacctcactgtggtggtcaaatgggaaacaaccttctggtgtggccaggcatcactttcctcaagttgcctattggttccagaaactctgcatgatctaaagtgctacaggggagggctcttagggctcaaaaggggcaaggtcagaaggcaccaagaggcaccaggtctgcccgccccaaaaccctgtgtccaagagccctgagctgcttgtcccagctgcaggtcagcaccgacctggtgggatgggagccagcttgctcaggccctgagtgcatgacccgtgcattgacaggaaaaagaggactctgatgccccttcagagcaggtgcctctgtgggtgggagaagagactagaagacaagattctccaatgggcttggcctgtctaggaaatcaggaagcaagtacgtgcttacagcagctggaaagcccacagagctgaagggggaccctgggaatgggcagggctgccccttgcagtctctagggaccttcctgccatcgagagatgtccagacacccccagcctagagttcaaacctagttcaaatgctccattctgccattcagcccctacccccactcctactcacatgcaactgcccccgggctgtgctttgattcaagccaggcgggctcctttcttgccccctcagcctccgctcggggcctcagcctccgctcggggcctcagctcctgatcacctgctcccctgcttttacatcactagctccatttattctcatccactcactgttcaaccaaaataagagaggtccgattacatgccaggcactgtgctatgggaatggggatgacaaaccccaaacacacatgcacacacacacactcacacactctctctcacccacacactcacagatgggacagcttcttgtctcatggcattttcccagcttcagctcctgttgctccctcccatctctgaggctgtcctagggtccctcgctaaggcggttctcagaaatgcaaacccatgaggacagggctgatgcctgccttcctcgccccaccctttcctacaacaggattgggcctccactagccccatgaccactgaagagctctccaggtgtgtgagaggacccagcagctggaacagaaagacctcaggcacattcagtggaactgcaattgctaacatgtacctgtgtgttcaacgtgcccggagccatgctgtgtactccgcatgcattctcttaatctcccagggaagttttcttccctgcaagcctacttggttccaggtcccaaatgagcggggaggatgagcccgtgaaggtggggtggttgggagaagggctgcacagcggcagagactgagggaaaccccttttagctctggccaaactaggaagaacaaggaggaaggagtgggaagagtaggtgaaatgggtgggtcacatcttaccatgaactgaactccaagtcactgtacatgaaactgtgacttgaggaattatatagctgaccagggccatggccttcaaacccttcatagaaaaccctccacatatacaaaagcaggacattttggggtcaactgatgattatttttcttattactcttgcgagcattttatattatttacatcagttactgagcattttgttgttttttaaagcagagtcttgctctgttgcccaggctggagtgcagtaatgcaatctcagttcactgtaacctctgccttctaggttcaagtgattctcctgccttagcctctccactgggagtagctgggattacaggtatgcgccatgacgcctggccaatttttgtatttttagtagagatggggtttcaccctgttggccaggctggtctcgaactgctgacctcaagtgattcgcttgcctcagcctcccaaagtgctgggattacagggttgagtcactgagcccggccactgagcgtatttttagtgcaaaacatatctaacatgtttttaattgccacaacaaccacatgaggaaaataatataattcctactttatagattaggaaactacaggtttagcaacttgcggaaggccatacagctagtaagtttggtcttttccatagactttgccattaatctctattaaaaatagctttgttgaggtatgtttgacattcaataaatgtgtatctttaaaagggggtaaattgatacgttgtgacacatgtgtacccccatgaagccatcacttcaaagaagaaaaaggacatttgtcaccccagaaaggtctcctcaagcttctttgtaatctctccctgccctttccccctctgccaaccccaaaccattcccaggtgaccccgatctgctttttgccactacacatcagtttgcatttcccaggattttacataaacggattcatacagtatgcactctctctttctttaaagcctggcttctttcactcaacgtagtcaatttgggtttcatccatgctgatgcatgtatcaataatttatttctgttgctaagccatagccctttggaaggatatatcacagtttgtaaatttatttacctgccaatggacatttgggctgcttccagtttgtggctattacaagtaaagatgctagtctgtatggacataatgctttcttttctcttgggtaaatagctaggaatggaatgacttgattgtacagtaggtatatgtttaactttgtcagaaatgatcaagtggttgtaccattttgcattcccaccagtggtgtatgagagttccagttcccccatatcctcaccaacacttgatatggccagcctttttaattttaaccattcttttaggtatgtggtggtacctccttatagttttaatttgtatttcccaaatcactaatgatgttgagcatattttcatgtgcttatttgccatgtgtatatattctgggtgaaaagtctgttcgaatctattgctcaatctaaaaactgagttgttttcttattattaagttttgagagttctttgtatattccaatactatagcagatgattatttgccaatattttctcccagtctgtagctcgtcttttcattttcttaacagtgtattttgaagagcagaagttttgattttgatgaagcccaacttgtcaatttgttcttttatggattgtgcttttggtgttgtatctgagaaatctttgccttaaccaagatctttaaggtttttttcttatgttttcttctagaagttttatagttgtagatattacatttaatctatgacccatttagagttgatttttgtatacaaggtaataatccaagttcatttcagtttagattttttgcataaatgttcataaatgatattggtttgcagttttcttgttaattgtctttcttcccaatatcagggtaatgctggcctcataaacttaattgagaagtattttctcattttcaattttctaaacaagttgtttcttccttaaatgtttggtagaattcaccagtgaagccatctgggcatggacttttctttgtaggaatgttccaaaccatacatttaatgtctttcatttatatggggctatatctatttcttcctaagtgagctttgatagtttgtgtctttcaaggaatttgttgatttcacctgttttccaatttactggcacaaaattgtcataatatccctttattgtccttttactacctatagaatctgtagatattctataggtagtatatattccttattcctgatattggtaatctgcaggtcttctcttttttcataatcagtctggctagaggtttatcaatgttattgatcttttcaaatcaccagcttttggtttcattaagtttctccaagtttttctgctttctgtgtcactgatttccactctgatctttattatttcctttattctatgattttgggtttaatttactcttctttttctaatttcttaaggtagaaaagtctttattttgctttcatttttgaagttacgtgtgctaggtatagaagtctaggttactttggagatgttatttctttcttctttaaagatgtggcatactttaaagatgccacaccatgttctggcttctgttgtttctttttttccctttttctttgttttttttttttgagacaggatttcactcccgttgcccaggctggagtgcaatggtgcaatcttggttcactgcaacctctgcctcctgggctcaagcgattctcctgcctcagccttctgagtagctaaaagtacaggcacgcaccaccatacacggctaatttttgtattttttgtagagatggagtttcaccctgttgcccaggctggtctcgaactcctgatctcaagtgatccacccacctcgacctcccaaagtgccaggattacaagcgtgaaccactgcacctggccttggcttgtgttgtttctaataagaaatctgatgtgaatcttattttggttcccttgtacataacacatttttttccctctgattgcttttaagatttttctcttcaccactggttttgaccagtctgctaataatgtgccctgatagagttgctcacgtgtttcctgtgcatgcagttcatcaaacttgttggatctatgtcttcatgatttttatcaaatttggcaagtttctgtccatatttctttttttttctttttctttttttttgcgttgagaactctgtcacccagactggaatgcagtaatgtaatctcggtccactgcaacctccacctcctgggttcaagcgattctcctgcctcagcctctcaagtagctgggactacagtcatgcaccagcatgcctggctaacttttgtaatttttttagtggagacagggtttcactatgttggccaggctggtctcgaacttctgacctcaagtgatccgcccacctgggcctccaaaagtgctggggttacagacataagccactgtgcccagccccaaatttcttacaatactttttcttccttcttttctgttgggaactgtaatttcacatattaggtcacttgaaattgccccatagctcactttgtgtttctccaaaacagaaagaaaagaaaaatgtttggagtttctcttgctgtattgtcaagttcactaatcttttcttctgcagtgtctaatgtctaatcccatccagtgtattgatcctacacattcatctctagaagattggcttgggcctttaaaaaatatcttccatgtctctacttagcttttttgaatacctgaaatacagttacaatcaccgttttagtatctttgctaattctttttttgtttgtttgtttgttttgagacagagtctcgcttttgttgcctaggctggaatgcaatgacactatctcggctcactgccacctccgcctcctgagttcaagtgattgtcctgcctcagcctcctgagtagctgggattataggcgcctgccacctcacccagctaatttttttgtatttttagtagagacagggtttcaccatgttggccaggctggtctcaaactcctgacctcaggtgatccgcccacctcggcctcccaaaatgctgggattacaggcatgagccaccatgcccagtcctttgtctgctaattctaacatctttgtcaactctgggtcagtttcaatggatcgatttttctccgcattatggatcctgttttcctgcctctttgtgtgtctgattacttttaattggatgctggacattgcgaattttaccttgtggagtgctggatgtttttgtatccgtgtatgcttgagctttgttctgttacgcagttaagttacttggaagtagtttgatccttttgcattttgctttcaaattttatcagggaggactggagctttgggggttaatttttccctatttgtgagatgagatccttctttgtcccctgaacaaaggccgtgagagatcaattgggaatagctggctaatactcatctgaaacttgtgggggactccagagtgttctatctgtgcaactgtctcctctctggtgctctgtcttgagaactccagctgtcttggtcttcctggactttcttttttttttttttttttttttgagacagagtctcactctgtggcccaggcgggagtgcagtggcgcaatctcggctcactgcaagctccgcctcccgggttcacgccattctcctgcctcagcctcccgagtagctgggactacaggcgcccaccatcacgccaggctaattttttttgtatttttagtagagacggggtttcaccgtgttagccaggatggtctcgatctcctgacctcgtgatccgcccacctcggcctcccaaagtgctgggattacaagcgtgagccaccgcgcccggccttcctggactttcaaaatggtaaactagacagctgtagggctcacttcatttatttcccatgctttgtggatcagtgtcctttgttatttgatatccaatgtcttgaaaactgttgtctcatatagtgtgtccattttttggtctgcagtagtttcaagcaggagggtatattcagtccctgttatcctgtcttggccagaagtggcacacatcgcacctgacacagctccttggatttggctggatgaacattccatcactccttggaattgcgatgagacttgagaactgggagagggcagctttgcgccacagaacacttgaggctcattcatggattccttttgtgagtttcccaccttgagacttccacggcatttgctttagtggaatttcacccaaataaagatgtaaggggccgggcacagtggctcatgcctataatcccagcacttagggaggctgaggcaggtggatcacctgaggtcaggagtttgagaccagcctggccaacatggtgagatccccgtctctactaaaatataaaaattatctgggtatggtggcgggcacctgtagtcccagctactcgagaggctgaggcaggagaatcacttgaacccgggaggcagagaggttgcagtgagctgagatcgcaccattgcactccagccagggcaacaagggtgaaactctatctcaaaaaaaaaaaaaaaaaaagtatggatacagagagcacatgtaccacctctgcaggaagtccctacttgtcttcactctgggagtccttccctggtaacagcatttagggtacatgcccagctgctccctctcccagccatgctggctgagatccaaggccacaggtagctagctgtattgctggtgctggtgggagtcactatgaagctgcagcaatacttgcagaagcacaagtgcatcctcatgaggaacatctcacaggtctggggtggaccagaccataggcagatccactggatcccccagggtgagttccagaatgtctgtctctctggtagtctcatgcagccccaccacacctgggtcaccagcccctccctcagtctagaggcctcctcttggggctacatgttggagaagtcaggtaaaaggcagccacacatattggtttggggcagcatacagtcaagtggtccctgctcattccaggtcactgccctggttctgtgctgacccagaggtaataatcgtcctgctagcttaacgtcagcagcaaatgggcaacaggggtcatcagacagcctcaccctagacaaggccacacttcactagccacagttgtgaagaattgagggaaataaaacaagttttatttccaagtagacattagtttgtgtctgatttatcaggtcaaatggaactcacacgggtgtgagatgatcatttctcctctcataagggaagtctgttttattttcagaaacatgctattttattttggatctataggccatgctttcttcatgtttattcccagggcctgggccgtcctctcctatgtgggagaagcacgctggccttttggcctgagcccctctgctctggccaattaaggcactggtggtgagcagagctatgaagggagagacagcctcaggcttctaattcctggacaccacccacttatgtcgtgctcacagagctgcctatcactacccagagtcccagggcctcagaaggaggctcagacatgcagagggaccaggaaaagcacagaggagccaaggtccgactgtgggcatcagtgcattgggctggttgggcaccaggtcaggccatcacgagccctgcccagggaagagcagagaagctgcagagcctgtagtgcccccccaccccccttagacctctgactgtcctgccaccttctctccagaacacaagggcacccagatgagggccagactttctggggcaaggaagaaggcaggaaaaatataaagaagctgattctggacaaagcagggcatcggtgcatgagtctgctggggcacagagctgggtctaccggggacctgccagagagggtgtcagggactgctgaggctgcacagagcagccaggaagcacagaacattcgactgtgaccatctgaaatcaactactcgggagagggctccctcaaagacttaagggcaatcatgccactctttggccagaaccctctgatggctttccagcttactccaagtcaaacccaatgtcctcatgacagtctatgggtgggctccgtgtcacccctccagcccccacacctgccctctctcccactgtccctttgcccccgcctccagccccgtcctgtgaacgcatcaggaaagcccccttcacactccctgctctgaaatcttccacctcagtgccgacgcatggctcccacctcatctctggcaagtcctcgagtgccacccgcttcccttgcaccatgagtccccctggccccgactccggtctgtttctcctgcaccatgcacgttaactgctggtgtgtgatacaattccccgcgtggctctcctcacaggagggaaaagctccacaaaggcagagttttgttttgttttgtctggttgagaacaggtatctctctcctgcctagcacagtgcctggcatgtggttgatacttgaaaaatatttgccaaatgggctgaccccctgaagcagagccctttcagcagacatggagtgcacaggcccagtcccacacaggaattgagaaccactcgggcaagaatgcctcaaggcctggtgggagctaggggtctgtggcccggggagatgctcacagatgcccaggtctgtaactgtgaatattcacactcatgtggctctggtggcccattgtcctgtaggtgcttaatcagggcacaggaaatcaaaagcgtgcccctctgacttgaccaaaagtatgcgctgggtgtcaaagaagtctcgacacatgggaagggagaggagctttgtcactagaatttccccaggtttgtggcttccctcaaccgccctcagcccactgagctcctgtaaagctctggccaggtcccctgaggggaggctggaatccccaagggggtggacctggggagtgggccgggcacacgcagcaggcagcaccacacagcaacacccacggacacacacacacatgtatgcacacgcacacacatgaacacgtgcacacacacacacatgcacgcacacatgcacacacatacgcacacacacaagtacacccaggacatggccatgagatgcgtggggagacagggctgggggccatgacatgcatgtggacgtggccggctctgcgcctgccgaaatggggacagtggagacagtggagacaggcagcacgatagcgtgagtgcacagaggtcaagatgaggtcagaggcagaagagaggcaatgggacgtgatcagcagatgggccctgctcccaggatgcaagatggcacacttcaggagacacaggatgcagagcaggggacagggagggctcagcgagcagggtcccctggtaggggctccgtgcccaggcccacctgggactcgccctcagccgcgcccccaaactgtgtacccagtcacaggtgcccaccctcagcctgggcgtggcggggatggcccctaagacaaggagcttgaggagcatacacatcaccatgcaggcatccagggtgacgcgtcagccacctgaggaagccacgtcacagacatggaaattttgtttcaaggtctgtaaggaattttagggatccaatccaacttgctgattttacagaaggggagagggctcagtcatgcagggagttggcaggaaggaagggcctagaacccagacctcctggccggagagtggggcctcgctgtttatgtgcccgctggccagagagggggcgggcgaggaaggtgttgcgagggggcctggcccaggagtggcaggggcttgggggcagaggtcacagcctcctgtacatcctctccttgggctggatctcacgggggatccctgccatgctgagtcacatcaacaaagaatgaggggaaggagatgagatgatagaaaagggggagaggaaaaagcagagagacccggctccaggaagagcaaactgctcagtccctagaagtggccacagcaggatttgtaaaacaccgtccagttaaactgcactagaccttgggccaggaatctccatgccctctgcttcccaaccactgactgttttacagatggggacactgacaccccaaagagggcccacgccttgcaaagagctaccggaaagtctgcagctgtgtaggggcagtctctagctagaggcctctgactcagctttttctcatacaccacgccctgtggggacgcagttgctgatggcaagggcctgggggccattctgcagggctgcaaaggctaaggcggaggcgatgcccacctgcacaggagcagccatctctctctccttcgcctctgcttccccggaaaggaggaacttgttgctgacaaaccagacctcccaccaatgggaggcagagcgggctttgagggatgacgtattgtgggaaggggttattggtgctgatgcctgtagggcagggctccggctcagtccccatctggtccaggtgacactcaccattcatctgggagggtgacagcgagtagtcgcggtcggtgtgccgcctgtctggcttcaagttgcggctctgtcggccggaaccctccagcatgttcacgatctcgccacggtcaatgctctgcagggctgtgtacagattctccactgtgggcgcagaagagagatgcacgttactccaggccggtgagcgaggatcacatgggctcagaaaatggggccaggatgaagatggagaaaggagataatttttttcagaaggtggaggcaccctcttttattagagtcaaaacaaacttcctctggggagaatactttttacacttcagcagatcttttccaaatgctaacagtgcgcagttattttatttattggtctctgttaccaaaaaaaaaataaattattttatttattggtctcactctgtcacccaggctggagtgcaatggggcaatctcggctcactgtccacctcccaggctcaagcaattctcgttcctcagcctcccgagtagctgggattacaggtgcatgccaccacgccctgctaatttttgtacttttagtagagacaaggttttgccatgttggccaggctggtctcgaactcctgacttcaagtgatctacctgccttggcctcccaaagtgctgggattataggcatgagccaccgtgcccaccacagtggccaatttaaaagtctagaaagactgtttttttattattattttgtaagctaagaggagcactacaagaaaataaggatgagaatgattagattctgtccttttgaaattcttggtccttgccagatgatttgagatgcaaatgtaaacactcaatttccacttagtgtttttgagtctgggaaactggttgaggaggagctgaaaagagaatgaggcaaagctccctccaggttggaggaagctcctgggagaatgagaactggttcagactggggtccagctcacccagactgtgtcctgagaggacaatactcatttgcttgggaaattcaacaggaagacctcaaagatgagtcatacaccctgcacagatgttgtcatctaggagtcctgatgcaatttttatgttattttttttagagtcaggattttgcttgttgcccaggctggagtgcagcagtgcaactgtagctcactcagccttgacctcccaggctcaagtgatcctcctgcctcagcctccagagtagttgggactacaggtgtgtgccaccacacctggctaattttgaaaggactatgttacacagtctgttctcgaactcctaggctcaagccaccctcccaccttggcctcccaaagtgtggggactacaggcatgagccactgtgccaggccttgcaatttttatcttattccaaggatgtgagaaaggctgaggccaagcttctctggtcatgccttctggcaggactgcctggaagacctcctgatgcgagtggtgcgtgagtgtgtgtgagagagacagagacagactgactccagaggccagtgtcatgaatggaatttgaaggaagaactagtttggtggggaggaggtcctaggacaggcttcctcagtgggacggtactgactgtttgcgttttggccttcacggatgacccagaggttcagcaaggccacactctgctccaacagggagttgggattttccactcggatcctgttgatgtcttccacactgaactgcagctcccgggccaactctgcaagcaaagaaccaacagcagatgtgagcctccagctcaccaacagcagggggcctccagcacacaggctgggtgggcactggggcgtggggggacccagtggggagcacagggagctctgaggcagcctccctgtgggtttggtcttccttcttatcaagaaattccttatgaaatgccagcacctatacctttatgtccccagaaaatggaagaatgggaggggtgtttgttaaataggtcctgaatgaatgaatgatcaaatgtcctttcttcctttcgtaacttccaatatgagatgacatgaactctcagcaaggtcagcaacttctgcaaggtcacagagccagcaagtccctgagccaggaggcagccgtacctgccgattctcaccccagcactgcctgggccacgccatgccctactgccaagaaccaatgagaacagaaatggactcctgagcttatgcgtcttcagggagaggctttatttacatttaaaatgaaaatacaagttcccatctaaatgcaaggcaataatgcagactgttagccaaaatcccccattatttttattgttattgctttagaaggaaaatagcattagagtctaatttcaaggatgaagaagactggggagaaagtgatggtgagaatcagaacacgcacatacaacacaaacgtgcacacactcacaacacatacacgtgcatacacacatgcacacacacgccccctgagcagccagcagtcatgattaaaagaaggagccgtgactgaacttctgagtttgtcacacggcctttccacaagtcattgccaaaaggtttctgagtgtgtctaaagtgttctccaggggaagtgaatgaagggagtccactcatataaaagctaacaaaaaataaggaggggaaggggaagccatctcagtgtcaacaagaattgagcaccgggctctggacagaaatacggttataattaagcattcaccaagctgcgcttgggtcctcttctttgttgctcaaagccacacagtgctggatactgaccactcgcacccccattgttcctaaagacagggtttctgacattaggcttctgtttaaggatcccttaagatggttttcagattcccaattccagcaaccactttgaaggcagggatcagcacgagaacgtagcttcttgctctccctgtccatgactccaccctgcactctccaaccaatcaaccacctacacactccagccactccaaagcccttaacagcccgagccctgaactcctccttggggagacggatttgaggtttcctcctccctccttgtttggtggtcctgggattaagcctctttcaccgctgcaaccccgtgtctccgtgtgtcttgacttgccactcacattgggcaatggacctgctgtggttacacagggagaatccagttctagggtctgtggttgggcacagcacattctgagccttcactttatttgcccacctgtctcccttaaaataagatctaccctgatggttggcaggacttctgtgagatccagccacagccacagaccatagcgaaatatgttgagacttgccctttccttccctccttttcaaggtctcctgtaaactcaaaagctgagtctttcttagaaaggaaagtcagacagagatggaggcagggggctcccccttcatgggcagccaatggtgtggcttgggcagcagacccagctcagacaatcacaaatcagataacccacgggtgataaaaggagggttagaaatgcctcattcattgctcattacaggggaagagggtaggtgagatggacaaagtgcttttctgcccccaattccccactcacctgcccagctgagaccgaggtgctctgagataacagccatcttcatctctgcctgctctgtcccactgagagaacctggggagaagcattagatttcatttagtagccagggcaggacacagttgacaggcctgaggacacggcctgtgatggatgtggcttccgtgtgcactggggtgattgtctagactctctgcaagatcaggggaagacccgagtcagctctgcagctgcttttggaactggctgagcgagcggcacctcagcagaaccctcacagggctgcggggagatgagctcacgcccacccttcttgggaagggagcaagcatgcatcatcacacagaggccgtacctggtgtggactcactgagaatgctgtatcgcagggccaggggcgtcggggtccttctcctatcttcggctccacttccctgcagaagaagaaagggtgctttgggttttggactctccccaccttcccagagaaagtgatctgagctcctatgctgcaggggtgtggaaggctgaccccagtcctggtaaacaatcagtccgtttcttcagggacttaacacaaagagtaacacatgggaggagtgggagtgaagggaagctgaagaagcgcacatgcgttattaatcacagtcgtaataacggcaagcccacgtcaccccatcacctgtgaggccctatttaatgttcacggcaacctaagaggtgggtgctgtattactcccatttcatcaatacgtaaactgaggcatagagagacaaagttccttgcccaagatcacccagttaatatgcaatggagctggggttgaacttaaaatgattgtttttctttttggatttctttctgcttgaaagacccgtttctgtactgccttaaggccttaacatcacagccctgtggaaaagcatccgaacatttgcccaaggctgcagaaaaatattctctctctctttttttttaagagccagggtctcactctgtctctgaagctggagtgcagtgcgatggcacgatcatggctccactgcagcctcaaactcccggcctcaagtgatccttctgcctcagcctctcgagtgccaggactacaggtgcatgccaccatgcccagctaatttttcatttttttttttttgtacagacaggatctcactatgttgcccaggctagtcttgaactcctgggctcaagcaatcccttgccccagcctcccaaagcactggggttacaggcatgagcctctgcgcccagcctgaaaatcctcttttgaaaaagaagttggttcaccctcatctcatgcccaaaaagaaaagagagattgagccatggacttatgaatgtaaccttgcttctttcctagtttagcatggaaggctaatgattaaaacaacaacagcagcaaaacaacagcaacgaaaaccacagagacggtctggagacgtatgatccctccaaagtccccagcagaggtggtgactgggatactcttacaggtatcgacaaatgaacatacgtggccaagactcctttgctgagctcaaaaccctgggtgtttgcagtggctgaggacaccaggcttcccttctgtgagggcctagcaccctgggaagataagcaggtagatgaaaaagcggcctgagagaagccgtgcaggggctgggagaccttagcagctctccttggtgtgaacctcagaggcctcgggccagggacaccgaggcagatgcccttagggccccttgtcactttcacacctagggagcccagggtccacagcgtgaatgtgcccatcaccatctgataccaacatttgttcttcctgtcccatgaccagcactgcactgcaaattgcagagagggccagggcatggtctccccgccaggccacaacatgagcatgtggaggagagctcagcacctttgcatgcctcgggggactctaagcttccaccaggaagaagccccttggaagtgctggacctggggtctgtttggggacctcctacagggaagccgtctcgggccaaggctcctcggcaggtgccagctcaccttggcgcaggggggcatggtgatgttcaggtggcagagaatgtgctgggtgtcctcgtacttcatcgccttgcgcagaaacgacagggaccctcccggctctcgactgctgtccctcacctaaactcaatcacacaaaggagaattcaggggcccttttctaggccacccggctgtctggtttagggaattctgcctccccaactttctagacccagaggagaactcagccagagggtgccggcacctttacaggcatggccagacggttctcccgaaatgactggaagtggaagctccgctgctgggcagctttcttcacaggcaccaggttcccagagagttctgcaaacagggacattccttccaacacctgcaggagaggaaaagcagatacagcttgtcagggagagaagggcccagatgtccctccttccaccttcggtccttccctctccaagacacaccctgcctcagcaagaggcatgcgggtgtgtgctgagaaatccactgtttgttttgggaaaggctttatttccaaaattgtgatcaatgaggcatgcttcccgacttcaacagattttgtaatatgtagggatcttcaaatatccctgagatgttgatgggaattgctatcaagtattccaaaacttcacttgaatatcataacatagcttctgaaaacaacaacaacaacaacaaaccctggttctgggctgggcatggtggctcacgcctgtaatccctccactttagaaggccaaagtgggaagattgcttaagttcaggagtttgagaccagcctgggcaacataggagatcctcatctttacaaatttttttaaaaaaactagccaggtgtggtggcatgtgcctgtagtcccagctacttgggatgctgaggcaggaggatcactggaggccaggagtttaaggctgcagtgggctatgatgtcacaactgcactccagcctgggcaacagactgagatcctgtttctaaaaataaaaccaaggttctgtttttatgtctgtccaaagatgctttgttcatgacaagagctggaaagcacttgctctgttttaatctcactcattgttatgggtgagctttcaactgagaagttatcactaactcatttgacagttgaaaaaattgaggctgaaagagaaaaaccggtttgcctcgttagtgcctaagacaggattagaaccaaggttatagtcctgcacttgttctctggggccctcagccttccccaggaaaactcagtgcagattctgaggattagatcactgctggcttactacacatcttaacccaagtgggtctcttaggatcggtaactggttcagacctagcccccatgccttcactcttcacattatctgtcgagccctttcctctgcctcctcacctgggtgctactgaaaccctagcacagcaggttataatgtagactctggggccagagatgacctggataaatcccatctccaccactcacttagctgtgtgaccattggcaagttacttaacctctcagcctcagtttcttaatacacaaataagggataataaaggtacccataaatatgagaattaaatgagaatatgcaagaaaagcacttttagttatttatttaatagagatggtgtctcactacgttgtccagactggtctcaaactcctgggctcaaagcgatcctcctgcctcagccttccaaagtgttgggattataggcgtgagcctctgagcctggccagcacttttatttgtttgttttttgttttgtttcctgcccccaccaccatactcagctggctagcacttttttttttttttttaaacagagtcttgctctgtcacccaggctggagggcaacagtgcgatctcggctcactgcaacctctgcctcccgggttcaagtgattctcctatctcagccacccgagtagctgggattacaggcacgtgccatcatgcccggctaatttttgtatttttagtagagacagggtttcaccatgttggccaggctggtctcgaactcctgacctcaggtgatctgcccgccttggcctttcaaagtgttgagatgaaaggcgtgagccactgcgcccggcatggccagcacttttaatagtccctggtgcacaagaccttcggcaaatgccaactcttttcatagatcactggaccaaaagcctgcagcctcctctgagatgtgcatggtggcatctctctcctttcctgaagcttctctaagatgcttctcaagaggggtctcaaagacagacagctgtggagcccctcgtctacagagggaggactgcctgcctgcacctggtaatggtgttctggagaaaacggcaggacggtttgtcccagaggcggtgcagggcccagccctgttacctctatgtccctgctccgggccacctccacgaagttctcatgctgctccagggtcttgtccactttatcatctgtcatgcagtagcagcgcaggcgcccctctcgggggtcattcatcttggcaaagatgacgaatttggccatgtagggcactgcagtgagctctttgtacagcagggtggcaaagttcacagcctcagcagtccgaggacagtccgacagccaaaacctaaaaagtagggcgagttatgtgttcccaagtgcccaacagagagcatcctttccatccagacgggagcagcccgtgagccataccatggctactattgccacacctgtggtcacggaggcttccacatggaggggacagtgagggagcctcagcctcaggcctggacggcagcatagagcctgaggacggcccacacaatactgggctgggctggcctcgtctcacctggcagagacattggtggtgaagttggcgcactcgttggcatatacaagtttggtggttcctgttatgtcttcccactgggcttggtctgttcctcctgtaacagcggcagaaatggggctggggacagtcttcaggatgtaagcatggagcttactaaaatgctaaggccgtggtgtgcaaggtgagactgggtgaagctcactttgtctgcagccctgggcaccctaccctcaccccgctgctcttcctcctagcaacctgcatgcccctcctcctagggcttggagagttcttccccaggggcatggactttttttttttttttttttttttttttttttttttttgagatggcgtttcatgcttgttgcccaggctgcagtgtagtggaatgatctcggctcactgcaacctccacctcccaggttcaagcaattctcctgcctcagcctctggagtagctgggcttacaggtgcatgccaccatgcctggctaagttttgtatttttagtagagacggggtttctccatgtctcgaactcttgacctcaggcgatccacccgccttggcatcccaaagtgctgggattacaggcgtgagtcaccacatgggcatggacttttatgcagatacatcatccttccatctcttggaagagcacctcactcccggggaagtcaacaaaaactaaggggattgctggcctcgccttctcgagtcacccccctactgtgttccagacgcactgcagcagccgagaacagaagcgaggcaggggcccctctcaccaatgacgctgcaaagcaggcgcaggctggtggtgtctccctccccgctgtccctcgggttgtcggtccaggaaggaggtagtgggatccgaagcccaatggggcggtggaacttccggcgccggggctccacggtgacaatggggctgaatgtggcctggttgcccaggagcttagtgacaagctcatccgggacaggctgggcctgtgaaatgacagaggcaggacactcaggcccaagcaggagaggggctaatcagacgggaggcagctccatgcctggtgagagtggccgtcagtgcacggggtcccgccctgctgttggaccacagaaccgacacggtggagcttgccttcctgagccctttctccccttctcctctgcttcttactcccagggctggtgcatctttgctagcaccacagtcaactcccggaggtcatgcggttcctgcatgctgcacagactgggccgtgcagcttgatgggttaccaggggttctgcaacttatcagggagcttccacctcaccccttcccacttaactctcctttgagctttaaactcagatctccactgtggcatttcaaagcaccagacaaaagtgtggggatgtcctggggaagagggtggccttcccggaggcctggagttcagtccacccccaggacctggcggggaggagggctgtcacctgcagagccagcttcactctcttggtgacggcattctccgggaacgttgcctgtaccaggggcaccagcttgctcttcagggagcccccttcgggaccgatggtgtcgtagtcctggcagagccgtgacatgatcacgaagtacagcgggaagtcggtggtgatgattcggcacaccctcttcttctctagctcctccaggctccccagctctggaatcacacacacaggccaccaccccggtcacatcaggcacaggttcaggacttccaggggccccagagtctccttgtccccaagacccagtgcacacaccctccccaggtgccgggcggcatagtggccagaagaagtggccagaagaagtgcccaggcccagaggcccagcagagcagatgcggctgcaggcagccgctgagcatcctctcacacatcctggggacccagggcttgtccacaccaggccattctcagcctcttggggcttcccaaacttcaggtggccctcaaagaccacctttaaggtgcaactcaaacccctcttccgcaaggaggggacccagccctgggatcccccgcccctaccttcgtccatcccgttgaggatctgatccaggtagctctctccatagcggctcctgtgctccttccacacggagccgttttcgctcctcagaaccacgagctcgcggtctccacggccatgggaggcaaagtgcgggatctccacgattacagggctgaggcaaggacacagtggtggtggggaggtgctcatacaaggcaggcagggcacagggagggatggggctgccggctcccacccagatggataaggcacttccgcagccacgtggaggccccacctgcaggcaggtctctaagtggaccagacccatggggaggttccccagggcttcccatggccccgcttgctccccgccaggcctgcagtgacagtgagggcaggaccagtctcatttcatgcgggctctgctcctacgacctaaagatcctgtccttgcacctgattccaaaaatccacctgacatccctagacgggtgacctcatctatcaactggccataatgacatttccttcagagggacactttgaggacaaagaaacgtcaacgagaaaacttgctgctttgcaaatggtggtgaccgctctgaggggccaggagggcggacagaggtagaaggcagggcctcctggtcaggcctgtccccacaacacacccatggtgcctgaggggcagcaaagctccaggaggagcccaggctgcttcaagggagtggagcacaggcctctggagccgggtacttccctcgtcctcaggggaaacggccagggaggccgtcttactgggaactctcagtgcataaaaggtcagaccctcaggcttcagagtggccttgtctctagtgtcacacaatatttaagagttgtttttttggttttgctttttattttttacaacgacggggtcttgctatgttttccaggctggtctcgaactcctggcctcaagcgatgctctcacctcagcctcccaaagcactgagattacaggcgtgagctatcgtgcccgacctgagatctgagagttgtaagccctctcagggctatggacaccttcgtgtgtcaggaaaagtcagggaaaggggaggggcacccagttctgtttccccatcaggacagatggaaatggcgtggcctccgtggcacagggacaggggagaacacgggctgcccgcgcaagctcacctcaggaactgtgcccccgtgggccccagtgctatgatcctgctggccaggccctcctcctcggccagtgggggcggcgtgctgagcttctggggcttgaccaggcggcaggtgatgcgggtgggcgctgcgcacgtccgtggcgggatcaccactcgcaggccgttgtggcgacttcctctcatggaaccaccccgggcgtcaaccatgaagctcaccagaaacctaggagtggggcagatgcacgttgggcttctgcatcccctctcggagatggagacaggagtccccgagccctgcgcccgccactcaccctgtatgcaccgggctggccaccgggctgatgttgtctgaggtctcggtggccgggctgctggggatgagggagtcctcatcatactctttagatgcctgaggagagagaaagggtcctcctgtcccacctcctcccgggccagctggatgccgtgccagggcgtggaggcttggaagaaccttgccgctagaaaccaggtgccacgtggagaaagtgctcccacgggaccccaccgccctgtcagacaaggccgtcctgaggtctaaaaggaagcacgagcttcctcccacctccatgcctctccttggctcaagaccctgggacagagccttggaatgggtggagccagtcctcactgttcagtctggctccaggccccaggcccgctgcacctgctgcagacccgccccccttctctccagctctgcccatggggagccctgccctcagcaggccaacttcctctagggtgggcactgcatcccagcaccgtgaccgcctcgccagttagctgtgggcggactacctgccctgtggacatttggagcccatgaggtgaacacaacagactcctgcccttgtggggcttcctgcctcctcacctgtgcaacgggaacttgccttagggtaacgctgcaactacagggatgccaggctgccctggcacagccagcagcacctgaacctagccttgctgctctctagatcttcacatttgcttttcccccggtccagaacgtccttgtccatcgcccttgttgatctaatcctctccactccccacatctcacctcctccacagatgctcccagccaccttggggctggttagggcctccctgctctgcactctgtgagcactcacaccacacagtggagcactcccccgctctccctcctggttctgtgctaactgggttcatgcgtccgagtccactctttctggttgggccccggctcccaggaggcaggtgtccagccctcctgcctgagcctgtccggggtgcacagcaggaatccagtaaacatctgctggctggagttcctaccctaggccaagagttgaagacagtgggctggtcaaggacccactggtttctcactgctgctgtcctgggctgcatccaaggactgcgccaccacaggaaagggccccatctgaccatctcttccagacgccgcccacccagcgccaccaatgttgcaccattatgaggcgtccaagcgtggaatgccagttggacagtgagtggcatgtgagctattagtgcctattgtgctacgtacaggccacccctcaacaatcactgtcccagggttttcatgccctccatgtggggaaaccacagagaaggagcttctcacctgctcctgctcttctgacctgatcaccactgtctcaggcatggcacagggaatcctggggatggctggagattccaccctgcgtgccaagaacaccagaacatcacagggctgatccacatgtgcacacagctcctcttcctcttgcctccaagcctctccctccggctttccactccagagcctgactgcgcttcacaacctggtggaaggaccgcctcctcctccatgaagtcctccccaatgactccaacctgcacttgtcgcccctttctctacctttagaacctgttgacagaatcctcgctctggctaacaatatatctttctgtgttgctacatgaccacttggtgtgcatttcgatcccaccaaatgagtccgtaagttgcttacggtcagggttacagctctgtatttctttctaacagatgtccagcaaattcaaatggagtaaatggcccagtggtttcactccctgcttgttcatgggacacttccatcttttcagaaaacacctagggctcagtgtttctacaaagtcgttgatattagattgctttgcaaaatgtccctgtgtacactgtgccccacagtgagataactcacagcagtcacagggggaaatgagaaatgtggtccaggcaggcagacccggatctcccctggcttgtacctaacatacctcaggggcagaggtatacagtcaagagttcgagcttagcctggcaatagtttctaatgtgaatcttcctcaacaattttttttttttgagatggagtttcgctcttgttgcccaggctggagtgcagtggcgcgatcttggctcactacaacctccgcctcccgggttcaagcaattctcctgcctcagcctcccgagtagctgggactacagatgcgtgctgccacgctcagctattttttttgtatttttagtagggacagggtttcaccatgttggtcaggctggtcacgaactcctgacctcaggtgatcctcctgcctcagtctcccaaagtactgggattacaggtgtgagccaccgcacccggccatcttcttcaacttttggatgagaagttgagtgtggataagagggagagggggtgtggatataaggctgtgaatgaggggagcctgggagaggatgggagcctgggtgggagaggaggggagcctggaagaggagcagagaggcgtccaggcagcacggtgtgagggaggcctccgcctgccctagtggctagggtgcagagctagctcatcctaaggtgcaaaccgtctctctctgcgggcagcgagcccagcgcctggcctgctgtgtccttcctccctctggaatccctgctctgagccacagggttgcatctcggcacccccggggaccctcccgggagcactgctcacacttggtctagcttcggcacaaaatccagcagctccttctcttcatcaacatccctggaatcccgcctctcagccttgaagctgatgagttcttcccctgaaacagcaagagctcaagtgagcgacggggtagaggaagaagagtccctctttttttaaaaaagctctgttcccgctccgcctctgggggcttgctcctgaggagtggggaaggtcttgatgctgcaaggagactgggagcaatgtctttgcccagtcctggtcctccagctctgggatagagagcagggcagccagctcctgacatcttagatgcctgaggctttgcaggaggccaaagacacagccagaaagaactttgttcgcttagttccaattcaaaacagcccttttagctgtgcaatggcaccaaagaaggaactgctactgctcttttccactccacaccaacagaagaataaattacagtggaactggacccactcatttcaaagggctggagaattttttgtaacaatggcagccaaaacctcattacttccaaagcctatcacaaagagtttcaaactacgggtcaatcggctgcctacacctctgactgcctctttgtttctctctcctagcttcaactggagctggagccccggccctcgaccttgaggggtcattcattgccacccaggagtgagcaccatggcttgtgatctggagctgatggaatggaagaacaacagctcatgcggttatgatcataaacacggtggcatgggcacagacacaaagatggacaggcaggaggtgcccgccaggcatgggtctcatgggtgtgaattccctggtttagctgagctcctggctccagcttattagctgtcagaggaagatggaaagcaggaatggattagtgagcatcagggttgcttagggtgaaatgcactctagtgagaaaagaccacagtaaacagaaagcatttcatacccattatagttatatgagcagttcctggaaagcaaaggagagcagaattgaaagaaggaccacattgaaggcagttaaagcgagaggcatatattatccaaaggagcaccagaagctctgcttctctagttgacaaagttatacaaccatgaaattatccagatggaagggaccactgagctgatccagcccaccccactattcaacatcctcagagttgaggatcctactactcaacatccccatctaattagtgatgaaataaggtttgctgggggtaggaaaaatactagaagcattctgtagttcatacaagctgatactatagtaatttctttctttttcttttagagacagggtcttgctctgtcaccctggctggagtgcagtggggtgattacagctcactgcagcctcaagctcctggactcaagcaatcctcccacctcagcctctggagtagctgggactacagatgtgcaccaccacaccctgctaatttttagttctaattttttggagagacgggggtctccctatattgcccaggctggtcttgaactcctagcctcaagcaatcctccaacctcggctgcccaaagttctgggattacaggcatgaacccaggcacccagccagactatagtaatttcataatcacagaaataacccaaaacctattgacccactatgtggtcagaagtgcagcttaaaaggcatgctcacagattttgaataatccacttagtattcgttcaaagcacaaagaaagaaccaggcagaattttattacagttcctcatggtgcggagacttgatctcagtagaaccacgctccgatttcatacacatccataatctatgcaaacatacatgtgtttttgaaacttcatgggattttaaatttagtcaatgttccctcacctaagtattaatagagcagtatttttgatagtagacaacagttataaaaaccaggtctccccagtttcagtgtccatctatagtgcttgggcgtgttgtaaggggacaaagccggcaggtggcaggaagcccccttggagggtgcccggagcccctctgtccccaccagcctgagctctttaccccaacgttaccttcatcttccgagacatccaggatctcatcaactgtctcagggaaactcattcgatgcttatcactgactaactaaaacgagaaaaagcagataattcaacccaaactagagccgcacacattttttaccagcccagcggttccctggtcatgcctgtggggtttcccacaaatgaagaaaaacagacggaggaggcgctcagcctggaagctgccgggcaggaaccacggggacgggacccgggaaaactggcttcccatctccccaaaccccatccactccactgctgcccggaaagctggtcccgcccctagtcctcgggccgctaggtggcagcacagccccgctggaaggaggacaagctcccacccgtcgggcgcggcgcctccgacccgcgtcccggagccccagaacgcaccccacttccagagtaaccccaggcacgcctgtgcgccaggctgagtgtgtctggggtgggtgcgggggagaggcagacataccacgaaactggtttcatccgtgacgaccttgagcacgtcggtgacagaaatgtagcccaagcgcttggctatggccagaggtgtggttccatcctggggaaagagcagcccgggtgcagtcagacaggggatggagtctaggaggcggggctggctccctagacacagatcgagttcaccttctagttgttcaggaggacctgagtggacagacgtcaccgtggggcccagaaagagatccctgcacgtgtgtgtgcctagatgtgtgttagcagcagcacccacagagacgggtgtgggaggagggagggcagcggtgctttcgatctgcagcgtcaagtgtggggccttgcaacccagcagaggaaatctcccaaggagaagtcaggctctgctaagtgggaacccactgggaaggaggtcaggaagttgccagatgcaattttaggaagatgaggacagaggaaggctgcttgctgctcccaaagtctgttcttgggtgtcagtgatggggtattaaaatagttgaattaatccatatacttcaatgaactctaatcagaatactcggaaatcacaaatcaccagaaatacagcaagggcatattttctactttgattcaaagaggaagagctacgtgatcataaatggatactgaggcttgatttttcttttgacttctctacttctaggatgtgccttgggctccgttcagattcaagcccagctgcagttgcaatttctgcaaccccatctacaatcgagtccacttttgtgtgtgtgtgtgagacagagttcactctgtcacccaagctggagtgcagtggcgtgatctaggctcactgtaacctctgcctcctggagtcaagtggttcttgtgcctcagcctcccgagtagctgggactacaggtgcctgtcacctcactcagctaatttttttttttgtatttttagtagagacagggttttgccctggagtgttggccaggctggtctcgaactcctgacctcaagtgatccacctgccttggcttcccaaggtgctgggattacaggcatgagccactgcacccagccaagggtccacattatttcagagatagaagcagacacggagataatttcacagaacttccacatggtcagatgaagaagctcacaccgaacgatgattgctgatgtcactaaagataaccttgagccctgaaagatcaggaaccacccaggacatttaattatgttcagttgtaccatactgaaaacagtttcacatattttagaatgggtttcaacaagtatttatatatgtggtatgtatgtgtgtgtgtgcatatatatatatgtatatgtgtgtgtgtgtgtgtgtgtgtatatatatatatatatatatatatatattttttttttttttttaagacacaaggtcttgctctgtcttccaggctggatgtcaagtgggcaactggaaaatggacactgaactgcagtggcgcaatcacagctcactgcagccttgacctcccggactcaggctatcctcccacttcagcctcccaattagctgggactacagctaatacgtatcaccacacccacataattaaaaaaatttttttttgtagattcaggcactcactatgttgcccacgctggtcttgaactcctgccctcaagcaatcctcccaccttagcctcccaaagtgctgtgattacaggtgtaagccactgcactcacacttaagaatgttttaataaacataaaagaggagggtaaatggtgcttaaaaggaaaacgatcaattcaccagaaagaggaactgatcacagcaccccatccccagggtacccaaggtagctgtggctttagggtgctgcggccccgtccaggccctagacacgtgcattaacctctacggttaggggagttcacacagggctgctgccatggggagcagttttctaaactcaggagagagagtgtactcaccgagctgacctcgtttggggaagcaccgtttttcagaagcagagtcacgatgtctgtgtgtccctgctgggctgcctggtgcagggggctgtatcctagctgcaaagtgagcagacatttaggcagggttagccagccactagacagagacctgcctacacatgatagtgcctgcccatcttcgaagtgggacattaatgaaatgcattttccccctttcttccttcagggtccatggtcaaaaccctagtgctcccagagcagctctggctttaccctgatgtggcatggagaagggtcagtgcaggagtcggggctggggcacccctgtaccttggtcttggcattgacatctgcctggtgctgcagcagaaacttcaccagcttgatgtttccatagtgactggccacatggaggggagtgtagcccatctgaaaagcagatgagaaggagtgaccggagctgtcctgagctgggcatcacatgaaatccttcccaaagcagctgattcaaagagagaacggacagggagccccttgaaggctgacattgacaagctgaatggctgctgctgggcagagaccaccaggctgagatgcttgtgggagacccaaggggagacgtcaagcgggcaactggaaaatggacactgaaccgcgagaagagggctatgctggggtcgtcagtgcatgggagatctgagagctttggaggtgagtgaggtcccccagaataaagtggagggtgaaaagtggggccgaaggagtgaggcagaggcagaaaagaggagggaaaccttgagagaccagcatcacagaatcccaggggagctatttcaagaaggaagaaacagccttcaggcctgggaagggtgctgagatgagggcagatggggatgtggagtcatggtcactccaatgacaacaggttttttccattagaaagctgaaatcccattgaaaaacccccaaaaggctgtccaagtgactgtggtgtaatggaatttatgagaactggtcattgcttattgaaatgcaagggcttgggacattcgctcatgtgagtctgggctgttcaaggagtctgtcctgctgaattttgtggtaatgccttcctgaattttgggccgacaggccaaggccctctgagctccttggtcccaagtgtcccgggaagctggtgccagattccagagaccacccaagcacagatcctccccataatgggatggcttttggatcctcaaggccattctaacccacaggacagggtctctctgtgcaggaccccaaaagactaaacggggcccgcaagtgaagcctcaaagatccagaacattcgtggattttaagcagattgctgtggaagctgcaggcagttggagacaaaacacaatttccagacttttctcagggtgacttcagcataacattgttgccggcatttctgtgctactctggagggggcgggagctcctggtactgtcactgtcccttccttttaatatggttcccttgtggggaaaagaaacaaaatgtggcttcttccatgaagcccacctcctcgcaccaactgaaaacaccctctctgcactctgtgctcccagctcctctcttaagagtaaatatcaaattatgctcttccttcctgtccctagcaatcacctccacaccaaactgcagacacctcgacggcagattccattcacatagctccttgcacacaccagaagttcaaagaaagttgaactggatttaaccaagtgctggaagaaaaggagctaagcttttgtgtggatctggggaaacttgacattttgacatgctaactactcatgttagacaggtcttagagtcatgattaaacattcgccccactttctcactgcagaggctcaaaggtctagcaaactttaaaaaaatccccaatgggaaagtcaggtaattaggagtagtgttttcaaactccactgccagccctaggaagtggcagagaagaatgtcccactgggtctttggggtttcaaagctctgtggaagattcaattctgaagtgtgagcaaggagtccacacagactgaagttccggctgcctgccttacccgggtggtggcgtccaccatgacgccgtgtttgatcagcacatctgccactggaacgtggccttcttgtgctaccagatggaggggagtgagtccgctctgcaaagaaaaagacgttcatcaccttctatcaagtaaagaattccaggccacaagtaaagagctctgaggtctgggagctgaagctaactttgcagtcaccaactagttatttggctccaggcaaagctcttcctgttctgggccccaatgtccttatctaaaaagtaaggtggttacactagaccaggggttggcaacttttgctgttaagggccagatcatcaatatttttggccatgtctctatatgactaacatttaaatgaatgggcatggctgtgtttcaataaaactttatttacacaaacaagtggtggaccagatttggcccacgggcccatagtttgctgacttctgatctagatgaactttatggcactttcccatcgttggtgctttatggacttcccagtaaagaatgccccatttccatggtgaatttcagagccctgtagccttggtttcctaatctagacaataggggttatcatggatccatctcaggggcaaggtgaggagcgctggagaaagcacaggtgaagcacattgagaggcacacagtgctgtttaaatggctgggcgcggcggctcatgcctgtcatcccagcactttggaaggccgaggcaggtggatcacctgaggtcaggagttcgagaccagcctggccaacatggtgagacctccatctttactaaaaatacaaaaataagcagggcgtggtggctcatgcctgtaatcccagctacttgggtggctgaggcaggagaatcacttgaacctgggaggcagaggttgcagtgagccaagattgcactactgcacttcagcctaggtgacagagcaagactccatcttaaataaataaataaataatgtaccatactgttatcactgcacagccagtgctggcacggtcaagagggcagagcatcccgccaggattgaacggaccatattcttgcaggtggcatcacagcttcgtcaggaaggcagtaaggtatcagagatgttgtttgatatgtgggcacccacatgaaaatgtcagaaaagtcttctctcccctggactttgcctcaatacactttgctagcgtgggaccaacaaaacggatttctctgcaggcacagaccgtgtcccctctacaggactccacttgccctcctctgccttctgcacaccccgcaggctgcccagaggcttgtgggcagtcatgatgccccaccacacactgctgcagccaaagcaggtgggcccctcctgcaggcaggcgggggtggctccaatgagaacagccctcggttgaggagtgactgtgtcagcctctcaggcgggcgctctgcctcattcttgagctaacaccaataatctgcctcgtgagggcggcgtgcggatgacagagtgggtttccagtcaccttacggtctccttgcaaagctcacattaagtggggcagtgaaggaacccagaatgccatgagatataatgaatataatggtcctaccagaatggttcgctcattgggggtcaattgttcaaatttgtaaaaaatgtgccagattttgtacaaaatgtgccagattttgtacaaaatctataggtttttaagaaatcttaagttgccctgaaaatgcttgcctttctgaatgtgtgctatgtgaatttatcatcaaagaagtggttcttcacattgcatggttccacgtatatgaaatgtccagaacaggcaaattcctagagactgaaagatttgcagttgtgagggaccgggggctctgggggaaatgagaagtgactgctaacgggtacgaggtttcctttcggagtgatgaaagtgttctagagttagatcataggctgctgaattctgtaaaaatactaaaaaacattgaattgtagagtttgaaagggtgacttctaggtgaattatatttcgataaaactgttatttaaaaaagaagtgatttttagtctttttttttgggtcacacattcctttgagaagctgagaaacattatgaatgcttcacccagaaaactgctcacgcgcgcttcctccccagatgtgtgcgcaattttagaaggctttatcctcacacacctattgttgctggagtgagaactcctagtgtataggtcagtgtttttaaaaatatctttcccccacggaacatagaatatttagtcccaaatgacagaatgcactcctgaaggtaggcaccggcctatatttgggaaagtttattatggattttaatattgatctttctgcagatccttaggtcaatctgtttagaaagatcggcaaaggctttggcatcagaaaggctcagaatcctgccaccttgggaataagcaacctttctgactctgtttattcatttataaaatgaaggtgaaatgtacgcagggctgttccaaggattacacacacacacccctaactcagaacctgggcacacatagatgctcaatatgaagacaccacacgttgttatccagcactccagggcagatccgaagacaccatgcctaccttgttccccaggttgccattggcttgtttcgagagcagcagagccaccatctctgcgtggccctcctgggcggccaggtgaaggggcgtcacaccttgcaccgactcggcgtttgctgagcccccatactgcagcagactacgggccacctccacctggttctgcttggcagcgatgtgcaaaggggtgtagccattctgaaacagaagaagccgcccagagcctggttacaggaatgctgagctgacaatatcaacacacaagcaggggctgagtctggttcttggccggctggacacccagtgagcagggctggcatcacccaggagcaatttaggtaaacaaacaaacaaacaaaatccatttgatttggagacagctcctcaggcttgcatagcctctatatgtccatcttttttcaccatctgttttctgttatgctttgacaaactgctggacaggaagagaataacaggaaggctgggtaaggaaatgaaagattctcatttcttgcttcctgcaataagagccaaaaaccccaaatatttcataaagaaaaagaaacatcagccccttttctttcccagtgcaactgggccaagtgctgccctctgggccttgccggcattaggcagggtggtttaagggacatgcacctggcaagggacttgaggatgtgggacagtcctcactccactgttaactacctgtgtgacccagggcaagatgttccatgacctagacttccttctgtatcttttaagtcatgaaaagtggataatagcatctatcttgttcatttctcgaagttgttaggtggatcaaacgtgatactatacgtgaaggtatgttccaaaattaagatataaaaagttggcagggcacagtgttcatgcctgtattcccaacactttgggaggctgaggtgtgaggatcacttgaggccaggagtttgagaccagcctgggcaacatagctagaccctatctctacaaaaaaagtgaaaaattaactgggcatggtggtgcatgctgtagctactcaggaagctgaggtgggaagatggcttgagctaaggagttggaggctgcagtgagctctgatcgtaccactgcactatggcctggagcagagtaagaccctgtctctacacataaaaattttaaaaagtaatgcacctgtgtgtcatggttttgcagtgcactggtttgcaagacattataattgcacaatgagatgaagaagcttgcctcaaaagtaaatcaatgatgtcactgtgcactgtttattcagccaatttttgtttttattattattattgatagcaagactgtctcagtgaaggaagcagcgcatgggtttacattctggagcacactccttatctccctgcaggcaagagacagttcccaggtgggcacctttgctcatcactgccgaaaaccactttcacctgcattttttttgcgcttcattaaaaccacataaggtcactagggcaggcatttttattatcctattgtgtggagaaagaggccaattctctgtaaggttaagcaccttatctaatgtcacgtagtaagcagaacaacagataacccaaccttgaacttctgattgcacagcccaggtaattccagctagaacagtggttctcaaactctgatgtgtacacaaatcccttgggaccttgttaaaatgcagtgtctgattcagaggcgctagggagggcccgagattgtgcatttctagcaagcccccagatgatgctgacaatgctagtccagggatcacactttcagtagcaaggccctagggcactcagggttaagggcaatgccaggctggaggacgtcctggacatgcgcccacccaggcccatagcagatggctgcccaacgtgggatctgtctcagggcacgagatttccccacctcggccagcattcctctggctgaggactgagttctccctgccagccactctcttactgtggaaaccaacatttctgattctgccaggatcactggtcaggaagaggaaagggaaagaaaggggctggccaaggcagtcaaagccctgggtacagggaaagctcagcaaggtgggcccataggtggcttttgtggtgaaacgaaaagttgagacttacccaaggaattgaattaaattgaaaaatcattttctttgaagaatgacatgagataatcctttctagtattcttcctttttaatttgattatgttatgagaaaacattaaattgttcttcgtaggttgtgttcatgtaacaagatcggcatttggattataataagtttaattaaacaacatgatttttgcactgtattaaaagagagcaaaggaatggggtgcgatgccgcagatccagcctgagatgcagggtcggctcaaaacagagctaagcctccccacgattagacacggagcaccagtcagcgctggcccagagaagattttcactatgtaaatgaaaaataaaaccctaagccccacacagatcccatctaggccaaagagatcccagaaaaaccttaaaaactgaattcccagccacgaaggaagggaggttggacacgccttgctatacccactccctttcggagtttaggcgcaactgaccggcattcatgttaaaagagatcataagactaaccaaagggactctttgtgacaagacaccaaattatcaacaggacccaaggccacagtaggcaagggctgagtcacatgccccctggaggtcactcggcccaggaccctggtgaacagacccttctctcaacttcatgcttttctgctgattccaaacttttagataaagctttactcctttaaccaattgcaaattaaagaatctcggaatctgcctataacctctgggactttctaggtatttttgtcaatatataccttccatgtattgatttacgtctttgcctgtaactcctgcctctctaaatataaaaaaccaaactgtaagccgcctcagacacactttctcaggacctcttgatgctgtgttgcccagggccatggttatcacgttggctcagagtaaacctccaaaagactttatggagtttggtttttccattaataactacatgagagcaatgattattaggccatcttttttttttttagacagagtctcgctctcttgcccaggctggagtgcagtggtgagaccttggctcgccgcaatctctgcctcccgggttcaagcgattctcctgcctcagcctcccaagtagctgggattacaggtgcacgctgccatgcccggctaatttttgtatttttagtagagacggggtttcaccatgttggccaggatggtcttgaactcctgacctcaagcaatctgcctgtctcggcctcccaaagtgctgggattacaggcttgagccaccgtgcccggccctattaggccatcttttaatgtacaagggtccatcacttgagcaatctgcagtgtgttcatggatgtatcctcaggaatcccaggccacctgggaagcagcgatgtccacactggcaaggccagccccctgtcctgcccaagggtaggcctgccctggacatggctcaggctaccaggtaaacctctggttaaaattgagatacaagtgccactgtgactctcagaacacggactgcccctctgagcttcccctaaaccagaactaaaatgaacaaatgaacttctgcaggtgacaaggacaaggacaactaggctggaaagtcacggagaggggagggaggaatgtgtgcccgcaaaaggctcttctttcccaaggaaatgagctcatcctaaggaatgcacacggagggagctctgcccaaatgttcaaacaacattagcatcaaaattagaaaggggagggtttggtttgggtgcagagagatttgcatgtgaaattctacaaaattgccagactactttggaaactattttttgccatggaaacaaagcccatctgtacagggtttgtgcttggatttagttatctttaaatataatgaacctggctcccgttccttttatataagtaggggagtgaggaggaggggagtccaggtttttatttttagaggcaggagtaagtcgacatcgcagcggggccgtgtgctccctctgcacagcgacgtgggactcactgcagcagggacaggaggagacagctgtcgggagccggcgtctgtagaagagcgatgctgcaagatggggacacgtgtctgtccagggagggagaacgcgccgaagccctgcactggcactgacgctccctgcctgggctgcggaggccctaagccagcaggtgttggctggagtcacatggggtcccaccccgaggctccttctctgcagcacttggatgcctgccacatgacggatctcccataaattatcctgtttcccgtgcgcctggctgccccatagagtgcgggtactgcgtgtggcttttgtcttcctggccccgctccctctcctctccccttctccccgctggccaccagtcccgcggtgcctatccctacacagcctcgccttcccacagcaggcagcctgttcccaaaaatggtccttccagctttatccttgtactacccaaccccgtggggtcttccagaagcaacccatctgctccctcctctgattccctcaagggtcacggaacctgctgctctgagcagctcgcctccgaagctggtgtgaggctgggccaatgtgtctcacattcaggtgagcctccctacaaaaatgccactatctaaaagtctgatctcagagacaaatgaatttggagatgatcattctcattttaaagaggtctcttgtttccaggttccagcaagctcgccagcagccctgaggatttctcaaagtacggtcgctgtggccccagccttggaaccatgcagagagtaggttaaaaatgaggcttccaggccacactgcacagtcccacggagtcagaatctagcaatgctagaaacgggctcaccactccccagggatttttatccacactgacctctgacagtcagtttacaaaacccagctgacgtgcaactgcttggggacacatttgttgtataaaacaagttccgcctctgcgaggtaacccctggctgggaattgttacccacttcccatcccactcctgggccctgaatagcgtgattacagggcaggtaacatgtgggaaagtgaggcgtgatttctgaggtaaaaatagcaacagaacgcaaaacccttgggctgctgtggaaacccccctccctgagggactggaaggtagcaggtgacctgctctccaggggcagctggggagaggggcgggccttacccaggcagggctgtgcggggagccgccccggggaagcagcagcttgacgatgtccaggttgttgtgatggacggccacgtgcaggggggtcaggccattctgcaggggacaaagacaaaagaggccggctgtcactcccacggactttctcccaggactccctttaggcatgggagcacctattttatacagtaaaatcctgtttaaaatctttcccaggccagtcttaacttggagtcatgacagaatgtcatcggcaggacccagagccctgtgggaacaggggggaacgtgggcagtgagatcaatacacttgcccggagaaggccatcgggtctttccaaaaggataaggcctttgacagaaaggccagtctttccaaaggccattctctctcgatggctacccatggaaatataaacaggccgggtgcagtggctcacacctgtaatcccagagctatgggaggctgaagagggaagatcacctgagcccagagttcgagaccagcctgggcaacatagtgagaccctgtctctataattgtttttttaagttagccgggcacggtggcaactgcttgtagtcccagctactcaggagactgacactcgaggatggcttgagcccaggagtcaaaattgtagtgagttgtgatggcaccactgcactccagcctgggcaacagagcgagaccctgtctcaaagaaaaaaaagatgaacaacacaggcaagagatggaatctgcaagtgctgatgtccatcctctgtccttgcctctaacctgagagctgcaggggagggcagggttcaaactcacttttccggcagcattcgggtgtgcgtcccgctccagcagcagctctgccacccgcaccttcccgtacttggccgccacgtgcagaggggtaaatcctttctgaggagaaacaggctgtcaggaccttggggccccagggctgtcctccctggagaaagggcccacagcaaaggaggctgcacctccgctggcatggagaggccaatgaaagcaaaggcacagccatttttgagccctctgggaggccgaagacctcaggacttggcaggcatccctgcacttacggtccacactcctctggcaagagggtctcaaccacctcacagtggtagttgattgctggctagctgagggcagggtatgagtcttaatccttttcatatccccagaacctgtttgtgacttgcccaaagcaggtttcgactaataattgtgccatgataaatgtatgaaggctggctgggtgtgtgagaagctgtggttgacttcctgttttggggaaggatggagacacatcggcttgcaggtggtggccagccctgagtgtgacgacccttccagctgcttgcagcatcattgaggtgacaaagagaaccaggcaggaattcccctccgagctccaggcctggctgagtgagcctgttgcttccttagaccacgaggcgggaggctgtaccttggtcatgcaggcctgggatgcttccttttccagaagggccaggactgtttccacatggccctcacgggctgcaatgtgcaggggggtgtgcccggcggtggtggccaggttggggttggcgttattttccagcaggagcttcaccatgtttgtgtggccgatgcgagctgcacagtgaagtggggtctggtcatcctggaccccgaagggaaaacaaagaagaagaaacgctaatgttaccaaatccaacttttcatcttacagagaagcaaggcagggcccagagagggcaagtgaccttctcaaggtcacacagctaagaagatgaagagtcaggattcgaatcaagtctctgagttacaggaaccaatatgctgtatcctactgaatccttacaacagttcttcaagtgagctgttatttctaccttatttcccaaaggcccagccctcccatctgtaaaatgggaataataacgtctacttgctagggctcagctgggatcaagctgataatgtacatggtttctgcgtttggtgcataaaaggcactcaatgcagtgtggctgctcatccgtctcccacatcctttctgagtggatgcgcttgtctttctgcttgaactctagtttgattttctctgtgctggggtcaggggagtctcaactgctgacagagaatgaggacttttccacccacacccccccacttcctgtttctgaatgctgctgtcgggctgcctgggccaggtctcatggggcccagctggaggcttccctcgagggccccaaacacaaatcacaggcctgactctaaggagaacccatcgtggcctgtggttaggaagcctgctgttggccgagtgagcaactggcaaactccacagctcttctcactgtctactcctccaacccccgcaaaatgtgtttacagcaagggggaactctccagttttagatcaagtaattcttgcctgatttttgctggcaatgctttctttaaaacgttgcccccctccttacatggcaactgtcatcgttagcccaggacatactcaggccagccacgcaccttggactttccttattttaaagaaatgtggctctcatgcagaaatacccctggtcttctcaaaccccctgcaaagcagaatctgggcgctcagagtgacctgatcaggatgaaaagtgatccccaggccacagcactgcagccccgcctggaatgaggatgggttctctgcacagtgctggaactgctcacatctgaaacccttcccttcctgccttcactactcaccttggccttggcattgactttggctttgttctggagtaaatatttggccacttccgtgtgcccggctctggctgccatgtgtagcggggtctccactttctataaaataacaaaattatagaactgttcatacatgcctgctgtccaaaacggcacacacagagctaggaagtgcagtctggagtggcttggtgggtttttgtccaagaggtggagttgccccagcaggcagctctttagcctggtatgtgtgcatgtgtgcatgagcatgtatgtgtgtatgtgtgtgtgtgcacatacgtgcaggtgcatgcgtgtatatgagtttatgtgtgtgtctgtgtattctaggtacacttaaaagtaaaccccagagctaatgaatattcaaaaatgtaaatgtattcccagtgaacacttacagacgttccaaaattattgtccaaaacaaagcctccaaggtttacggatgtgtgagaaatttaatccagaaagcgtcagtacacagggatgtcctcccccagtctgaagcattggctgttctgggaatcgtagctctgtccccagagagtaggactgggagcactggtgaaagctgccctctgagctcttggtctaggggagcaagcccctgcctgcctgagggcttaccacgttggagacgttgggcgacgccccccgctgcaggaggttcttcacgatgggaaggtgccccatgaaggaggccacgtggagaggtgtcaggccagactgaaacagacaaaggcagagtccgataagtgggagtctttccgctcccctgaagaagagagaacctgacagtatctaacgctttcacaaatgattttccaagaaaagggagctatatgaggtgggtttgcttccaagaaaatggttggagaaaaaaattactgtgggcaagtcgtgcccactcttacaacttgcaaaaattgtgtctgatcttggaaggctccatgagacttgactcatgttcccttgtcttagtcacccctgattcattccttccagcagtccagacttgcagacacacacacccctgcagccatacaaagctacaaagagcgactcttggagaaggtgggtcgggggagaccacaggcctgcccccaggctcctctgcagtctctcctacctcggtgaccgcgtcgatcgaggctcccgtcttcagcagcagctccatgacacggacgtggttctttttgcaggcgatgtgtaagggggtaaagccattctgcagcccacacaaagggagacagacaagcaggagcttacacacgggcccaaggaacgcccagaagaccacctggctgctctaaaaggcagctgctgcccaggccaccagcagatgcccatagaccaatcaacgaattaatgccaattgattagtcttataatgtcaattaatgcaaatcatgtaagagacaggtggctctcacttgatgcactagatatgttcctgaacatgttgtttataaaccttttttaaaaatttattcatattttggatgcactaaaagatcctgccatttaaagccccctaagggtaaatttacaataaaagagtacttttgtgaagcaaatcatgttccctcttccctgaaaccactgatcatttttagtgaaatggatttctgctttaaagtgtgatatactctgaatgtaaactctgaagggcagaaatgtgtatttgtttttgtctgtttttttcagtggtttatccacttaaggcagtggttctcaaacacgggaggtggtggtgggggggtatcgtttgcacctcacccccaaaacatgtggcaatgtctggggacattttttattgtcagctagggaaggagagctatgagtgcttagtgggtagaggccagggacgctgctaaacatcctacaacacacaagaccacaaatatcgaccccaaatgtcaacagtcctgaggctgggaaatcccaactcccctataacagtacgtggcctgtgggcactgctcagtgaaagcttttttgagcgagtgagtgaatgagtgaatgaatgagccatcctctgccatccctggaggatatcctgcccctcagttctgctgccttgggaagaggcagagaggagatgtggttacaggcatgcttagtgcaaagctacagccctgctggatccccagactccctgggagcccctgtcctgggaaggaggcagaggaaccacaggagggatttgctctgggcctgagcttccctttacacgagtgccatgagaactacaagcccctctgtggacgaaggatgctcagctctggccatctcattcatccccaaagcagctcagaaagccacgcagcctctaaggaatcactcagctccaggcctggctccactggagagatgccccaagcccgcatacctaccatgcaggatgcttcctgagtccggtctcctgggcccaaactcatccctgacctcggcctggtcaccggggcaggggtcgatacccaggtgggtgtgcagtggagggtgcaggaggggtgcacaccaggcccccaccatccagtgctgtcacaccccactgctcaggcctcgaatctggggagctccgggcacctgccgcccttcccacaggcccagccatgcctctctgctcctgcccccagcctgccctgccactctgcaccttctccagcagcacccccactcaccagggctctggagttgggtttggcccctttatccagaaggaccttagccaccctgtggtgtccacagtgggcagccacgtggagtggggtcaggtggtccagggtgatgtcgtctatctctgcgtcgtattgcaacaggagccggacacagtcgaggtggtctccctgagccgccatgtgaattggggacaggccgttctgggtaaagaggaaaacacaagcaatcacaaagtcttctggggaccgagcatggagattcaggacgattccaacgtcactccctacttcttccctacacaatgtttccacaagtctctggagggagcttggctcaccctggcctccacgctcctgccggtctctgaccacagacattctcctttccacctggccaaaccttcaaagccatgtccagcagacccacctcttccagaaagccttccctgaccactctagactcctgtgggctttccttatctgcaccatgcgctcagaccttattctcatatttgcccaattatatccatagctaactttttaggggagtgtatctcttctctttatttatacgcctcttaagatcagtgacttagcctaatatttctccttaaatgccccacagtgccaaatacatgcatgtaacacacatcatggtccctaaattatgtgattttgaatgaatgaatgaatgaatgaattatgataaaatagaacttggatctaaatccctctgttccttgtccctatcaaatgcagttcagttaaagaaaattctgttaaggatactcatttctcaaacagcaatttgtttaaaaaacataaaagagagaggagactcattcattcacttagacattaattcaacacatatctatcaagtgattaatgtgcacctggtatgggttaagctctggggaaacagaagagaacagacataacccctgacccaaggaagcttgtagacagacatggtgttgtctttcagcgccctgaagtgggatgatcaaagcacagagttgtgcacaaacagatggcgtccctgatgaaggaggggcactgggagggaggaggtgaggcctgagctaggacttgaaaggagctgaatggaagttcaccaggaggaccaaaggggaagaacatcctagggagcagcaagtgcaacatcacagaggcagctaccctaggggaacccaggggcctccatgcagttcgacagtccggggtgaggtgattccaagcatggagtcaggctggagaggaggctggagctgcgccaagaaaggctaggagctcaggacctgggacttcagcttttagaaagtggaaatgagaggattttcatcaaggaagatgcaaatcaggttccatgacagcagatgttagtgttacaggctgaattaggtcccacaaaattcacatgctgcagtcttaacccccaggacctcagaatgtgaccttgtttggaaacaggatcttcggggatataataagctaaaatgaggtcattagtgtgagttctaatctatgactggcgtccttagaaacagggagatttgggcacctgcacagcaggaaaatgtcacatgaagatgaaggcagaggtcagcatgatgccctataagccaaggaaaccaaagattgtgcccaaaccaccagaagctcggggagagacctggaaaagatgttccctcacagcctcagaaggaatcaaccctgccaggcactgtagctcacccctgtaattcccgcactttgggaagcaaaggtgggcagatcacttgaggccaggagttcgagaccagcctggctaacatggtgaatccccatctctactaaaaatacaaaaataggccaggcgtggtggcatttgcctgcaatcccagctactcgggaagctgaggcacgagaatcgattgaacctgtgaggcggaggttgcagtgagtagagatcacactgctgcactccagcctgggtgactgagtgagacttcatctcaaaaaaaaaaaaaaaaaaaaaaaaaaaaagaaccaaccctgctgacaccttgatcttgaccctccagcttctggaagtgtgagacagtaagtttctgttgtttaagccactcagcatgtggttctttgttaaggtggactgagctaactcagttagttacacttgcatttcagaaaggttgtacgatagttcccaattgaaaagtcacatattctcagtaaggaattttcataagcattcttttcagccccattctaatgatctggataataaaacaaaaaatcttaacttctggccatgtattatgtttaaatacagcactcctggaaaaatgttgggaattttctaataatttaactgatagtagcaattctactttcatttagctgaggagttttacttttagatagcttttgaagacattatctcacatggtcatcccaataatcctaggagagagggtgggggctctccagatgaggaaactgaaacacagagagggcaagacacacgttcatagtcacacggcaaatcagccaaggatggagggctaaatgagaaactgctttagtagaggacaccctcatgcaacagcacacacagacacacccaagaaccagtgtggggactatgaatcatgacccaaattaacgacagctctacagaacagaacatgataatgtgtcgggaataaatcagctttcactgtatggtctaagccatcattttatgacagaactgctcgtgggaaacctcctgggtagctgtgagtgggcctggcttttgccttgctctgctctgacacagctcaattcacggggcagagggcccagagcaggcacaggcagcagtgtggctgacagctttcaccccttgaagactcgagtccttatgtcagagccacgtaacgggccttttctctggcccgtaatggaacctgagaagaactgtgttcttttctttttaacttcgcttcagtctggcccaggctctgaagacttctcagagtacttagtgcctgtcttttctggagctaggaagagagacatagggattgatctagagcagtagtaggcgaactacacaacctgtgagtcaaatctgccctgccaccagtgtttgtcaataacgttttattggaacacgggccctagtttgcatattgcctgtggctgcttttctgctacgttggcagtgttgaatcattgcaacagggaccacggcctgcaaagcctaaaattgtctcatacctggtcctttagataaaaagtttgccgaccctgatctagttaggcattagagctacactgagagtctcctacgtgataggccttgtaataaatgtcaaaggtgctatctcatctagtagtattagcatctctgttttacagaaataggatttgatgccaggtctgttggacctggagccctgtctagaaaatgcgcctgacaggaaggaagtacacaccttggttttggcttggattggtgccccgtggtccagcaggatctctgagattcgcacgtgcccatttcgagctgcacagtggagaggtgtcaattcgtcctttaaaagacagagtcaaaaacagaaagcccaaaaggcagctatcagaggccatttggagagaagactgcctatggcatcatcccagcccacgcaagtgctgacgtttcctcaagcaccagctcgacctcagcacagttttactattgcctcccactgcacgcggcactgcccagaatactgctgcaggcggctccgggaggctggtggtgcatccctaactaggtcaccaagggcccgctgctctgggtgaggcttgtgaggggggacctccctccccctgcctggctacagcacctgctggcacccaccttggtcttggtttctatctgggctccccgatccagcagcagccgcaccatgatcacgttgcccctgcgggaggcgatgtgcagtggcgtgatgccgttctgaagggaggaagcaggacggtcagggcgcgtcatccttccctggaatgcagctgctgtgcacccgctccccttgtccccagcccccagtccccaggcctgcaacagcgttgtcagggcatttctggcctaagatattttatttttttttattttttatttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctaagacattttaaaacctgaaaggacctgccaacaggatgggtcatcccaccacaccacccaagcccatgcctcccagagtcaacataacagactgcaggaaagtcagttatatggaaatcactctctgccctccaggtttcccatttttaggatgggcaaatggagtttagggttttctcaagacaaagcaggtggaaactggggggtagatgatcagaaacctgccagcaaggagcccgaccagacagcagggctgtttaacccacaggcacttctgccactgggatgaaacccatggtgccgaggcaggagcaactgccagccccaagcccccggacagtgagggcgcacgtgccccagggttacctgtggtgtgaaattgacgctggctcctctgttgaggagcaactgggccacgttgaggttctcgtagtgagccgcaatgtgcaggggcgtgaatcccgtctggggcacaacagagggggagaaacttgttatatgtgatttacttctatctcagaatcagccctgggatgcaggaaactcaggtggggcaacaggactttacagacaaaggagattttgatgggtgggaacatttggtgagggggtcaagagaggctttatggcacagtgtattcaaaagctgggggtctgccctgagcaacccgaattatatgttaacctcagactctgtgggcccgttcgtcagagtgatcaccgacaaagagattttcattcatgaatgaaagtgtaatggggctatggtctttttttcctcccatttagacagggtctcactgtgttgcccaggctggagtgcagtgtgatgtgatcacagctcacttcagcctcgacctcctgggctcaagcaatcttcccaccgcagcctccccagtagctgggactacaggcgaacaccatcatgcccagctaattttaaaaaaaatgttttagaggcagggtctcactatgttgtccaggctggtctccaattcctgggctcaaaccatcctcctgcctcaacctccgtccattgtcatcattctgttccagagcctgaaggcaggcctaaccccacccaggtgttttccagacaaaacccggtggatctggggccggtggaagaggggaggggcggggtgcaggaggggactttgaataactccagtaaatccatttccactaaaagaaaaccagcagcctcagcctacagacagcagatcagcagtgcctccgaacaccggagagcgtgcccaggtgcacgcaggcgtgcaaggtcccggaccccctttctccacaccccagcccctgcacgcctcctccctccactacggggcagccggggaggagagatgaaggaacatcaggaaggccgcctcctggggttccagggtgacccgccctgcccgcctggacacatttccagatgacctggagcaacaggaaccacccccgctgctcaccaagagcacgtttctgggcatctgccagggatttagagcggggctgtccaggggcccctctgcgtcctggggtgagggcgctcagtgcgcactgcccgccctgcacgctcggttctcctgcctgggaagtcgctgggcgtgcgcggtgccccctgagcccacgggcgtccgcggcccaaggctcctccctcctcctcgccctcaccttggaaagcacgtccgggttggggtcgttctgcagcagcaccgcagccgtgcgcgtgtcgtcgttgcgggccgcgatgtgcagggccgggaggcgcaccttccccttggtgccgtagttgatgaggtgcgcgacgacgttctcatggccctgctgcagggctaccgccagaggcgtgaagccgtcctggccagaggaggaaaatgctttgctctgactcgtctgacgccagccgcccttcacacgggacacacccttgcccctcgggcttatgctcccagcagccccagcctgagggacctacctccaccaaagccctcttcatccgccaagtttagcctaaatgccatctcctccctgaagcccttcctgcctccacttcctttctctgcaatctcacagagcctgccgaatttttctttagcattaatttagttttcctttataatttgcttccagtttgacttgttttaagaaacttttgactgctcagattctttgccggctctctttctcaccccatctgctggtaccaggatagtgccttgacaaggcagaacattactaacaccgaccaaaggccagagtccacaccaggccctgataattcaattgtgagctattattattattattattttatttttgagacagggtctcactctgtcactcaggttggagtatggtggtgcaatcatggctcactgcagccttaacctcttgggctcaagtgatcctcccacttcagcttcccaagtagctaagaataaggcacacaccaccacacccagctaattttctttttctgtagagacggggtcttgctgtgttgcccaggctggtcttgaattcctggcctcaagtgatcctcccacctcagcctcccaaagcggttggattataggcatgagccactgcgcttggccatgagctactattattaattccctcagttgtggacatactaaagggcacaggaccgcaggaactgataaaacggaatgacaacaaagtcatgtcattgagccatccaaagttaagagtcaagagactccttggctctatctagtccaatttcatcatttcaccaatgacaagactcaggaccatagctaatgagacttgtccaagggtgcatggtggttttgtggcaagagcctttctcattaaggcccaatgcaaacttgccaaccatacacatgcatgcttcgcctgccccctccagtcacaagtattggccacagcgggaaggacaccctcaagtgtgacgtcgtttctttggtacgtgtctgggccttcttcaagacccatgactttgtcattagtcccttgcagaacctgacagcactctggattagtgcagcgacctgaaggtcatccatcatgacatggatgcaccccaagccacatcccaggtaggtgtcacctgaagcaaggttgtacacctgggagacttctggtggtgacgacatttttccaaggtacttacttctgtggctacattctggttagctccattttccagtaaaaacttaaccacttccaagtggttctcttgtgctgccatgtacaggggtgtaaaacctttctgtaaaccaagagaggacatcattagcatccacccgcaatttaagaaaggcctacaccagcacaacgtcctctcacctggaggacagcgctctcttcattccatttcctcccacctgacccctcctaaggaaactcattgtcatggtgactggcgtcctgggattattacaaaaggccacagaggctgtgcctcccctcgccaccgtaggtcagtctcttcagctcacatactcctcattgatttcatcaatgctgcactgcacacctcattcccccagtcctcagtttctctctccacctaggctacaactggacatactatttggcttaggtccaaaacaattcaaccccgtcatgcttaggacacgcggtctatgcatgcgaaataataaaggacaccttcaccactgctcagagacatgctcctgagaaatctaggccctgccccacagtagtgtgtgtgttaacacggctgccaatggacccacgagggagcagcaaagaggaaccacctgtggaaaggcaacaccctctagtccagaccagagagccattacctgtgactgggcgttgacgttggctccatagttgacaagctcccggaccacctcatcctgcccggctagagcagcgatgtgcagggccgtgttccccttctgaaacacatgggggaagggaacagaggcggtttcccactgggcccgctacgggaccagcaaaggtctgtggacaggtgctgcttgagggacccgggggctttcttcatggccaaaaggggtagaaaggacacacgtgtgtgcttgacccattgcacatcctgaaatcatactgaaagtacagggaggaagatccagcctgttctctatgacaaacaatgctgcaagagccataaaaaagaaggaaatcaggtcttccgtagcaactcagctggaactggaggccagtaacttacatgaagcaactcagaagcagaaagtcaaatactgcatgttctcactcgtaagtatgagctacataatgtgcacacgtggacatacagagagtggagagacactgaagactcagagggtgggaggtgggggcaatgagaaattatcctttggatgggatgcccactcttcgggtgatggccacactaacagcccaggcttcaccactacacaatgtatccatggaacaaagctgcactcataccccctcaatctataaaaagaaaaacatttaaaaagaagaccaccagcactggctggtgtgattggagtggcgcaggaagggggcaggtgacactgagatgtgcggttgaaggagagtgcggccatgtcaaaggaactcctttttttctattatgtatccataataattaaaaataaaaaatttttataaaagaaaaataatactgaaagaaaaaaacaccccccgccaacacacaacttctgaacatctaatctgctgtgtgcgtgcagcgtcctgtccccagcagacagcgcgttggcgtccctcaggacacacactggaaggcttgtcagcgagctggccttccgcggacctgcagctccgctcagcctgcaattctgcaaggcaacaagccctctgagaggcctgggagcgccaggaaaggaggccagcaggtccctcaggcccatacctttgacgccatcccagggatacccacagaccacaagctgcagtggagcggacaaagagatgggaggcaggagagtgaggaaagcattatacagaaaaggaaagggtaagatcaactctatgatgtatgtagggaagagaagaaaaatcagaaaataaatggggggtaataaatggaatacaatctggccaagaaaaatacaaagaatatgcaacatactagtaagcaaaatgtaatgagtaagggttcaccaaatccaagaggagagaaaaactggagagaataaacactggaggaaaaccaggcacgtaattgttttaaactttgtaaaagataagaaccaatagcagagactgagaaataaggcaggttctgagaaagtgagtttttgttttgttttattttgtttttagaattggaggtctcgctctaacacccaggcaggagcacagtggcaccatcataactcactgcagcctccaactcctgggctcaagcgatcctcccacctcagcctcccaagtaggtggggactaaggcgtgtgccaccgtgcccagccaatttttaaatttttttgtagagatgggctctcactttgttgtccaggctggtctcctgtcttagcctctcagcactctggtattacaggcatgggcctgagaacatgagtttaacattctccggttttcttgtctggattcttttttgatattaaacaacaattcacagacaggaccagcagcctccatctgttcccgggatacccacagccttccagccaggctcctgccagcccctgggggtcctggaccacaatgtcagcactgcctctgggggtggactcccctgggtgccctgcacctgagcccccattcagggagttgaggggcaggggcgggcagcctccactccatgcttctgtcaaatagggcgagtggagaaaataggtccatggtcggacccatctgtccctgcactacttaaggagcagagatctcaaacaacctcatttttagagtttagacagtatgtagttctttttactaaactacataatcattaactaatccatttcaagaaacttaagaactgacaagcagggactttggactctgaccttgcccagtggctcctgtcacctggaggaaaagcttcctcactgagatggaagggagcagcctggggcctagccgtgtggccccccagccgctgctgaccccgcttccccgggtcagggaggcagccccatgaggccgccctgggggctgggaagcagctcagttctgtttcttgtactctgcctggtaattcaagcataaagcctggggctgggtgcagcagctcacattggtaatcctggcactttgggaggccaaggcgggaggattgcttgagtccaggagttcaagaccagcctgggaaacagtgagacccagtctgtctgtcttttctttcttttttttttttttttaaaggcataaagcctgtttatgttttgttttgtttaaaggcaggcacttcccatctgttgcctcctgaagttgtctttttgatttctcctcaagttctatttgatgaagaaaaaggtttttcctcaggtatccattggagaataaatgccagatatgaaagtctggaagctcattaataatttttcatagaagtccaaagagcctccattgagaggcttggcacctgctgtaccaaatggagcagcactgctggcaccagaaacttttctagacaccaggacgctgagctccaagtggcatcttctgggctcccatggaaaagaaggaggcatcctgggtgcattcattcactggccacatgcttcctgggcataagcacagaaggcctgggccagcatggaggcacagaggccatggagacatcaagaggctcacgtcaaaggtttctttccaactgacccttcctgcctgaagtccaatgatatgagagctttccttaccccacgaggaggggaaggtcaccctgttttggggagctcatcagtgatggaaacctggctatggatcttggttcgggccagctgagccaacggtagcataagtgaggaataagaacacagggaaaattctggaagtggacctcctttcccctatctacacacacacattatgaggctcaagaaggcccctggcctaagttgtgggagtcacaggaaaagggatttgtgagcctctattttctctgcccctccctcaccatgaaagaacatggcctcaaaggagcaggaaaaattacttagctatattttgctccacaaacacccaatttctctattttcaggggctcacagagctcagagcagggaggatggttgcatgggtgctgattgaatgcaagtggaagggggagagggaccccaagtgagagagcaggcttttttccagtggagatgaaagctgtccccattcattaacagcttaggtgctgagctccagtctctaagagctggagataggaggatggggagagaatgcgtttgttttgtgcttttaaaatttctaagtacattttaggaatctaaattggttttggctttttactctttttcttcttttttttttttcatctttctgctgcctgggagccccatcacagtccccaatctgttgtgactcttccccagcccacggtttcagttccacctttttttccccctctctctggatggtattccaaagccacgttggcttagaaaatttctaaaaataaaaaagacacaccaagtgttcacttgcaaaatcacaacctggggaggagattcggaaacagtcgaagcgctgaagcctcgtgtttccgcagcccttgaaggcacgccagggcaggcgccgctccggcacacgcggggcaggtcagatggcacacagctcacagccaggtacgtgggagtgtgcagagaaaataatctcacccttcatccacacgaaaagcagggtgggaacaattggaatttgacatagaatttgggaaaaaaataccccgtatccagtcagaaagagcaactcagtttattttacccataagtgcaataagatcttttcacattcaggaaatgacatgaaaattacagaattttacctcaagagatgattctaccttcataatattttggtagttcacttcataaccataaattatatctgttctctacatattgttcttctatgttctctgcttgagaggcggcaaactgtttgctgcatggaactgaaattgaggttgtgtgtgagaccacgtgtaatatataccaaaaggaaaataagaggctagggggaaagaactccagaagaaaaacatgggaaaggaacagaggagggaagagaagagaaaacagtaactggggagacagtacttgagttagcaaatggagatgattttttgtttcattttatttatttatttttgagagggagtctgtctctgtcacccaggctggagtgcaatggcgcgatctcggctcaccgcaacctccgcctcctgggttcaagcgattctcctgcctcagcttcccgagtagctgggattacaggcctgtgccaccacgactggctgatttttgtatgtttagtaaagatggggtttcgccatgttggctgggctggtttcgaactcctaaccgcagatgatctcccctcctcggcctcccaaagtgctgggattagaggtatgagccaccacgtccagccttgtttcgttttatttatttatttatttatttttgagatggagtttcactctgtcacccaggctagagtgcagtggtgcagtcatggctcactgcaacctccacctccgcttgaggcagggttcaagcgattcccctgcctcagtctcctgagtagctgggattacaggcgcccgccaccacgcccggctaatttttgtatttttagtagagacggggtttcaccatgttggccaagctggtctcaaactcctgacctcaagtgatcctcccgcctcagcctcccaaagtgctgggattacaggcgtgagccaccgcgcccagtctgtttcattttatttttaattgctggctgcatcttgtttgataaataagatgcatgtcaggtaaaaaatgaaacttattttgcaatctatagatgtatcaatttcatgactctgggattttgaagttgagtcactggtatttataatctactgaaatggagtgaaatacgttactgtggatgcctggcgtcgccccatgccaaacgcctcctcatgaaacagaatgctgttccagatcgttagcgaggagaggaaatcagtttggggctgaacaaggaagacttgctggagaaggagaaatgaaagaaatctggattcttctctacaaccttcagtaacaacatggtcactagtatttattgattccttactacaggaatcagtaatcaattaatatatccaataatcaataaatgcatccaataagtagtaaatgcatccatccaataaatacatccaggcatttgatgtatgccatctcacttacttttcataccaaccctgcaactaagtattattatctccattttacagacaaagaagctgaggcttcacagtggccaagtaactcgtcccaggtcacagagcgtgaagtatgtctgctgggattcgactccaggcacctgattggcgcttccagagcccttggacactgagttcgagtcaaggaccctgagaaagtataaagccatcaggaaagggctctatttttagatacgtaacctagtgatgaggataaaggcccactgaatctttctggaaatggggtctgtttcaggcagcttcagggattcagagaactaaaaagtgattggaaggataagagaaattcagatgcatgcctgagttctctcatgaaggactggtttctaaggaaggactcacaaacttgaattttcaatgcaaagctcccccactccctgtgagacataccttggttgtcgtttctagaatgatttctttgtgcagaagttcaaccaccattttcacatggccttccttagaagccagatgcaagccattcaacccattctgtaaagagcagagaggcgggaagggcatggttagtcaaatggtgctttctgcacgtcccagtgggggcccaggccccttcccagccctgaggtgttcacagcactggagaaaaggagtggagtgtgtctagaggttggaaggggcacagggcagggccacccagcctccccttcacgcctcaggtcacaacagagcagagatggaaaggaagggcaagaactagcccgccactcccagatgtgaattaggcagtaagctctcacaacacccatggtgaccttgaaattcatgtcgaggccaggctttaggcagcccacttaattaaaatgatgtagcttcaacccctggttaattttcacaacagtgaccaggaaaagcaaagtggtaacaccagtgcatcctaaatacttgtagaaatagacatatgtttggtaagatgttaaactctgaagcaaggtcatatgagaaatgaataccaccaaccacccagctgtaagatttcctcaatagaaaaatcagtattaaaatagcccctttggcccagtacagtggcttacacctgtagtcgcagcgctttgggaggctgaagcaggctggttgcttgagcccaggattttgagaccagcctgggcaacatgatgaaaccctagctctacaaaagaaaaaaaaaagcccacagaagtagacaggtgtggtagtgtgtgcctatagtcccagctactcagggggctgaggtgggagaatcacctgagcccaggagtttgaggctacagtgagctgagatcctgctactgggtgacagggccagaccctgtctcaaaaataaaaataaaatgtaaaacataaaatagcccctttgccatcccaccatttcaaaggtgaccaaagaaggctgcctgacagttaagctttaggaaaagcaaaaaacaaacaaacaaacaaacaaaacacattttccttgcccaacccttagcccacaagagcagagccaattaaaatttaaccaattaaagttccagctgcatctggtgaagctgccactgtgctttatggaaggcagccaagttcaagttttattcatcactctcatgcttcctgctcttctgatccttgccctgaaaggtcttgaaactttccggcaaaagctgacatcaaggagtgctactcggagccacaaataagtctgacaatatgaaggagcaaaatatcaattccaacggatgagtcgatcttggctccgtacagaaaatgattttagtcagtgagcaaactccacctcctgcttttttattttgttcctgtcctcctccttccccgccagcaattttcccctcctgtcctcctcctcctggcctcccgttttgattaattctgttctattgcgttcctttccaggggaggcctcagagccacttcaggctccagttcatgaaacagatcctcaccacctagacggagggcttggtttctgcaggtctgatgtgcggggtccctgactcacgtccccaaatatctccgcagccccaccctgcgttcctcgaattccagctctcccattgtgtcagggcatcattttcaggaggttcttgttcaaacacaagtattctacctgggagtgggagtgcattagcccattcacagattaggcaaattgctttgccataactagcagaggaaagtcacccaaagtcatgataggagaatggaaggggtccaacgcttcttttatgtggggaccttggatgcagcaaatataacagatgccttggatgttagagaaatgagaaggggggctgcaaagggaacattacctacctcctatttaggtcagggcagccctgcacccttgcctatcagcacagccagccttgccagggtgtgtgtgtagggagagggggtggttcaccaaatatttcctcatgcaaacgcctgaaaatgaccactggccattaggtttcctcctcctgcagattttgcacaccattcagtgaagggtccaaagctgtgtggattcttctcacccggtgtcaatgagtttattagagaaagctaggtcagagccagtctgggtaatagagagggagaaagtgcttgagggccagatgggaatccaggagaaggggagagagcactgggcaggcagaaaccaactcccctccccttgatttgcaagacaaattcactgcaaagcaatttgtcgagtgaccagtgcgctgagagcctggagccactcttgcttctgcatcttgcaactcttttctggatgggtctgcaggaaggagtccctgctccttctcagagcagggcgagctttttcaggcagcacacagcatttctgcaagcgctcttccaacccagcggcagccttatctagaagcttcctagtgctgacagcggatgccctgtgattgcttgggaactgggttggtgtttgtggctgtcggcatggctggagtgacagcccggcagctgctgctggccgcttactgcgggaagctgactcgcagtggcagccagccttgcctcggtgctgacggctggggttttagtgcttacttgggcagcgcagtcgctctgatgagcatctgtgggtcctgaatgcatcaaagccacaaaaccagcaagcctggaaagaaatagctaatgcttgccgctaatgctctgggacggccggcccctgctgtttgaggccaatgtcacgatttcaatccggagggattctagatatactgtctgaccagagaatgcaggactcgaaagggatattagaggtccctgaactccaccctttcatctgcagctgaggaagtcaaggcccagagtagtcaaacgattggcagaggccatgcagcgtctccagggcacagccacacacaggaccaacctggatttcccagaaaaaaggaggtttggttttctccccgctaaaaactactgtgataactggctgggcacggtggctcacatctgtaatcccagcactttgggaactgaagcagccggatcacttgagggcaggagttcgagaccagccgggacagcatggagaaactctgtctctactaaaaatacaacaattagccaggtgtggtgacacgcgtctgtagtcccagctactcaggaggctgaggtaggagaacagtttgaacctgggaggccaaggttgcagcaagcagagatcacaccactgaattccagcctgggtgacagagagagactctgtctcaacaaaataaaacaaaaccaaacccaaaacgatgtgtttctttttatcagatgatgaaagcatatcttcccttttctggtctccatgaagcttagagctaacgaatggatctgattgtgacctcggcaattgatctctaggattttattcatcactctgatctgcagaaaaccccctttcttctcttcctgggtcccatgcctccctcgcaaagggcagagagtaagaccctcgccatgcaaggggccgcctgagtagacctgcctctcgcggagctgcactctccctccatcccagatcctggcccagcgatctccttcttatgatttttaaaaaatgttttctcactttattgtagatttgtctttaacatagtcaccctaaatcacttccaagtctattactgcggggatctgaatccactgttctcagcagggccactgaatcaaaccccactgggcacagttaatgagagagatgcaagatggtccgggaatgcaatgcctgtaaaaaacacatggggacggggctgaggaagcacttgtctcagccacaggtgtggacactgttgccatcaaacgctgagcaattacttaacccaactcaacaaatatttatggagaacctcgtctgtgtctggccctgtgctagaaatgaatcaaacacaaactgtttcccttgaagaactcagttttgtagggaacacggatgcataaaaaataaatgcaaaatcatgtgaaaaaagccccaaacagcatgtaaaggggtagaggtggcacagaagagaaaagagttgttctgtcaagaagacccagaaagcttcgcagaggacttttcaaggcagaggtgcccacctgcacaaagacagagttgcaagttcattaaaaacagcaagatgagaagtgtttagattctaaacccataagctaaaatatgctcccagctctctcagcaagtgccctcctcttcctttcccaaagcatttggatacaacagatgcacaaacatccagaccccagcagcacctctcctccagcaattggtcttagtacgtagatggctgcgtctacctacctaaggggtggtgacagccacaagtcaccaccatctagcagcggaagttgctgaacacctgaaaacgaacctcctgcacacacacacaaaggagcttgtacagctgtcttattaaatgcataactagtttatgcaggagaccacttctgatatccaaaagagcattttgtggataaataccatatttaatacttcctttttctttaagcagatttttcattgctcaaatgagaaggaggaggaggactgcaaattatgtgagctatttgttcttagctgtaagtatggacagagatgaactgtaatttaccacctcttcaaaactgagaatcatgttttactttagctaaatcaagtttaagttagcttggttgctaaaagtaaaaggcagcttgctgagacttgctttgaatcttttcggcgactccatctcaccttcacagccacttttcttgaagccaaatggcagacaggctgttaaaggggattggaggtgtggataaatcacatatttcttccctcaaataacagggtgtagaagataagcaaaaaggaagcagaataatataagagtaaatgatttcactaaattagaagctggggagaaaagcaataactacttgtggccattttttaaccatatggctttccctggaggaaaacaccagttcgctagagtctttttcctacagatactgccttctggagctccaattacatgtgttttagaccagttgatgttgttccatagctcttggctactctgttttggtttgttttttccccctcttttctctcttttctttcaatttgaattatttctattgacttatcctcaagttctttaattctctcctcagttatgtccagtctactgatgaacctgttgaataaattcttcatttctgagaaagtgtcttttgttttcagcatttcattgaactttttcttatagttttcatctctctgctgaaaatttccatctactcatgaatgttatctacttttcccactagatactttaacatattaatcatagttattttaaagtccatctaatacttccaacatccaacattgtggtcatctctaggtctgattctgtttattgctttgtctctcgacaatagttcattgtttttttctttcttttttttttttttttttggtgtgtgataatttttagttgagtgccagacatcaagcatagaagagcagtagagactgaggtaaatagtatttacggctggaaatcaacatgcctcttcttctgtgaagttgtcagcatggaggtgagaaggctgagtcaatctcaggggttgacctgagtttgagttttgttgttactttcagtgcaccacagccttcacattcttacaaaggtagactgcggttatcttgaactttgagttggagctggggtgccaggggctttttgtgtgagtgttcttgacctccctcaacttccagccatcctgcatgcctgggccttaaatgaggtaattctccatgctcctactcttctcccagcagtggcctgctcttccttattacaacatgttaggctggcaggaatgggcatgttctcttttgtcgtgctccagcttcagtattaggcaggctctgtacatctggccctctaaggtgggatttcttttccatgtttagcaatccttcccccttctctgtggcagcaaaacctgtctcacttgcactggtcttgggtgagtttcttgctcctcccccagcagtagtcgacccctgcttgttttttttgtgtttgtttttgattttttttttttttttagatggagtttcactctcattgcccaggctggagtgcagtggcatgatcttggctcactgcaacctccacctcccaagttcaagcaattcacctgcctcaacctcccaagtagctgggattacaggcgtctgccaccacgcctggctaattttttgcatttttagtagacggggtttcaccatgttggccaggctggtctcgaactcctgaacttaggtagtctacccgtctcggcctcccaaagtgctgggattacaggcgtgagccaccacgcccaattgcctgcttgttattggtgtagaatcccgggcccaaaacaatctacagcccctcccctaggagtcccaaggtggctgctcctatcttccctacagcagcaagtcattggcaggaatgtttcctacccctcccctggctgaggcagtttgtttctattcctcccctaggtctacggtctaaggattggtgtatctctgtatgcgtgcactctatatacacattcatgtaatcaccacccctcaatgtctacttcaaattaaggttcctgagttggtgcagtgagtgctggataagccagctcaggcctctggggctgacacacaggtctttgctcaaccatgtcccctgggatacaggcgcaaaccaggcccaactggcagacctgtgggcttcagcctggggccaggcactgcctcccacacctggacagcactggattaacaggcctgctcttacaggtaggctgggctggcttctggccatgcagggatctctggtccccaggagggggacagggcaggtgaggatgctgggtgggtggggaagagcaattgccttgttcacctcatgcacccatggggacctgggagtcccatttacagatgggtggggcttccaacccactccacccagaactgggcttccctcctctcagcaccccatggaggtaggggaggggaggcctgttttattctcagaataaatgttaccacaatttcaaaaataaaaataaaggtgagagggtctgtttttgcttcacatgagggaaagatctggagaagcggtgaaagctttgtgtccgttcctccctccacccctgcctgcacagtcacaggtcacctcctacacacctggctgtcgagggggcctcctctggctcctgacgtagcccaatacttctcatgggggccccgtggagaaaagcctgttccagacacactggcccacacttggccttcaagaacttttaagattttggtggctgggtgtgatggtttttaatcccagcactttgggaggctgaggtgggaggatcccttgagcccagcagttcaaggctgcagtgagctatgattgcaccactgtccttgagcctgagtggtggagtgagaccttacctgaaaaaaaaaaaaaagattttggcttgtatggtgaacacctctctttcctgacctctgccaaagctgaagcgatttacgtggcccgcttcttagagggctttgcctctgtttgaaattctgtttactcagctgccttactacctcaggcaggcatgagatgggttcaggaaaaaatgatcactttgtaaattatcgagctttttgtcattgtcggggtaggagccatgctctctgcagccttctgcatcctacatactccctgtactgagcccttaaggccagctgtccccatatgatctctttccacatggtcctaacataggagataaccttttaaggctctttttggcaaaaatcttcatgccaagcacacacacctagagctgtgcacctgcctttgctctttttcaggtggaatgtcaactgacaggattgttctgaaaagcgatctgtgtgatgggcggggaaggagacctcagctaggctatgtttcttttaacatttttaagaagaagaagaaaaaagtcacattcagcctgattaattcaatgtggagtattttcttgcaccaactgtgagaaattccattggcaaaatacacaattccagacatttgttctcgttaaattattcctctgtttagctcttctgattgccccagttgcactaattgatttccaaatgtatgaatacaggagacacggggaatttaactcttcctgtcaagagaaggggaacggtttgaaatagaaaggccttggtgtctctgcaaaactgcaagaacatctcaaaagtgaatgcctacattcccatgaggacacacagccctcacacctcctttccacgcagctgtttatttcacccgtgcacaaggctggccctgcctctatggagcaggcagcttcagctgcatcccgtgactgaggacctccccaccccacacctcctgaaattcactgctcagtcccccactccctttctttgagctgtgtttccagagaacctaggcaacatgttcatataacactcgggaaacacaaactttgcatcaatcaatatctattatccaatgattggtcgagccaggcccagaggcaagggagcactggccaggggaagatattatggggatggaaggcaccgcagtcctagaaagaataggcccgatagcagtggcagagacaccaaggagtctgaggaccccagagtgaataaaatgaaagatgagaaaagaaatgcctagatgcttttacctttacccatgcaggcagcaaagatccaggcagaagatcttgcctgtgataaggaggaagttgtctacatagtggactcctctatttaatatcctaggttagtgggatatatttcatatcccactttcctattcaatttggattctctgttgagttattataaacaagcaagtgctatactcgatgtcacagaagcttaattccgcaaatagcaaccaacttgtacatgtgtgacctctagctttgctctattattggtccttgtttgtggagtgagaccacaacagaatatattacgtttgcaggtctgcagccctgcagcagagtaggagagaagagcctaaactggggttacagagaggaaaagaaggactggagtgactgccatacttactccaaatcctgaaactgatgagaatgaaagaaagagcagggaagaaagcaaggcaaagaccatggagccacaggaggcagagcagatgatgggaagggaaggagcgacggcatgatagtttgtctagaagaggaaatgaactgagacacatcaaaaaaattactagagctatataagttttgatttctttcctcaaatcgcctacatcaaattttcaaccaaaacagaaacgaaatcaaagctgaaggagtgctttcccatcttcccttctcatccttctccttccctccccacccagctggagatgtcggccttagagggcagtgaacagggaggtgccctgcagggcatgggcagcagcgtgtctggggtctgagaaagaggacagctaatggagtggttgggaggttgtcatcacactgagcaaacaagtcagtgaatatgttaaggaggacgggcatcagtggcattcaggcctcctgctgtgtgaaggactgtacaaacatggggagaggaaaggctagaaagaattccgagcactgggctggaaccagaaatattggtgtgatctcattgattcttcatatatatatatatacatagacagctgtagacgtagttagcagactcatgtatgcatacacgcatgcacacagacatatgacaacccggagcaatgggctcatcgggggctggaccctggtgtctaagtgctgtctccactaacaggaaccagggatctttggagaagtgctgagccaggggtggggcagggcaagtacaaaatgagcctggggcaccttgtgccagaaagtaggaaaatgctcaaggaatgatgaggacatgtcaaaggatgaagaagccaactgatgggaaggacttttattggcccagcttagacttgaccattaaaataagtcatgggagtatcaggttgaaacgaagacaaatccataggagacaaatccatgagtccaaacagctctacacaaataaagaaaaaataaattaatggggaaaagaaaaagcttatcctttagtagaacgccagctaaaaaatgtagaagacatgatggaaatgaggaatcactgtctggagccaccacagcagtagctgatacaggcagatgtcattaatgggctattaatgtcattaatagactgaaatatttccctccctcaacacaatactgatcaattacaaagggaaaagcagtgaacttatagtagaaaaacgtggctggcaccaactttacttggtgatcaagattaacatccccaggagtggggagggagcatgatttcttttcttttttttttttttttttgagacagagtcttgctctattgcccaggctggagtgcagtggtgcaatctcggctcactgcaagctccgcctcccgggttcacaccattctcctgcctcagcctcccaagtagctgggactacaggcccgccaccacgcccagctaatttttttatatttttagtagagacggggtttcacagtgttcaccaggatggtctcgatctcctgacctcgtgatctgcccacctcggcctcccaaagtgctgggattacaggcgtgagcctccgcgcccgatgggagcatgatttctatggtattcctgtccagcatggccatatggccatgaggcagcatcagacagacagctgaggctcaaactacagcatggaaaacagtcaaacacatgagaaatgggcacgctgagggcctattccagatggaaggaggctgatgagacatgacaactaaatgcaaaatatcttcctggagagatttctgaaccagagaaagagagacagaaaaaggtggaggggaacagagacagcgtgagaaaacagacagagacagagagacagagagaggaaaggatggaggggagcaggaaagggagcggagggagaaagaagaaggggcggggagatgtgaaggaaggaggcacagagagagggagaaattgtcagaggagggacagttagcaaaatcctaatggagtctgtggattggatggttgtgttgcatcagtgttgatttccagattggcaggcacgtgggatggatacgtgggaaagtgtccttacttttggatggtgtacactggactgtctggggatgtgccgaatcaggtcacatgtcctacattatagacagatgaacagggacaggaagtgtagaagaacgggcgtagataatgcagacacgggagatgcgggaattctctgtacgttcttgtaacttttctatagattcggaactactaaacaattttttaatgggaggtaaggaggagtggtggtgaggtgcagaggctgctggaggagaggagtgatgttgtgggggtaattctggggtctaagtaggggacaggtggcccgctggggcttctacacattttgggaatcacagccagtatgaagttataattacatctatctgttctggtttttcctttctttcttttagagatggggtcttgctatgttgcccaggctggagtactatggctattcacaggggagatcacagctcaccacaaacctcgaactcctgggctcaggcgatcctcctgagtagctgggactacaggtgcagggccatgcctggctaatttgttttttaatgtttaatttttaaattattgatttgttctgtaggacaaggtctcactatgttgctcaggctggtcttgaactcctgggctcaagccatcctcccgcctcagccttctgagtggctgggcatctgtcctatttgtaaaggaactgtgaggcacgacctttactggagttctgatattattccaggatggaaaccccagagtgcaatcaaacacactaagagaacagccctcagcccacagggaaacccgctgatgggggagacctcttctggagggcaggcctctcgttctgcggggccataccacctgcagcctctttctaacccggatagtttatggctccccagagactgcttggtgggaaaggtctgctaaaaatatatgatcttggaatctaaggaatcagaagccaggcagagctgaagcaactgccgtaaccctagtggaaaatcacacctgatctcctttgcaaatctgtctcttgcctagggacaggaaagacagaataagagaagaaactgagaggacagcacaaactcagagagaggtggcgcagatggaaagggaggcaaccggctctgagcattttctctgtttgctttgttgcaatctaactttagccctcctgcctgggtagcgcttaggattcacagtttgctggatactcatgaggaggaaaaacactctaatccttttcattaccttaagaaaaaggaatgcacaacgattttagagctctgcaaggaaatgaatcaacctcagctcaccttctttctattttgattgtacagaactcgcagcagccctgtgctctgagaaatcctgcatctcagcagcaaatcaactgcagaggctgatgggccctggggaaggtggaggaggaagtgtgagctcgagttaatgagagaatgggactctgaaatgcagttcagcatctaagaatatctcctatggactagaaagagcatctatgcccgagatcttggtattctttaaaaaaaaaaaaaaaagacccagacctttagaagaagggcagtggggtcaggagaaaggaaccctgggcttctaaactgtccttatctatgacctcccaggcttcaatttatgctgctttgcaatgacaaaactgctctgagcttccagtttcgtctgaattccataattccaagaataagacaacgtaacagcttgcagaaaagagttaagctatgtgttttgcatgtacagaaaaagtaatatgccaagattcatataaactgttaacagtggtttcgcagaacgtaagggagttaaaatcagagccaaggcttgtcaaaacggacagaaagggtttacaccaaagaagtcaatcgaatgcaaacaatcgtggccaattctcattcctcctctagtctcatcacaaccatgggatctgctttcagcgtttcctctaacaagcagagaggcaaatcttcctcaaggcccagaccgagtgtcattttgcctgtgactttacctgtcccctctctttgccacactgtaccttatttctagccccctaaaagtggattgctttcttggccatgttccacggaccttgataactctctcaagaccctcatcacacagaattgcatttatctgcgcttgtgcctgtctatcccaaaggcctgaattctttgagatcctgtgttttgctcaccttggtaatcaggtcctagcatggagcctggtgcataaggtttgcagaattcaatgcaccttcatggaacctgccacacacaggcctatcttttttctttgtctctaagcactatgaagatcatgtctagtcttcatattctaaattcctagagcaatgaaaccataatgtggagtttagagagtgtgtgttccttgcactacattccggatcgttcctgaaggtgctagtcacccttttcccagtccctaggattccatggaatgtccctgctgtgactacaaatgaagatttttatgtaactgaactggtcaattagctcttccttggctgcagaggaagggaaaatgaaaccagtctggggcagatcacccagagcaataacaggcttgctgcgcagtgtcaaatccatcctctgagtcagtacagaggcttgggctgggtgtctcagtcctgggctctgagactcttcacctctctgagtctccccagcctccctggtcaagcacctgctctaaccaactctcagggtgacgtcagcattaacggtgtcgcaggtaccaggtgccaggcataggggcacctagctgcatatctggtttaactatttaacacagaacactcttctcccaggtgagggctccaatgaaacgttctttcttcctcatccctattccagagctgcaccaaggcagcaagtctaaagaagtttaataccacaacaccatcattttaggaaggctttctgtgtgttttcggggtgcagctaggatcagagaactatgtagtttaatacatttttctatgcctgtcaacagttcctaagaaaaagacaatgacagagaaaagtgccaggttctagatctatacagatctagctctaacctccttagctggattgaccaccatcctcaccctctttcatttcatgtaccccaacctccccgaactgccccctgccccagtgccctttggcactccagcctttgcagtctgttccttctcacagcaattcctgtttcccagttctgtactcggagacttgtatccttccttcacaacctttctctgactcattagcaagccagccactacccttagacaagaaacgacataagggcaggtcccaggacctgctcatctttgactggctggctcttggaacattagaacagctcaaaaaatatttgttgaatgaagccaggcgcggtggcttacgcctgtaatcccagcactttgggaggctaaggcgggcagatcacgaggtcaggagatcaagaccatcccagctaacacagtgaaatcccgtctctgctaaaaatacaaaaaattagccgggcgtggtggcgggcacctgtagtcccagctacttggggggctgaggcaggagaatggcatgaacctgggaggcggagcttgcagtgaacagagatcctgccactgccctccaacctgggcgacagagcaagactccatctcaaaaaaaaaaaaattgttgaatgaatgattacacggacaaaaacatctcctgtactccttcaggatggcacttacgatactgaatttgtaatcttttatctgcaagctggaccttttacctgcctctgagttctttgaaaacagggcacgaatttattcattttggttagccctagtctctagcatggtgcatggatcattgtaactggtcaataaatgtttgcagaataaatgaatgagcagagaaatttcatcttggacttttttttttttttttttttgagatggagtcttgctctgttgcccaggctggagtgcagtggcacaatctcggctcactgcaaccttcgcctcccgggttcaagtgattctcctgcctcagactaccaagtagctaggactgtaggcacccaccaccatgcccgactaattttttatttttagtagagatggagtttcaccatgttggtcaggctggtctcaaactcatgacctcaggtgatccacccgcctcggcctcccaaagtgctgggaattacaggcatgagctactgcgcctggcctcatcttggacttcttcttcttttttttttttgagaaggagtttctcccttgttgcccaggctggagtgcaatggtgcgatctcagctcaccacatcctccacctcccaggttcaagtgattctcttgcctcagcctcctgagtagctgggattacaggcatgcgccacaacgcttggctaattttgtattttcagtagagacagggtttctccatgttagtcaggctcgtctcgaactcctgacctcaggtgatctgcccgcctcggcttcccaaagtgctgggattacaggcgtgagccaccacgcccagcctcatcttggacttcttaagcccaactccccaaatccaaagtcatacagcataagatgatattcagaagtaacttttagacctcagtttcctgagctataaaatggaaattgaatgccgtgagctccactaagccctaagattctatagcttggaaaggtcgtaattatcaccatcaccagagcacaagaaatcctgatcaaaagacttggaatttggctgctgtagaaagtactacactgtagcagaaattattgttataggcgctccatttattccaaatgcccgcaaccctttaccttcaagataaacattagggcttcctaatgcacatgtggaactttagggcacatccagggagctggcatggtttcacgtgctttcctgggctgggttttcgcactggaaatcgtgtatgcttttgtgatcgttcagatggtcgagcttctggacactgcagcaaatattgccaaatactcgacccgtggggctaacgccagcatctgagccatgcttattgcaggctcattatcctaagtatgcacgattgcacaaggcttttacaaagtgatggtgcttagtctagttcctacgtggactaagtataaaatatataagctttcaccattcatagctatagcaaacaacattgctgctttttttttttccacacagtctgtcaactgggtttatgagcacgtgctataggttaagcaggatcctgacacagagcaatcaggaaagcaaagccctctccccttaaggtgcctacaatttagtgaagacaaaaataagcagacacatacatgcatatgaaggcacgcagtaacaagcactatggagaaaaatgagacaggcaaagaggaccaacagtgcctgggctgctctgggaagtcttcactttgaactctgccttacgctgagttgtggacgacaaagcttctccttttcatggaaaattatctcctggagtctcaagccctttctttgctatcaggaaggccaaatgaaccagcaagtgtcagcatcatcggaatagaacagaaaactaaaagagtgaggctttttgcccccgggattccagctcacggcccccagtggaacatccatgtcaatctgacaattgtaggaattcaggggacacaggccggcactgctcttttctggttttattttatttggttgactcatcaatgtgtatagtcagttacttcatcccagaaagtatttttgtattgctatagtctccatgagaaaaaattttgatttgatattaatctaacaataattctggaaactgagcatgtgaagctaatatgggtctgtgcacaattatgtggccatttattaagacaaatgccagagtatctaccataggacacatcctatgccaggcgctgtggagaaacagagtccccaatcatgggttttgcctcactgcggcttggagcccaccaggagagggaagacctgctcgatgttaccaagccacatagtaggaccagctaggcttgagccttaagagaggtactgacacatcacaaaggcaggaatggcttcaagctatggggatcaaggctgtcttcacagtggctgttgagctgagatggaacctaccaacccattgctatgtggctgctctagctggaagaatgacccattcccaggctgcgtaaggagccccggcaaaatgtgtgctgagaccaacacatctggggtgatgacactccaagcctgggcagcaagtcctctggcctccccacctctcctctctccccattattcaaagccaccccggggtcccacctggcccccgcaccagcctcctcaccagtcttgccgctcttgtccctgtgctctgagtctatcctccacacagcagcgagggcaattgtttagaaacctccatcagcataagcatctcttgtgtaacaccttcaaatgacttcacccttatggcaaaatctaagccctcaccaatgcaagccctctttgatctgaccccaggcactcctccaacccccctgcctaccaccttcccttccatcactcaactccagcctcactgttcccccaagcaaaccactcttactcctgccccagggcctttgcacgtgtttcctgctctcccaagaatactgttccccagaaaccacatggcgctctcccttacttcttccagacctcttgaaagtcgtctccctagagagccctcccaaccaccccaccgaaatagtcaccttgaccttcctcctccccagtgtctcccatcagctgacttcatgtatgtgcccatcctcttagctattgtctatttccttcaccagcatgcacaggccacgagcgcgcagactattttgtctgtcttgttcagtgcctagaataggcctggcacagagtgggtgtttaatgagtgctgtggaatgaccccacacaggcgagtgggagtatattcaacatgcctttcctccctgctctcatcagcccccgtcagcactcgacttcctcgaaggctgaatgacttccaaatatctatctttgggctggacctcttatctgagttccaggctcaaatatccaactgcttactatatatttctgcttggattcctcagagcctccttaccaggatctggaacagctctgctcttgactcctcccccgtgtttccacacaccggtctgctcccagcatccctcatttagtggatggtgccaccacccacctgccgtggaagccagccctcggaaagtctttcttgagtctacttcccctcagtgccccatccaatccatcacccaagcctgcttggctttgctccatctccacagccatgaccctcatccaagatgcccacacgtccctcctgcgctgctgggcacacacaggcccccccccactgcaccgctgggccctccgcctgttttccatgcggtagccagtgagaccctttaaagcacaaccctgatcacgtcactcctgtgcttgaatctgtggttcactttcctctatgctcgggagaaagactggaatccttcatgtggcttctacaagggggggatattcaaccaggacacagcagtacagctgtgcaggtgttaaatgctgaaacgctccactcctccaggtcagtggccactgccgcaggctcttttttttttttttttttttgagacagagtcttgctctgttgcccaagctggagtgcagtggctcgatctcggctcaccacaacctctgcctcttgggttcaagagattctcttgcatctcagcttcccaagtagctggaattacaggtgcctgccatcatgcccggctaattttttattttagtggagactaaatagttccatcatgtaggccaggctggtctcgaacacttgacctcaggtgatctgcccacctcggcctcccaaagtgctgagattacaggtatgagctatcgcgcccggcctgctgcaggctcttaagtaccccatccctgctgctctggccactgtccccctcccccagaccccttcccctcagtcagcaactacggggttaacatctggtgcagctggttagcacacacatgcatgcacacacacagctctggcccaggggcacgctgtcccagttgtttataatttcaacttctagtttagattcgggggtacctgtgcaggtttgttacatgaatgtactgcatgacactgaggtttggagggcatatgatcctgtcacccaggtagtgaacacggtacccaatagttagtttttccacccatgccctcctcccgccctcccacacccatagttcccagtgtctcctgttcccatctttacgtccctgtctctgtcgctgagtgttgtgactctcgcccctacctgtaagctccagcacaatcccagctccaccttgcctggcttctcgtgctgtctgcactgcacccactctggccttccttcaaccctctgctcctttctctgcctctggggctttgcacaggctgctctctaagaccggcatgttctcccttgcttcaccttatttgcctctgctcctccctcacctcagctgtctcttcctcatggtagccttctctgacctctgactctagggcagtcctctcatatactctctgccttccattcatggttcctaacatagtttttggtatgcatatctgtttgtgtcattatttgattaatagctctcactgccaatagactacagttcagaacggataaggaacgtgactttaaaatgaaattattctatcccttcagcccagctctccatatacacgtggagatgcacaggaagtacattagacacaggcatctaaagtgcaaacaataaattttaaaattggcattcacataagggggttcctgtatgcacacatgtgtgtgttcttacatataaatttcttcttttctgtagacatggtaatgataatgatgatagaacattagtagacacagtctatacaacaaggaactgccctgaatattcagacatctcttatataagccaagagttcctctttccacgctacttagagtaattacttcctattatggcaaacagtacgcattctttccacaaaaacatactatttgaaagtgtgttacttatgtaaggataagtatttgccctgttactgccaccacagtccatcagctcagaagattcaagccgaaagcaaattctcttgccatgaccccgggacaagagcttgcttttatgcgtgttttaaagagcagaaagctctagtagcattaagaggctggccctgtgcacattacgcagatgcaggatcgtcccgctgggtgcattcgtgggtttcatgcaggcatgggttcagccactgcagtccctcccccaccaccaggactctccctgcaacagcaaaaccaaactgccctgtgcaaccagaatgaggttcagggaaccctgaccagctcctttccaggcgcagccacctgcagctacctgttctgctcagccacagaccataaaacagggaccaacagggccacatctggcagctgtgggaattaaccagcagcaaggggctttgcacttggtgtgtcctgtctttcgttcccttctgacgctcatttcataacttgtggcagtgtcctctttaagagagaggccaggcttagccaggactgcagtcttgagtctgaggcaggagcctcccctcagcctgaagcagggctgacagccacttgtcactggcgctgagccaatcggaaatggtgtcaataaagtgcaaataatacctcggtgcttgctgctctctgagcccaaaacgaaccgaagaggtgctctgaggagagaaggcagagtgacaaggcagttacacccaaggcctctccaacgggagaccaatcaggacacagctattccctggtggcatcaaaatcttccaatttcacacagaaaatgagccctggctcaagtctaacacacgttcagttgtccccatttcagctgaatggattcctttgagagctagaatcttaacccttggaaggcctctgaaggtgtgattcacctccgctgagaactgcactgcggagaaacacatctgcaattctccagccacagtaagaacaaagaaagcctccaggtgtgcatctctgcaagcccaagaatgcatcccaggtggagagagcgagcaacccaccctgcctatggggggctggggcaacacagctgcagcctgtgcagctgcttctggaggtgcagtgctaagaaggtcccagaccctgtctcctgaacaactctcacaccaagactctcaccctgcctccaggctttgctgcatccacctcttggcatcaaaaaatgggctgagtttcaacctgctatgcaaaggccagcctggcagatgctttgttagaaccaccacaatgtcctctgggctgtggatatgtggatgttggcatttctgggtggagggatgagaaaaggggcggggggcctggtccttcatccagtttgcaaattccagtcaggtccacatacctcactttccctctgaagtgcactgccagggtctttgcttcttatcacacacctacttctgtttcccatcacataccatactgctccattctttctgatcttttagctgtgaatttctgccactgcaagaccaactgaatccaaatggggtcttagccctaggaatggaggcaggtagtattttgcattttatttatttatttatttattttatttatttatttaagacagagtttcactctgttgcccaggctggagtgtagtggcacgacgatctcggctcactgcaacctccgcctcctgggttctagcgattcttctgcctcagcttcccaaatagctgggactataggcacgcaccaccatgcccggctaattttagtatttttagtagagacagggcttcaccatattggccaggctagtctcgaacttctgacctcgtgatctgcctgcctcggcctcctaaagtgctgggattacaggtgtgagccaccgcgcccggtctattttattttatttctgagatggagtctcgctctgtcacccaggctggagtgcaatggcatgatctcggctcactgcaacctccgcctcctgggttcaagcaattctcctgtctcagcctcccaagtagctgggattacaggcatgcaccaccatgcccggctaatttttgtacttttaatagagatggggtttctccacgatggccaggctggtctcgaactgctgagctcaggtgatccgcccacctcagcctcctggagtgctggcattacaggcatgagccactacaccggatagtattttgcattttaaacaggggcaggatggatagggaaacagtagatgagggggtaggacagaggcatgtcgcccatggaaaacctaacctacgttcagaaaatctggccctgctggcttggaaaagtcacccaagccactaaagtacagaggaaccatgaagacactatgctaaataaaagaagccaatctcaaaagtacaaatatagcaggattccgtttctgtgaggtccctatagtagtaaaattcgtagagactggaagttgaagggtggccaccaggggctggggagtagtcggaaatggggcgttagtgtttaaagagaacagagtttcagttttgcaacatgaaaagagttctggagatggatgatgattacaggataatatgaatggacttaatcccattgaactgtacgccgaaaaatggttaagacaggaaattctatgctgcatatctgaccacaattaaacacacatttttaatggctaagatggtttttaaaaagtcgcaatggataactgtattctaaattagaaacaattagcatgtgtaactaaacaacttaattggcaggcaaatatctacaaacaaacaaaacctgtcaccaatccacaagcccaagccacacacctgttcccttcctggagggtcattgcctctctatttagttagttcctggatctttggctccaagcccgagtctctgccctccaacccaacccaaacacattttgtttcctcgccagccccttctgaagctaaggcttggctgtgtcactcaggagccctggagagccagcctctgcaccagccccaccatcctcaacccgagcccactcgcctttgtcagcacctaacacaagcggggcctcgttcctcgactttcttctcaggctagccgagaacccacacagactgctggtggacaaaggagactgaacatccccactgacacagcatctttcaaaggctcttcctcctgccccaattcaaaggccacatattctaagacaacagcgggaatcaattgcaacttctaagcgaggagaccgcaggggatctgtgcgggcctcgcccacactgttcaggcatcagcccttctctgtggggccctgggccacggcaggagtggaaacagcaaggttagggccttccacaggcaggagccctgggggagttttgaggccactgagaaaaggttaatagaggcagtttcaaagctctcaggaaatggcatcaggcaagagctactcttcagagacaacaggcctgcctccatcccacttacctggttacaggtgttaatatctaccccattccgcaggtgatccaaagctttgtccaagttacctgatcttgctgctctcagaaagctggtagcagcatcggcctgtgaggaaaaacaacaggcggtgagtgtcctgggtgtattaatgacttctccaccccgttcaagtcccaggcccccgcagcagcccctgcatcctctgatgtggcaccctggtgcccacagtgacaccaggtgtgcacaggagcctgagagcccctggttggactgccttcacacccaggcctcccttcctttggttttttgttttttgttttgttttgttaagagagagtgttgctctgccactcaggctgctggagtgcagtggcacaagcgcagttcactgcagccttgaattcctgggctcaagagatcctcccaagtagctgggactacaggtgtgtaccaccaagcccaactatttttttaaactttttttttttttatagagacagggcatcactatgttgctcaggctggtctcaaactcctgagctcaagcgatccttccaccttggcctcccaaagtgttgggattacaggcatgagccaccgtgcctggcccccttttggtatttttataagcaaacgttcttggcttggactcaggaagaatcagcctttgagggggagcccattcctatggcaagcgcacagcacagcctggtgtctccctgctctgaggtttcaggggctccacagtcttgctgaagagtttgcaatatcacagaggtccctggccccaagaatcatgaatgcaggcaccaaaggaaccaagcgtgggctctttggagctgttttgtgtttttgtttctatttgtctgtttttcctttttagagatggggtctcactatgttccccaggatggtctcgaactcctgggctcaagcaatcctcctgccccggcctctgaaagtgctgggattacaggcataagccaccatacccagccctgtgtttttgttaagtaaacaaacagctatgtgctgtcaagtaaacagcacatagcacttactatgtgctaagagccattattagcactttacatatacagtcaagcccatttattcaaccaactgtggatggaaaatttgcaggaaaaaaattaaaaataacaatactaaaataaaaagtaatactaacagaaggctgggcgtggtggctcaaacctgtaatcccagcactttgggaggccaaagcaggtggatcacgaggtcaagagacagagacaatcctggccaccatggtgaaaccccatctctactaaaaatacaaaaattagctgggcttggtgacgtgcacctgtagtcccagctactcaggaggctgaggcaggagaatcgcttgaacccgggaggtggaggttgcagtgagccgagatcgcaccactccactccagcctggtgacaaagcaagactccgtctcaaaaacaaacaaacaaacaaaaaaacccagtaatacagaaaagcaatgctgtacaacaattatttacaaagcacttacattaggtattataagtaatctagagatgatttaaagtatatatgacgatgtgggtaggttatatgcaaacactatatcactttacatgaggtacttgaggatctgtggattttggtatctacagggggttctggaaccaatcccccacagataccgaaggatgactataatatatattcacacacatgcacacgcacagataagcattttatcctcatttggaatacccaagaggtaagtgggattgcagagtcccattttacagatgagtgggctgaggcacagagagcagaagtgccttgtgcagcatcccacagcagggaggaggcacagccaggactcagatgcaggtagtgtggctcagaaattcatgagccgaacctcccagctctgcagccagctcggtctcagctttaacaccaggcgccccccaacagatttcttaaatgagagtgaagctcttctgttccttagctgctgctacgtcacccaccccatgcatctcagaccttgcccccaggaacatctgtttcctttaaagatgagtgacagccagagagggtgagagctgaggacaataaaataaagtttactaattgatatggtttggctgtgtcaccacccaaatctcatcttgaattgtagctcccataattcccacgtgccctgggagggatctggtgggaggtacttgaatcatgggggctggtttttcccatgctgttcccatgaaagtgaataagtctcatgagatctgatagttttaaaaagaagagacccccctgcacatactctcttgcctgctgccatgtaagacatgcctttgctcttccttcatcttctgccatgattgtaaggcctccccagccacgttggactgtgagtccattaaacctctttcctttataaattacccagtctcgggtacatctttattagcagtgtgagaacagactaatacactcacaaagacaaatgtaatgattaaagcccagtcctcaggcattggagtccgtggcctagactcagagccactccactgggtctagctgagtgccctcaggtacttagacaccgttggcttctatttccttatttgtaagctggggagagtaaagcctttcttgtccccttttcatgatgcttaaaagaaataaacagtgtttggcacatagttgcatacaaggctgagttgaaagggtgagagtggtcatatgacaagccacacatgggagaagcgtgtgacgccattcccacagaagacccacagtggcttcctctccacccaggcactttgtctccttcctctacatgccctcctaaaaaaaacatgctgcagtgggctgaatggtgccccccaaaagatatgtccacactcttatccctggaacctgtgaaggtgaccttatttgaaaaaaaagtctttgtagatgtaattaagtcatggatcttgagacgagatcatcctagattacctaggctggccctaaattcaatgacaagtgtccttagaaaagacagaaaaggagaagacacacatgcacacacacacacacacacatgcatgcacatatatgtgtatgcacacatgcacacacagatgcatgcgcacacacacagattcacacacacacacacagatgtgtgcacacaaatctacacatacacacccatacacagacgtgtgtgcacacacatgcacaccaagagatgcatacacacacacgcacacacatgcacagatacacacacctgcacacatacacatgcacatacagagacctgtgtgcacacacacacacacacatgttcacacacacgtatacacacacacagaggtgaaactatgtgaagacagagccagagactggagtgactttagccatgcacaaggaagcaaggaacctctgggaggtggaggctcatagaagaaggccctgaagccctggagggagtgtgtccctgtggaggccttaatttagatctccagcctccagacagcgagagaacacatttccgtagtgtcaagccactaagtgtgtggcgatttgttacagcaaccatgggaaactcatgcacacactagtgatgaccacccttgaacacccttgaacacagaagactccaaatctacagccgaagaccaaatggaactctcatcctcctccacaaagcagcgcttcacgtcttcaccactgaaacagggagtccctagggcatcagcagtagggttctccagccttccagacagggggtcctccctccacactcaggtgctgccccacaccacctcccagcccccacccacaaccccaggcctgcagaaatgctgcttcctcgctctgcctcccagccaacctcctccatccctgcctcacccagccaacctcctccatccctgcctaactggtcttccccaaatcctgacttcctgccagccctccccaacctcaggtcccacatgggccccctatgatgtaagctcaagttcaagtccaagccctgtggctgtctgttcatgaggcacactcatctcgctgtccccacagcggcaggagccccttctcacctcccttgtcctctgtgacattctcatgctctgtctacctcctagcctgcaccttcctcctccctgggccctgaagctccatctccctctggtttgctacttccaatctttcttcccttcaaggccctgatggtggctacttcctgcatgaatgacactatgcttagacactcagtatttgccatctttaaatctaggaaccacaaaacaggagcttgttttttttttaatgcacttaaaatatctctttctctagctattgaattcaggcaagtcttgtctccccagccaaactgtttgcttcttggggcagggaccaagtcttctatctcttttgaatcctccaaagcattaagtgtctgctagggcgaggcctcccttgacctaaagcacatggcattcacatcctaggttcctcagcaaggcatctgtggggcaggaaatatttcagaaatgaagatcaagctgttggctctccaggcatgagctgggtttccagagaaaacccagtcaaggtttagtctctcagataaatgttacttatgctactgattcagaaagtctgtctagattcagttattaggaaaaacactatattattccccaagaataagaatgttaaagagacatttctcccaccaattaactaccgtttatggcacaataataggattcaggctgaaaacctgagaatgggtggataaaaatagactcaatatccactaatgacactgactgctcaaagcactgaatccaggaagaaaagaagaatatttatgacaaactggcagggcgtggtggttcctgtaatctcagcactttgggaggccaaggcagatggatcacttgaggccaggaattagagaccagcctggtcaacatggtgaaaccacatctctattaaaaatagaaaaagtagccgggcatggtggtgcatgcctgtaatcccagttacttgggagggtgaggcagaagaatcacttggacctgggaggcagtttgcagtgagctgagattgcggcactgcactccagcctgggcgacagagagagactctgtctcaaaaaaaaaaaaaaaatttatgacagacaagcacataaatagagggtaagggaagctccatatggactagattgaggaaagctaaaccatttctgttgttgccataatagaatactaaaattataataccaaccattgggacaaatgtattaccagcattatatcttttaattcttataacaacctgtgggtaggtataattattatccccattttagaggtgatgaaactgaggttttgagaggttaataacttgcccaagttctgcagataaatacttggggtgattcaatccaggggtaccccactgaagtctatgcctttccactgcccttgaccccaagggcgttcttggccatttcaagcctgagggtgttcaggcagccctgacaggctggcggctgggcaggcctatatgcctcggccgttaaagagctaatccatggcagaggaaaaatgctaggaggtcccactcaggctctgtccctgagcactctattcagaccaagacaggtctctagaagggaaccatctagttccagcccttcttgtcactgaggataaaattgaggcccagggaagtaaagtgaccggctaaggtcacctagatagttagcagtgaagtgcaattgctaaagctttttctttctttcttctttctttttttctttttttctttttttttttttttttttttttttgggcttctccaggcatagagtagtcaggactctgcaggatcctcagggcatctgggaggtgaactgcagataatgatgccactcccagtagcaactacacatcattcagtttaattccacaatgtatttactggggtcctatttcaggaccaatatcctgctagggcaaagagagaataatcactcagaatataggtccttgctctcttgatctgaataatcaagcaattgtgttataaagcggtcatgtgcattgcatgcacctgtggatccattccatgagtattcattgagaacctcctaggggccaggcaatatttcagctacagagcaaatggcccttgttgggatatgagactcatctttaccatcgtgttctgctgagcccctactgcccatctgtgtagtccaactgctccaattcaatgacctgtcctcagtacatccagcaaatgcaacagggcaggaggcgtgtccaaagaatccaatgtgttccattcaaaacatttacctgagcacatactgacccaaaaaacaacagcaacaaaatacaaacctgaccatctctgggctatgacaaaccggagcagaatgactggccctctccaaggctcatccattcccagatcaggaggccaggaggcctgctcatcctatacagaaaactaccccaccgtgtccacaagccctggccaccagtgaggtgctggcacctctgttgtgcaccccaccaaagctgtcttctggtgtctcttcccctcctcatctctagcttcgttttaatctaattctacctgtgtgcgtgttcggggatctgcacacagcagacattctgctgtgcctgcatccctgctgcctaatcaatgtgatgtccctgaacttcctttcaaaacaaaacaagtttactttcacaaagctctccctaggttttaaacacaccacataaattaattcactccctcctcagaataatctcacaaggcacgtgttttgttatctcctttttatagatgaagtgaccaagtcacagaaaagtaacttgtccaaagtcacatagctaatatgtagcatggccaggatttgagtctaggtagcatacttcttaactattgtgctataccgcttcctgggtcaatcatttcccttccttccttccttctttccttccttccttctttgcctccttccctccttccttccttctctttttctctctctctctttctctctttccttcttccttcctttcctttcttttcctttctttctttctttctttttctttctctttttttctctttctttctttttctctctctctcttctccatttctttctttcaagacagagtctccctctttcttccagagtggtcccccagtggtgcagttatagctcactgcagcctcaaagtcctgggctcaagagatcctcctgcgtcaacacccccttcccccgaatagctgaaactacaggcgtgcaccaccacacctggctaatttctttattttttgtagagataaagtctccctatgttgcccaggctggtcttgaactcctggcctcaagcaatcttcccacctccacctcccaaaatgctgggattacaagcatgcgccactgtgctggcctaatcattttctagtgctcataagggtcctctccagttcagctctggctggagaaagccttctgcctgggtttggaggctgtgcccacgtcaggagaaagggaatggaagagaaggaagggaacagaattcttcctaggaattaagttctcatcaggactgctctgaaagggtggtgaatcctggttacctgagacacccagactattattaaacttgcacttcctgagcagatactaatatagcaatagatggggtgcgagggggctccagtatcctgagagggaggggccggaagcacgctgcagaatgtcaacatgctgtcacccatgagcaggggacattgggaaacaccagcaggcagacccaggtgagagaaccccagggcctcctcacaccttctctgggggttggggtggcctaagttttccctaggacaaatcatgactgacctcaagatttttagtacaaaattcctatctagaaaggcgaatggaaactgagctaatatcaattgctgtaaacagtcataaggcaatgccactttcccaaggggtcttgttggagcaaaatgcagcttctttaacgcagccactgtcagagctctcaggaagagatttcaggtcctttcctgggggacctgcagcccagccagaagacaggcagcagccctgatgtggagctgtctgcttgtgcttgggggatctgagagccgcactggggtatgaggaaagacagctgtccccagccagcatagcctggtagccctgcctttactcccttgacgatggagaaacagaggtgaacactgggccctagtgagtgtgtgttttattatgtttctttccttttgccttccagaaaggtgtgctgttacagctttacaaactgtctccaggctccccagtctgactaccattggcaaaaataaaatgaataagttaaaggtgtcactgaggaaacaagacgcctgagcggaagtgctgggctccctcttaatctctcaacccgaactcgggacattgggaaaacccctggggttccctgtgctgtctgcacccgaccctggaggctgggcagggtgggctgggacgtcactggggaagacctggctgagatgcactgctcgaccacttgatgctgtgctcatctaaggccccaaacctccatttccccattgctaaaatggggatcttgccagggggctgcgagaatcgaaggggacagcggcagagagctccaggcttgccagggcgcccaacaggtctgccttcctctgccccattcatttcctgctacctgggggcctccgggcgcctcacgtttctgagttttaggggccagacgtgccgcaagccaggtccccgcccggcccaaggccgtgcatctcccaccccctgctgaatctacccggccaggctgtcccctggggtgaggggacttggcctcggccagggcccggcccccctcggggcaccccggcggcggctccacgctcccgcccgtgcccctcttccaggccggccacaagtcccgctgcctcccaaccccggctccagcccctccgcggccgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctcttcattttctctccatgattatgtcagatgggaaagttaatgcgaagcgctctccggagagcaggcacctgctgccaagccctgcgaagggggtgcgcgcgggggcgcgggcgggggtgcagccccagctgcaggtgccggccggcgggctcggggcgggcgtcctgcccctgcggaggggaggcacacacgtccagtggaggtgaggagctccaagctgcatggcctccctccctgcctcccgcctccccgaatgccctggtgaatgggccccggagcttgccgagacgtggccggggtgagctcagcaaactctatttatgccccataaccgatttgcatgttttgagctcttccatcgtgtcgtgagataccagttaatcagcctattccagattctgcctgagagccgccagacgcagctgggttgcaggagggcagagctgtcactccccgctgcctcccgcactgctctgacgctggcggttaactagcgtcacccgaggctgtgtccgtgcagtaagcaaccagtgttctgtcctgggaccactatcaccctttcatgcagtcatttcaggggcagatgtcaaaacccatgtttgggattttggagaagactaggggtgacatcatcaagagtaggctcaattcagagggatgagggaaccgtaagtaaaagcagtgtcaggtaactgggcccctggcaatatggcttgttcagatcataggtgttttgtatcataagccggcttcttgctggcttcaagtcacagtcaagacacaataccaaatgctcttttcctctcccgctgtcccctgacattgtacagtacagctgcgcgttggtgaggaactagcacgctcagcgcctattagctgatggacatactgcattatctcatttaatcctcacagccacccataaggtaggcaacactactacagttggataaatgaagaaactgagcccagggaggtaatgggtggagaccaaggtcaccactagtaaatggtgggtccaactggttctaagccaaattgatccaaagccctgccactggccgcaccagcaagattcctaacaatagtgtactcagcgccaggaagagataatgtgggggatgatcttgaaggatcataatcccagcattttgggaggctgaggcggggggattgcttgaggccaggagttcaagaccagcttgggcaacatagtgagaccccctgtctccacaaaaaaaaaaaaaaaaattaattagccaggcaaggtggcacatgcctgtagtcctggctactcaggaggctgtgacaggaggatcacctgagcccaggagttggaggctgcagtgagctatgattgcaacactgcgctccagcccaggtgacaagagtgagaccctgtctctaaaaaaataaaaattaaaaaagaagaaaatactgtgagagtgtgttacaaagccaggtacgcttcaaagctatgcagcaatcagggggcatcccaaggaagtgggataatcaaagatcaagagaaaaggccagggtgttgccaaaaagagggatctgaaatgtaataatacaactcctccccatgggggttaaaaaactggtatttgaagatgacaatgtgagaattctccaggcataagatcctccacagcactggggctgaacttgaggatgggcaccctctcgaaggcagcagcctgtctggatgtaagtcacacagccccttccctccccaggcacatgctgctaaagcccagctcaccctccaggtctctcgccttgtacctctgaaaaccaccttccagatttgctagaatcctctacacagagaactccaattaataaatgatggttactggaacatccctgatcacagcccagtggaatatctcaagggattctaatgcactgttccaacattaatatttagagagagagagagaaaattccccgctcagatgagtaaataatatatataatacttttaaaaacacgaatgcaattgacttgcacaatgaactgaaagagatactattttttagcaactatttgaggattaattgacacactacgagttgcacatttaaaatgtacaatttgctaagttttggcatatgtatatccctgaaaccatggccacataagataatgggcataatcacctccaaaagtttcctcatgcctcttggtattccctgcctcctgccggccagtccacatccttgtcaagacttggtatgatctgtcttaattcagacatcctaatagatgcaccacatggctaattaaaaaaaattttttgtagagaaggggtctgttgcatttccccaataactgataatattaaacacctttttcaggtgcttatctgccatctatatatcttcttttttttttcttttttctttttttttttttttttttttgaggaagagtttagctcttgttgcccaggctggagtgcaatggcatgatcttggctcactgcaacccccgcctcccaggttcaagcgattctcctgcctcagactcctgagtagctgggattacaggcatgcaccaacatgcccagctaattttgtatttttttagtagagatgggatttctccatgttggtcaggctggtcttgaactcctgacctcaggtgctctgcccgcctcggcctcccatgttgttgggattacgggcgtgagccactgcgcccagcttatatatcttctttggtgatacatctgttcaaatcttttgtccatttttaagttggaatgtttgttttcttattgagttttgagagttctatctatacagaatatctgtcttaaaggtgagataaacagatcttacaagtaaaatattcaaagctcagtagcaaaacattcccagtcgcattttggtactcggttcttataattcttaagctgtatctttcttcatattatacaacgctgtgggttatatacaatcacaaattaaaagatgtgatagtcatagtggaccagaagctgaatacaacccacagcactctgagtgtaatgggaaagatgctgaagtattatcagaggactttagttctcagaactgccaagaattcttgacattagtcatgacctccttagggttgaggctttgaaaaacttaggcaggcgatgagtcaggcaaggcccaagaggaggagaaagaacacaactacaaacatgttgctcagtgaggcctgaggctaaaggagctgagatgataaagctaagggagagagcccttgaaacataaattccagcactgcagcctggaatgccacattggagctaattatatggtgcccagtcccaggtgtggtggcctgccaccaggactgaattctaaatgtctcccaggcagagacagcttggttctcatgttccaaattcccagtccctctcccttgctttccccacctactcctctatgtgactggcacagtgccgggcagtgctaaacacagtgattactgactggtgttagaagaatgatgtccccaacacttccatgagtcataaagaaactgtaagtcttggggttcaattgctatggaaaagatttagattccacagaaagaactttccagctataagagatacgtgacttaatagaactctttattcagaaagggtttaatctttgcaggagatccttcaggatggcagaaaaaaaaaacctcaacatttgatctggcatatagaccactgggtaagctgtacgacttggaagggtctctttgggccctagggattcagaaagctaaactattgttcttttccccataactgactgtcccctcaaccttccatcacaaccacacccttagaccacaaataatcatcctgcttctccatctgcattttgttcatacttcaaggctgcacgttttaacgtaggcatttagtgtgctaagaacttgctagtgagatcaaaacaaaccaccagaaaggaattgatgggctgaagaaaaggctaaagactctcggcagacacaggccactgttctagcctgtagcttcatggagtcttcaggcttttcccgtcttgctaaatattttacctactgtctccttgcaggtctctctgcagacaagcataatgaaaagctggaggcctcgcctgtggggttctgtcctctgggccacatgcagctatgccaagcagggatgatgtgggagagaagaaagggaagaaatagactatgcagcacttaaacccccagctcgctcctggcttgatgcagtgggctgttctcagtatagacagggactctgggacacttgatgggctgctgctgctgtcaattcctgcagggatttcacgagctggaagaacacaagcctgcagcaaagaatcccatgcgagtgggattctcaggcgactctgcctccccaggatgatttgggagaacaggtccgggctgcttcaaatggtggccagtcagagacatgaagtggctcctctctacagggacatcagagctgagatcagggcagccccaggattcgagagaagggcatcctggcagctcaggccctgtggcaatgaccgtcgcgcttaaccctcctatgcaatcaactcaaacccagaactcaatagcaacaacactatttgctttctggacagcctcttaagaggctctaaatcagtaggtctcccacaattgagctgtgcagcttttgataaaggaaatgacttttctgagcattgatttcttcatcagtaaagtgaaaatagcttcacccatctctccaatattgggagaataatgtaaaatgctgaccaccacttctggcacatttggtaagtgctctatcaatgacagctgatgctcttttttcctcctcccctccatttcttctcgactaaagcttttgtcaaaggttaatgtctcccccagaggtgtgggttgtcactgatcttgcttcaacactggaaaatcaaggcctcatcactgcttacccagggtcaaacatccatggtcaagatcaggatcccaagaaatctcaaagctctaccctgcacccagacctcttgggcttacaatgcacccttttcaatgcccatattctctgcagcaaagaaacaatgtgtggactcagttgtgcccccacgctccctgtccgcagctgcccttgcagtgtcctgctgctggctgtggccagctgacccgttgggctctcctcctgaccctccttccatctgttccatcctcacccacccaaggagccgcccctgctcctagagactctgggcaccactgataagggtgggtaccaggaactccaccctttaccgagaaaggcaggctggtttatcgccactcagacccagccagcgaccaccctggggagtgtgtcagccaccaggagcatcgctgttggggaaatgttattaactaggaaggaactttacagaatgttccacacaaatgtcacattgaattcaatcagaaatccagcctgaccccccctaaacctggtcattccttcttaaccttaatggcagtgacagaagaaagggagagaggaatggagtcttggttgtttttctatttaactttgtgtagggagtgcccagtggtcaattaaggtgtcctgggcacccggcctggctggagtaagggatggcaagtgcgggggtctatttagggaggtgatcagagcccggatcaggccccacagagttggcaccaatctccatcatgttctttttaagagggttggcagccctggagtctatttttaaacccatgagaaaggtgctgtgtggattccaaaaagggccaacattaaacccgagatccctggaggagggagggaaggggggaggcacagctgaacctaggattttctcttcacacacacaggggttccccttattcctgggatcagatattgactgtccttccaaagggatctcttgggttacaggcccactctttggcatggctttggtggaattcgactcctaacgagctcgtgagttggaaagggttttgcacaccgggtctctttttcagaattgagatttttttaaatccctctacccccagtgtgaaaactccatgtgcttttgatatatccggcatctcccccttcttcctactttcaaatcacatgttctggaacccccgctccctcctgcatgcactgcagagcccacagccgagaatctacaacaggaagatccaaggaaagtctaagttccccacggccacggtgcccagctccccagaaacccagtcccggtgctggagaaggatggggagtggacccaagtggcaagcctgcgggggacaggattattttcccaatagtgagaaataaacaggcatccaaacgccactgtttcccatcaaataaccagatgaagcgaacagaatgttttatgtacaataacaaatttcagcttcagtatctgtgtctctttttggataagaaatagaaccagaattcctaaagaacaaaatgccttgagattaagcaaatgcttctgctgaatagttctgggaccacccaggaccccctgggcagggaagtaggagacgaggtctcttctcatctccgctcaactcagaatccccaagcctagcacagaagcaccactcaatacatgtttcctgagcagaacatgatgcagttttgtgccccatgtcaaccaggtaggagctcccaccagtcatgctgaaaacaacagacatgagtttaagcacaatgctggccgcacaacagaggctccataaacgttagctggattggaatccagtcaactcagatttctaaatgaatcagatgttcggggctagttgactaaattgtcaatgtccccacgtgctattatagcccctgtagaaacagcctggggaccactgtcctcttctgggcagggaagtttcaggtgcttcccatcccagggccagggccgtgctgcagaaaaaagcctccacaccccaacctgccctgcccatcctttccccacaatctccattagtcctaaattgccagtccaagcccaagagagcaattgtttcctcagtcccaaggcagcgaagcagacagctcttcaatagttcacatctttctgctgagggtgggaagatattggggtgtcttgtgggtgcctaaatagaattccaagtgcacccgcatcaccaagcaccctggcccacgccgcagagcatgccacatttccccactgcgcaaggaatgggctgcatttagaattgacacttcagaacatattgtggactggggagccgagactagagtggaattacacacattttggaaaatgtggatgagcggcactgccagaatgggcccatttactaaactacctccagtgtttccaaacattagggaaaccttcctctgcggcctgctggtatgcgaggaggaggagcacatactggagaaaatgcaaaatcaaaatcattgggaaggtgctaatagggaaaatagggactcttcttttttttttcaagttgccaaacaggcttaagtactggcagtgaaccccatggctccagagtttctgaaggatgcccaggcgttggacagccctgcatggcacgctcttcctcagcaatgaagaaagattcccacccttccttagaaatgcaactttgcctgatataagctgccatctggagcaggcggggccgaccagggggtaccctgagactcctcctttatttgaacaatttgccccaagggacagagccaggatgggtggcccattgccagccagagagacctgcccaagattccagaggggcttgtgaccctgaaatttggggtctgtgcccctggagtttgtccagcctctggagcaaggcttcccttacatggagaaggtagccttgaaccatccattgggaactaggcctggaaggccccgtccacaccctctagcccatgatgattcaccgcagagacaatgagatacagaagtgagagcaggaagggggaactgatttgaagataataataataaagctacagttagcagggcatggtggcttatgcctgtaatcccagcactttgggaggttgaggcaagaatatcacttgaggccaggaatttgagaccagcctgggcaacatagcaagatctctgtttctccatacacacaaaaaattaaaattagccatacatggtggtgcgcacctgtagtcccagctacccgggaggctgaggtgggagaatcgcttgaggccagaagttcaaggctgcagtgagctatgatcctgccatggcactctagcctgggcaaaagagtgagaccttatttctaataataacaataataatagctacaatgtgtgagccaggtattgttcaaagcatgttagatgttaacacatttaaccctcaaaaccaccctacgagttaacagctattattattcccatttgacagaagcagctaaggcacaaaaacattaagtcatttgtccaaagtcctccaggagtaacatgatgcctgatgcctggggtggtgcatgaaacacagtaaaggggctggccctgggctttgcaccattctgcaacctaaggtatttttagggtagaggggaaaactgaaattcaatattctccagtaagagttgctcagtcttggaaatttaggtgcaaccggggcatctttaataatgtggccattctctctattcagaaaaaatgccagccaccaatcactatcacattcaatgcagaaatgtgaggtatctgtttccatgaactaggccctccagggtttaatgagcggggatctgtcctttccaagagccatggagaaatggggaggccttgaatcaataatcccagtccactccaatcgagttctctagaattacaacagtaacatcgtcatgtaacctccattgcacacttctgaaccaagagaaagaagctccagggagctggtgctacgtcttcccggctggcccacaatgatcctagactccaagaaaggataatgaggtagaccaagcccaggggaccctctgctgtgaaacccacttcttcgccttcattggggccctgctgataaggggtggcttccactggctaaatgctgactgcagaggtttcctctctcttcccagagccaaaacattgcaattaaacccaattaaactactaactggcctacctatgcctctttaatttttccatttgtacaacttaacaacaggaagacaggatccttcctccaagatgcacttaagctcctttcaacggggtgcttagcagctaccactcgaaaacaccttggcgtcagccctcgacttcctagtcctgttttctctttactaccaaggaaacaagagcaggtgtcacacataatacttcacacagggctcatcgtattattttaataattgaagggaaccattttctttctgtttaatcctcttatgaattctggctggctgctctttcagatatcttttcatacagtatttatatcaccctttttgtaactatttaaatttaaaaggtgaggaaataagctctaaactgtcaaccctcagctgcatttctttctacgttgcttatctgcagaaaactctgcccatcccaggggaatcctaaggtatgtctctaatctgggtatttcttatctgcacaatattgaagggtgtctagggggccccctcttaaagccttggcttcatgtctttttaaagaaatatggctgggtgcagtggctcacacctgtaatcccagcactttgggaggctgaggcaggtggatcacctgaggtcaggagttcgagaccagcctggccaacatggtgaaaccccatctctactaaaaatacaaaaattagccaggcgtggtggcgtgcacctataatcccacctacccaggaggctgaggcaagaaaatcactggaacccaggaggcagaggctgtagtgagctgagatcacggcactgcactccagcctgggccctgggcaacacagcaagactccgtctcaaaaaaacaaaacaaaacaacaataaataaaaacaaacaaacaaacaaacaaacaatgttatggttgtgttggcaactttctttccagctctgcagttccatgaattcgtgaagtgaagacctcatttctactctaacatcagtgctgaagtccactttcataatctccttttcaaagtgacctgtctcagcactcgtgaccttgaactcctgaataaagggatgtcaagcattagagaaagaatgaaaaatgcacagtgaatctagtatcaaacaaaaacagccagcgcatcatttctggaatgactgagttttagccttcggagagagacatttccaggatttctgaaataagataccaagatgccaatcaacatttcctaaggacaatcattaccaatatccacacccgcctctactgcctcaagtgcttttcgggtgagggtcacagagataaagtctcaatgcaaaaattcggtgggactagatagataggctttttcctcattcatttattctttcactcaaatgtgaactgttgaattgcattgtacaatctcagcacccagtggtagacacaaaaaaagtaaaggctgtttggttcctactcttgggaagactgcaaactaacagaggtgaaagatagagctgtatgaaaaataggacaataaaagggtcaaatactcagtaagataatagctcaagagatgccccaagacagtgtgcaattaaataccaaacgagaggttgcaacaagaaccaccaggagttcaagggagtggctgagatcagagagggctacagcactgggggcatctttgatggagcagtgagaattgaacagaatcttcaaagactgccaggttttaggaagttgtggggatccatttcaataccaccaatgctttttcaaaggccgctgtgttccagaatcttcttgattataaaagataatcagagaacacaggcttcctgacctcctggagagaacgtgtggatccagaaccaaacgcttgaaaattaaaacatgtatgttagacaacaacataaatacgtctattgtaggaagctgtgtgaatgttatgtaaaggaatgattcgttgctaacgatcgtatagcctttacagcattaaatgtctcccgttgtgaggttggagggagtttccatccctcacaaagattttatacaaagaggaaaataaagtgatgatttttagatttattcagtcatttaaaaattatgtgtgtgcctgtggaggggtcaggccttgtttaggatccgacactgaacacacaggcaggaagcccgcgctcatagagctgacattcctatgggagggaggagagagagatagaggagcagtaagatctatttatcccacagggaagtggtgagtgctaagaggaaaatcaaacgtggagtggggatggagagggctgtggggtgcagtacccgatggtgttcagtcccggaggcctttatgaggaggtgacacttggggagctggatgcaggcagggataaggcagcagcacctggacatgcccaggctgtgacaggtaagctccatgcagtgggagaccactctagtgccccaacccatccctctcctatccctgagacatgccccttgcttggtctggaatgcccttctctacacctacagatgctagacaacttttttttccctttctctcactctgttgcccaggctggagtccagtggcacaatcatagctcactgcagcctcgaactcctgggctcaagagggccttccacctcagcctcccaagcagctgggactacaggtgagcaccaccacacctagctaatgtttttcattttttttttattgaaatgaggatctcactatgttgcctaggatggtctcaaactcctggcctcaagtgatcttcttgccttgggctcccaaactgctgggattacaggcatgagccactgtgctcagcctctagtttgatgcccatgggacaagcagttagaggcactggtggaggaacaaaagaaaaaaagaaaagacaggaatcaatagcattttaggaggtgctgggcactgctctaagcattttacaagtgttcacccacttaaccctcacagcaactttataagtcaggtgttctacttatccttattttacaagtggaaaacagggcacagagaggttaaaaaacttgcccaaggtcacatagcagagaagtggcggagttaggatttgaactcagcaaccggagccaagtcggccaccgcaagcattctgcttttgtgcctcaaagacgcctgtgcagcaacaagaagctcagaaattctgaggaagtaatggttaagagagacatgggatctggctgggaaagccatgagacagagcctagggaggttcttggttctccaccgacagcttttgctacagagcacggtagccccttgttcaggccactaactctaattagtattttgcatttgccaagtgcctaccctgtgctgaggccaatggaaggatgctgaagtcagtgacagctgacatagtcctcccagggcctccctaggaactggcctgggatgcaactggccaatcagaccagacagttggcctgggttcacttcttttagaattttttttagagatggggtcttgctatgttgcccagtctgggttcaagcaatccgaccacctcagccacccaacgagctaggattactggcacaagacactgcacccagcctcttcttgatttttgaccaataactttccattatttcctcttagactccagttgaattcatgaatagcattaacatttttcaaatgcccataggagtttgttgagttaacctgagtgactcaccagagagccttcagcttattctcctcttctctggggggtgagacgtcctcctctgcccacccagcgggtgcagaggggaggggacgcttctccctcagtagattcttccttcctaaatgggccaatgtgtctcagacactgagggtcagggtgttcctggagtctgaggccttggcagcgctggccgccaagggaacatgtgttccatgggccacccggagggaacatgtgtacacatgtgtgcatgcctgtgtgtgcacgtgtgcctgtgtgtgcatgcgtgcatgtgtatgcatgtgcacgagtgtgtgcatgtatgagtttgtatttgtgtatatatgttctcgtgtgtgtgtatgtatctgtgcatgcatgcatagatgtgtgtgtgcacatatcaaggcaacttcagacaaagaaaccaagagtgggtcccagggggttagtttctggggctggggacagggttgggggagaggatgacaaggaggatgcagctgggggtggggagagaatatactacaaaaagaaatcaagagtggttctggcatttaatttctaatctcatctcactagaaaacttgtaaaatcctcaaccagaagtgctaaagagaaacgtctctgcctggttcttctacatttgtggaaagtctccctctctggaaaacagtcaccactttctgctttcactggggactacatttggaaggctggagagaagagctgaaagccaacaggaggtcttgctggtgatgtggagtgggttccatctgtggcccatgcaccccaaagcctctccagccacctcaatctcctggccctctgcagtttctctaaaacgtggcaagctctggaccacacacaagcccaacagccaggactccctgctgagcagccattccccaactggaagggctaccatgccaggcaattccgagagacgccttttaggcagaattcacgagaatctgttctcgccccagcacagctgtgcacggtgcctgctgcgtgggtaccacacccagggaccaccttcccaggccctctcactgtattttcaccaccctgccctcccttctgcagccatctacacacactgctgttgtcttctgcagaggaataagcatgcctcagtccccatcccagcaagagcaggaggcatggcagaggtggcaccagagagcacatcccctgtggcctgggacggaccattccacagtcaccccactggagtctgcacagatggctcctccctgcccttcatgggaagggacggagctgagggcacagagaccagcaaccaacagacccccgactcagggcggtgacccagggccaggagggaggcagagggtctccaaggccaagagggctgggggcacaggtcagcttcagggtccatcccaggggctggtactaggagagggtggagagcaccctgcgtgagggctgggggtccctgctgctggcggctcccctgctgcctcacagctaagggtctatgtcacagtcagggacagagcgccaagaaacacccctggccaaactgggaatggagctaagtaaacccagggatttaaataactgggatttttaaaggctaggcacaaaacaggggtttgtgacaatgtgcagagccctccatctagaggaaacatttcttatgtgcctgacaccagctccatctcacttgggcccggggccctttagcaagggttcctgctgccacaccccctgccatggggccaccagatggaaaaataactgaatatttccatagagagctttgaaaccaaacatgcaaactcacaaggccaaaatgcatggccaagaagaaaacgcagaggtttgttgcaaaggagcccaccgtgttgggggaggctttgcctggcatttcttgggtgggtatttcaaacagggagagtaaagctgctctcctgcaggtcccttaatgtcaccctctgcgtctccttttacctatttgccactaagcagcaagccactgaaccattccactccccagtttcctccccaaaataagatcttatttcccagagggagcagcgtacggactgagtgagccctgcatccagcaggtcttcccctaaacattgtagagccctccgtgcccccaggtaattcctgacacccagaaaggacggggccgcctgttgagaactgtctcagggggtctcagattctcgctgaattgaattctaagcattttatttgaatcaaaatatatcacattgcatacattaatgtttacttcatcttatgcatttggagttagagcctctctaatcacctatgcgaaactaagtaagcaaggtgtaaatctggatccgaaattagatgaaaaaattccatcctgttcagcttatcaaatttcaagtatttcattaacttgatcattagatgctggctgatcagaaagtcccaagatttctaactactgtaatctaaatggtataggcgtttctaaaatatccacactgaaaaaaagctcctttgctcatcccaaatccatttcatctgattgaatgattttctcatttccacagagagctgttaaaccagccaagcaaactatcaaagctccgcaggcccaggaggaggaagaaattagacgacatttggataagtcagttcttagcaaagtagtagtgcacctaattaagtgaatgcagcgcatggggtttctgtgaaccaagtcctatttcctctgagagttgtctaactggtaatccagtcattgaaggagatcgtttcgaaagtctcccaagtcctactcccggtccatgcaactgtccctcctcccaaattatccacaagactctgatcaaatacttccctctttggagaattctaatttttggaaagttctttctcatctcaagttgaaatctgctttcctgtgacttctaccccaccctttcccgggtccttccctggagcaccaaggagtgaatctctactcttgctggtagcaacctggtgacaattcgggactttttttcagccttttcagtattctcttttcctctgttcctccaaagtttctcccaggcatgcagaaagacccttttcctcattgaacccctgcctacgtccatccaatgatcaaggtctctccaacaaaggaaaatctgaacgccatcctcttaatggagactgacactgcatttcccaaaatgtgttcccaggaacaccagccctgtgcaatgtcacccacaccaatccaaagggtgctctgggcaagtaaatgtggacaatgcaaaccttgtccttacagagtcacaaaccaaggaagcatattacagccctgagcagggccaggtatggtggctcacacctgtaattccagcactttgggaggccaaagtgggaggatcatttgaggccaggagtttgccaccagactgggcaacatagcaagactccatctctaaaaatattgtttttaatgagctgtgcatggtggcatgcacctatagtcccagctacaggagaatcacttgagcccaggaggtcgcggctgcagtgggctatgattgcatcactgcactccagcctaggcagacttggtggcatcgcaagaccctatctcaaaaaaaaaaaaaaaagctgtgagcattcttggagaaactgattaacagtgtttaagccaagattccataatcgcatttgactctaaaactctttatttcccccacataacacacttagggaaaggatggttattttcactctgaccgagctttgaacacttcactatatttctctaccccactctctcacccccactctctctaccccattctccactcctagcctcctggtgcccaggaactaacaccatcaaaacaaagaactttaatgcaatagctctcagtatttagtgaattccttcttaaagcaaagcatccttttgggatagaattaatcaattccctaattttctggctttgtaaatgtgaacgttagtatattaagtattcaccccttcaataagatctgtaatacaattcaatgctaccacctaccgcaaggacatttttcaggtaattgatgtttgtcattaaattcactgacaaatatgaaaggcaaggagaaaactagaaacattttggacactttttatcatgcatgtataactaaatctattcagttaaagcttttttttgccttccacaaacgtttttatctataatatttttcatatgcacttgggagctaattactgaaagaaacctcatggtgaaggttttgcaaattaaacaaacatcctgcaatgcatctgggctttgaatcttgatgcatgcacagtttttgaggtggttttgtttttggttttctaagttcagaagaaagccctgtacatagtggaacaaattatgttccttcaacaaatcagcgtttcttgaaggaatgggcaaagcaggtgatacaaagtttccaaaagatgggccttccccaggtcacacatgtggtcagtgggcttccaagggttccatctgaaatgctgcacaggacctggaagagcgacgctgggctttgccagccctcgagccccggcttctcctcttgagtctcctgtttctgcccctcagatgaaagcagaatgagactgggcatgatggctcactcctgtaatcccagcactttggcaggctgaggcaggaggatcacttgagtccaggagttcaagaccagcctgggcaacacatcaagacctcttctctacaaaaaatttttaaaaaattagccaggggtgtggtgcatgactatggtcctggctactcggaaggctgaggcaggaggatggcttcagcccaggagttcaaggttacagtgagctatgaacacaccactccactccagcctgggtgacagagcaagaccctgtctctaaaagcaattaattagataataaaaacacatgaagcagaatgagtttgtgattaaggactctgagtctagggccagcttgcctggcttcctgccctagtccgcagctgtctagctacggagaggtgagtaaatcaatctctctgtgcctcagtgtccttatctgtagcctgtagtgacctcacgggataactatggggatgaaatgcgctcctgcctgcatggttcttagatgaggcctggctggggtccgaccttcccctcttgtgggtgtggtcactccagtcccaaccactgctgcccctgctcgctgcgcatccctgagggtctccatcacttccgggcctgggccttcccgcaggagttgccgaattgatcttgcggtctccaggcttccttcctttccagatcactcactgcaagggtcctcccgctcagagccgtccattgctcctcggtgctttccagaccctttaaacaccctggcggagccttgctcggcccttctgggtccacttggtagccgagggtccgagctgacctcatgctttccgcactgtcgggcagcgttgtcatcagcggtactctccgcctgggaaccctcccgcgtctcttctccctgtactctggagtgccccttacagccaacttaaaggcacctccctgcagatcgtcccttgattccctccgatgcagttttctctcctcctcccgagtttccaaagcattgtatcttgtagcaggttccttttggcgcggtttgtggtcgaggcacagcccatctccccttccaggctcttaaatgcttttcagagcagccaccacagactctgaaagaagaggaggagctcgcgtcttgccaggggctaggaattaggaacatctcagaggggggctccctgtaggagtcagggctggaggggcgtctacaggcagccctgggtgttgcccctgagccctgagagaaccttggggaccctgtagacaggctccacccaggtcacagtcataatgcccctgaggagaaagcatctttattggtaaagaaataaacaaaattagatgcaaacaagtaaagcaaagatctttcaacaacaccttcaggctgccccagccactgctggctctgaagccatcccatttattcaaaggctagggacaagcccccagtggccacgttgcaaactaatggagtcgagagaagggctcagaacagttatcctaatcctggaatggctatttaagtaccactttgtgcctgagacattcggagcaatttgctaatcccagcccagcactcaccaccaggcccctttgtggtggtcggtgccacacactagtgtctctgtttctcagatgcaggcatgaggacactgaaaacaagtgaatattcaaaactccgcaggaaaactatctcgatggagcctggaaattcaagcctcccgatttgccagttcatcctacagatgctttttaaccaaatctgagaaacacagtggttctaatgaaaggctgtttctatggcagattccataaagagaaaagaacaaaggcagtgatggaacaagttcccttcaacgaatcactcaacacagcaaggttgacatgttttcatggtttcccacacactgaagtcagagtgggtgtccagtggtcattcatttttccactccacatgtatttatttagtgccagagacgtcccaaagcacagagggatgcctgatgggggccatggccttaaggggaccagagggtgaggagctgggaagctggactggagggcaggccctggcctggcccagaggggtgggctgggcttggacaggggcagggaaacagtggtggaggggctggaggccagtggagacgagcagtcatgctttgtgggtgattatataaaaaatgtgggaaaagtccattctggctggtgatattaaatggcaattcacacccatttggtaatgaaaagcctcccctacctatggcttctgtgtagtagaaagagctgggcttagaattcacacagtcctaggtcagaccctgccacttactggctctctgacctatatttaatggtgacccaccccccaacccccagcccaacctgacaggggtagctgggagagataaggaactggaaaacgtgtggtatcatatgaccttctgagaggtaaaccagtgcaatcaacacagagacatagccccagctagcttcaaacatccttgaaaaacaggatgtctcttaagtaaatagcagtcaaaacatggctcatctgattaaggctaaactaaagaaggagacagaaagaagaaaaaaatagccaggcgtgctggcctgcacctgtagtcccagctgaggtaggaggataacttgagcccaggaggtggaggctgcagtgggccatgaccacagcactccagcctgggtgacacagtaagaccctgtctcaaaaggaagaagaaagaaggcaggcaggcaggaaggaaggaaggagaagaggagggggaggaggaggaggagaaagaaggaaaaacaccagtgacctagaaatggctaccataatacaccaccctgccccccagtacccctggcagaggttgctaagttatcacagcactcttgcccataagccttaaagtggcttcagaatctctcaacacagcatcccagacagctgctatcaatcggattggcgttgacaccaggcagtgagactcattttctattccaatgttgtttaatcagcaatttgtaacaaacacagtgctcttggctatggggcgtgcatgattcatcaggccatagcacagtctcgatgacagattcaagacgatgtcgcctcctgtttctctgattgcgcccttaccaggacattggttgtgactgacttgccttttaggttttcttattaggacagaattcactgaccggagaacacaagtgaacaagaacacagaatggcagaggaccggaggagtcagatttctcattgtgaagtcggagtactgacgtgaacaccagacacctgtgaggtgcattaagtcagtttccaaacctgctatcctctggttgtgtctcaaaatcaagttaccagaactacatctcagaccacaagggcacctacacgaccagccagtcaatatccccaataaacaactttatttcatcactcttcctagctgcaatctcagtttcctcatctgtaacatgggtaatttttatgtggccactgtaagcattaaatatgctgcgatatttaatcacgtagcatggtggcgggtacaaagtcgctactcaagaatgttcatgatcttccaatcccctcgatttaggacctcatcaaaccttactggtagaggggcaatattttcactccagtgacccctcttcatcagccctgccagatgggggctttctgaagccctaacactttcctactcagaaagctttgtgggcttccccaacccctgtggactaaagaccaaagtctcaggctgacgttcagaaggctcctcaaaccagctcctctctatctcttcatcctcatctcctactctgtccaccccacctgtccctcaacactggatcctacacctctcccaaacacacaagccacacttttcatgaggctttctctgttttgtgaaattctacagattcttcaaggcccattcaaagttctcttcctctgcaaagcttccctggcacactctcttgctttcctggccagagcgttcactcttccctgtttcagcctccatggtattgttcgaatgcagcatttcccacttcctgagaacaagagactgtgtgatttactgtttcctattccatactttctgttggcctgagtcaaaggtgcgttaaaggtaggaagatcttctttaaatttccagagttcttagaaggttaagagttattgatccagagaagaacctgtgatttcaaaaaagtttataatcaccgacttttcccaaaaggctggctctgatttcctgtgttgctcacagcaaccccagggcaaccacgatggtctttggtttccaggtgcggactggagatgcggggagggcacatatctgatggaggataaagtccagaaagcagcagagcacagtttggaggtcaggcactctggctgcggtgcccacaagctggaccatgtgctgtgctgctgggcccctgcggtcacactgccagcctcaaggccctgtgtggacgagttcacctgcaccaggcaatctggacattgggactgaagactagtggggagacaggcatctaaataacagtttcagcacgaccagtatggtgaagagtgtctatattagagagttaggagacagacgtgagctgggaacctcgctgggaaacataggccaatcaattaactgttcaaccctgtttcctcatctagaaagcgaggacactgtcacctacatcccaagatagtttcaataccacgttaagatgaaatatataaagaaagtgctgtgcttcttgtatggtaaaatgatataattccacacacaaggtttgaaaagctggtagaaaggcaagggataaaaccccggggacctcaggccacacagtccagccaattcctgggctgaacctgtcgccacctggatgacacgtttgtgaagagggtgttcagaatctgggcagttcctgtcacccgcctccaggtccactgtaagtcccacatcactcaccaaactgcactctccatgctgtgacaggccagactgtcctagggtatctgaccacttggaaaggaatctttttttttttttttttcagagacagagtttcactcttgtcgcccaggctggagtgcaatggtgcgatctcggctcactgcaacctctgcctcctgggttcaagcgattctcccgcctcagccttccaagtagctgagattacaggcacccactaccatgcccagcgaatttttgtatttttagtaaagacgtggtttcaccatgttggccatgctggtctcgaactcctgccctcaggtgatccgctcagctcagcctcccaaagtgctgggattacaggcatcagccaccacacccggcctgggaaggaatcttgagcccagtcactatcctaagtcagggagctcagggagctcagggagcgagcttccccttccctcctaaccactgcaccaacacctctgcacctcccacccccaccccaccaattcatgacctgccctgaatctcactcctggcgtttgcctaatcctcaactaatcccactaagaactagttccctgcatctgtacaactcgagatcctattatacagctttaaatgcatgcaattaatagaagactttgagatataaaacccctttaagaatttaaggaataatctctgatggcggaactttagactttctggctaatgggggttgggggaggtattcaaagactacgaagacattctggcatcttcaaatcacgccgtgtagacagaacattagccagtcccaagcgggacttagacatgttagaggttagacagatgggagatgagggtcctctagccattgactccctttggagaaaaagcaaactacaggtacacaccctggcccagcccagctcccccacccagaggagaggttgccagagtgggctgacagcaggacagagggcaccaggtggctgcacaagccgctaataggttttctgagtagctggaatctgctccactgtttgcaaatcatcatcaccctccatcaatggctgcgcccctaggtgtggagaagggctggacctgtgccagcctcttttcagcttttctcagtactaactttgtttttttttttttttttttttttttttgagatggcatctcactctcagctcactgcaacctccgcctcctgggttcaagtgattctcctgcctcagcctcccgagtagctgggattacaggcgcctaccaccatgcctggctaatttttgtatttttagagatggggttttgccatgttggccaggctggtctcaagctcctaacctcaggtgatccattggcaggcactaactttctctctctctttctttctttttttttttttgaacggagacttgctctgtctccaggctagagtgcagctctgctcactgcaacctctgcctcccaggttcaagtgatgctcctgcctcagcctcctgagtagctgggactacaggcgcacgccaccatgcccagctgatttttgtatttttaggcagggatggggtttcaccacgttgaccaggagggtcttgatctcttgacctcgtgatccgcccacctcggactcccaaagtggggaggcactaactttctgaagaaaactgaaaccaggtgccctttcttccaaaatattgcttcatttcccacatctggaaagggcagaacagtgttctgaccaataacaccctgggggagggccacagaggctccccgctgccttccagacaccatggggggcccagagctttctcaggaaggaaaacccttccaggcgttcctataggagagaagggctggggtcagaaggttgtttgcttgctttgtttttcctaatctgtctataaacaagttttctgcacaggcaacacaccctgtctcattcctgcgccaccttcccctacacgctaataggtttcagcagctgctcagccgggcccattagcagcagtcagccttcctcctgtaatgcgcttttcttcctgagcccccacagtaaattcaggagataaatcagcctctgctcagagagcagcagccgaggggagggtgacagtcaagggtgagcgggaggcagcagggaaaacaatgccacttctcactagatttctaattggttgtcactgcctgtcggagaatgatgacaaacgccacacttgccctgagagggctgcagtccaggctgggctgtgctgagaaacctcgtccggcaggggtgtcaggctgtaaccacctactcccgcacggggccagcttgcaaatttattttccagaccttcccgacatcaattggcccaacattttcctaacagccaaagctcacgatctgggcaagcgaaggagaagcaggagctcagactcattcatgggtttccaattaattcacttaacaaatctatttttcagccccaggttcaagaccttggtcgaagccagggaaaataagaggaagtgactcaaagatgagtcagatggagctgttgcccgcctcccgcccgctcacagcgtggaggagagatgacatatatataaataagcggggaggtgtggaaaatgaggagggccctgagggaggttctgatgaagtgcaatgagagttcagaggaaggagaaactattttatgaattttaaaaaatcccaagagcagagtatctaaaaagtcatccacgcaaaccctagagcaataattttcaatcgcaggtttgtgagcaaactgctaagcagtcatcaaccacgaggtgttctgcaaataatttactgttcattcatgaatgcaaccaacatttaatgagcatctaccatgtggcaggcactgtgctaagtgccaaggacacagcagtgaacaaggcaagcctgagtcccacccatgtagagtttctgaatattatataaaaatgtccaagtgcagcctgttgaaggaactgacagtgtcctggagcaattattgtgggagttctgaataagaagtagtccagggccgagtgcggtggctcatgcctgtaaaccctgtgctttgagaggccaaggagggaagctcactggaggccaggagttcaagactagcctgggcaacatagtgagacccctgtctctacaaaaaatacaaaaattagctgaacgtggaggtgcacacacctgcagtcccagctaatctggaggctgaggaaggaggatcacttgagcccaggagttggaggctgcagtgagctatgcttgtgccactgcactccagcctgggcaatacagtgagaccctgtctcaaacaaacaaacaataaaaaaaaataaatacaacagtgcaggatcaggacaggaggcatctcaggaaggagtctacactgtcctaagaacactgtgaagccactgaagatttaaagcaagaaagtgaagtggtaagatttgcccttctaaaacagcactttggttgtgtgtgaagaatggattagagggagtgagaccacctgtaagaagaccactgttgctttttaaaacttagaacacattcaaggttcccctctatcacagctctgctcttgcacacttacacccgagctttcttgacagctcatgctccagaaccttgttccgctttatccatgccaaggtcccaagaagaccatgaaggatcttctgcagctgtgattgcaaattcatatactacatatgaattgtgattttatagtggctcccatctccttttaaatataaccagtggtaaattattaagtagggagcatctatggcactattttctcattaaataggaacgtgtaagagagagggggattattaatacccaggtatagccatgaaatatgtcatgcagaactatgtcaacaaccagccctatgtatcccagagggaagcaagttgagaacggttgtactacaattgcatgataacaccatttgccacactatatcaggtggtttaatttggtagcccatccctacaaaacgtgaatccctggtttcaaaggcattaggaagtcataggtataggcagaagtcagatggtgccatttgcctcatacaaatactatctaatgcttctcatctcgctcaaggcagaagtaaaatccccacatcaatgtacaaagccctgcatcttctgcacctgtgcccctttcccaatctctctgacctcacctcctcctgctcctcctgcctcactctgcttcaaccacactggcctcccggttattcccatgacacacgcctgcctcaggacctttgcatgtgctgtttcctctggagtttggcctggctgtttccttcacctctttatccaatggcacctcaatgaggctgtctcagagtaccctatttcagttgcagaactccccacacatcctatttcccttgcccgcttccctctccctcaataacaggactgacttttcacctttcaacagaatgcagtttactcctttattttgtttttagcctgtttccttcccctgctgggaaataagctctgcaaggacagagtttttgtcagttttattcactgctatattcccggtgccccaacaggacctaatacacaataggtgcttcataaatgcttgttaaaggtttttgtttgtttgtttgtttgtttttgaggcagagtctcactctgtcacccaggctggagtgcagtggcaccatctcggcttactgcaacctccacctcccaggttcaagcgattctcctgcctcagcctcctaagtagctgggactacaggcacacgccaccacgcctggctaattttttttatttttaacagaggcggggtttcaccatattggccaggctggcctcgaactcctgacctcatgatccacctgccttggcctcccaaagtgctgggattaccggcgtgagccaccgtgcctggccgtaaaggttgttaaacagacctggaggacaaaggtttttagtcacttcacctttagaaaacactcttattttctctgttcattttggcaacaccaacaactgaaaccctgcttttctaaatatattgcagtttgattaatctcaaaataagtcagctggttttgcagagacactggcagaaccattttggggtgagaggtggcaacctgggtttaaaaactattataggccaggcgcagcggctcacgcctgtaatgccggcactttgggaggctgaagcgggtggatcacctgaggtcaggagttcgagaccagcctggccaacatggtgagactgagacttaaaaatacaaaaattatccaagcatggtggcacgcacttgtagtcccagctactcaggaggctgaggcacgaggattgcttgaatacaggaggcagaggttgcagtgagccaacatcacaccactgcactccagcctgggcaacagagcgagactctgtcttaaaaataataataattattattaaataaataaatataaaaactaattacagctgcttgagccacgaaaaagaatgaaatcatgtcatttgtagcaacgtggttgtaactggaggtcattatgctaagtgaaataagcgaggcacagaaagacaaatactgaatgttctcagtcatacataggagctaaaaaagttgatttcttggacctagagaatagaataatagataccagagaccaggaagggtgggtggggggcaagagaatgaagagagattggttatgcgtacaaacatacagttagatagaagaaataagttctggtgtttgatagcagcttagggtgactatactataatagcaacaataccgtgtacatttcaaagttaccagaagagaggacttgtaatgataccaacacgtaaaaatgataaacattcaagtctatggacaccccaaataccctgtcttggtcagtacacattctatgcatgaaacaaacactcacatgtattccacaaatatgtaaattattatataccaataacagagaagaaactaattataattgacccataaagtcaagggtgagttgagtctatggatcctggttacaataaacgtcttcaagcctctgtcccctttgctaatgttttcataaccgagtaactcacttcagcctcacagcagacccatttcccagacaagaaaactgagacacagagaaaagtggcttgaggctgtaacttgatttgtgaaagaaggctaattttacccattttttccatcggccattccttattcctgcaaaacacttgcgtttgagtctgaagacagttcacacattgcacgggacacctgcagtcacctgcctccttccaaagttggctatgatcaggtctccaagactcaccctgaacctctgccctagagtggtgccacaagaggaaaaagactctaccaacttaacctgaattgcttgccgctggtggaactaaagtgggaggcccaagcttcctctacagagcctctctctccttagaaaaaaaaaaaaaatcaaccaggaaaggcaaattgtacagatgccactaaaaagaaattcccgcttagtattgcttcctctgcacccagcgacttttagacaagcagaagacgaaatgccctgcccgcgactaaaccagactccttttcacttactaccctttcagcgtgtgtgtggcctgatgtccaactctgggctctgaatccatcactaaactaagaaccgtacccaacaaaggacactgacacatggcacaggctggccgtgctgccaggcagagataggacgggttctatctacacagggagaacaagaaggctggagtggccttgctaacgcgccattatcacttgaaaaatatccatgagagcctatctccccaggccacgccgccgctctttcccttccttcgtagacatatttctctccatgaattaacaacataaattaaaagaaccgagcaggtgtgaccatgagaccaccggcctccgtgagtctttgagaaaacaagccaaagtccccttccaaatgacagtgacagccccctagccgggtggcccaccccgcagcctgtaataacacacctacaaaacgcagtttagcagactcaaaggaaagcctctaagatctcaatagatttggactataatccaaaaaccatccctccccagcgctattgctgacaggacataattcagagacccaggtagttggaactcaatttgacagcaaatctctggatgtaaaaaatatgaaactggcttcagcgagtagggcagagtccacctgctgccttcagctacaaggtcgatgtgccgctatgctaaggcagggagcccacggggaggcgaggcgggtggggtgtgcaaagctgctcttgctcgcgtgctgcctactggcgcggcctgggtggccccctcctgacatctccccgtccacccgagcagccgcccagtactcacttcgcggaagcccacagaatagggcatgccggtctttcagcaggggcccgccgaagggccttgggggcttgaggaggagcagctggggctggcggactcaccgcagcctctgcggggcctgtgacgtgcgggccaggcccccgagggccttatcggccccagaggcgcttgctgtcgggccgggcgctcccggcacgggcgggcggaggggtggcgcccgcctggggaccgcagattacaagagcacctcctcccccaaccccaggaggccccgctccccaggcctcggccggcgcggacccctggttgccccggggtcgagagcagccggggagagctgagttcagagcccagagttggacatcaggccacacgctgagagggtagtaaatgaaagggagtccggtttagtcgcgggcagggcatctcctcttctgcttgtctaaaagtcgctgggtgcaggggaagcaatactaagcgggaatttctttttagtggcatctacacaatttgcctttcctggtttttgttttgttttgttttgtttcctaaggagggggaggctctgtagaggaagcttcggccctgggtgcccctgggttgggagcagtcggggagcgctgagccagggcgcacgccctgtcggcgctgcgggtgtggggcgcaggagtccttctggccggcccctccgccccccggggaggctggagctctccaaggccggggagcctcccgaagcgcgctgccccctctgttctccgcgtgctttcactagggccccatgctgcttagtggccgatttgcagggaatctgggcacaatcttaataacaccagggccaaaaataacaacgttcctgggaaccgaggtgagtcaccgcaaacagcggctaggagggcgtgggatggcgcgggcaggggggcgcccaggcggtcccgcagctgccagaaggtcggggctgcccaccagccaggctggaccatcccaggccaagctcctgcaggcctggcctaggaagccgccttttgcaacgtccgcccgtccaacaacgggatgagatgtcatctgcccagaatggctttatcagtgagaacaccatatcctggaatggcagttggtggctggcagagggaacaggtgaccccgaggagctgagctgcggggccaggggcatggcagcctccctggaccctgggggtggtgccattaaggtgggggctgtctccctccatggtttcctctaggggtgggtgtcaccgctgggggcctctggtgcagtcctccctgagaagggtctctccagccttcctcacgtgatgcttggcctcctgctgggcccacgctggtccaggtcccctgacgaggccgccatctggctttagagctttcccgcagcaccaaactggccttgccatgagggcacagctgctgcggaaagatgccaccgagatcagcttcatgacccgtctgtgttttccacagcagctggagcgcaccccatggacgctgggccatctccccggggactagtgcctgacagagctgacagagttctaggccacatgtgggctagaaggaaccgccatgtctaccacagcacagtccttaagcaggagccttttgaagcacttggactcaaaacaatggctgtttgttgttgttgttgttgttgtttgtttgttttgagggagccagaaagctaaaaaatgtaaaagaagcaggtcacattagacatgatttcagacagcctccccgaaggacagatgatctcacttggcaacacatactgggccaggctcactcatgagggggcagcgtggcatgcaccccactcaggggcaagaatgaagcttaaatattagctgactcagaacatagcaagtgctcagtaatggcttctggaacgaacccgtggttgtcaccagcaggagtgacgaaagctagaagccgtttcaccatccaaggaagaggaggaacaatatttttctctttggagttcccacactcagaagagagaacaccagcatatgaacacagagtgtcacatgatgtaggaaacatcctgtaggtagagagtataattccaaagcttaggatcctgctagttccttgtgcagtgcttccggtgggcaacatggtgcctccccagtccctcaggcttgaggcgggccagcacagcttctctgggagccaggtcatttcagaatttaaccccagaactaggtcaccccaggcaacacaaggctcctctcccttggatacaggaagcggaggaaaaggccaggcatgctcaggggcaaaccaacacccaggtgaaagggagctgggctggtttcggggagcagcctggtttcagggagccggactcacgatgtgcttgagaccctcaaattcacccctggaagcagctgcccccgtgacaaggaactaaggacaggcatgtcatggactgtgaattggagtgacatttgtccctcccttcaccaacagactgccccaagagcttcccaagttatctgccatagaataccttgtttccctcgagtctctgaaagggggccgcaaaagctgtccccacgctggaaatgcagggccaggcttttaaagttttgctcccggattatgagaacacctagaaaattcagtgctcctctccactcccccaaaccccttcacaagcccccaccctttgtttaacaaacatatatatagtgctttcctggtaccagatactactttaagcacttgacaaaatatttagtcatacataaaacccttataattacactgtaattcactctcgtcagatccagtcattgtgaagaaacggaggcacggggagattaagagagctacttaagaagacacggtgccaggtttctacccaagccatttggatctagggtctggaggccatgtgagccattttgcattagattaacgctttaattcagttcacagttagacaatatacgttccccatctatatctatacccatctggaaggcaacaaaaagataataaactgatagtgtcatgtgcccatgacccagctaacaaagaggctctgggttccaatgccccagtctttcatgggattccatcgacctcatgccctgctcccctccccaacagagatggaaacattatcctgaattttgtgtttatcatcccttgtttctctctatagtttttccacttatggttgtatgatttttgtttgtttgttttttgagacggcatctcgctctgtcaccaggctggagtgcagtggcgtgatctcggctctacctcccaggttcaagccatcctcctgcctcatcctcccgagtagctgggactacaggcacacgccaccatgcccagctaatttttgtatttttagtagagacggggtttcaccttatggttgtatctttaaacaatgtcttgtttagttttgccatgtttttggactgtgaataagtagaattattatgctgtgtgaattcttctgctacttgcatttttgctgcaacgtcatgttcctgaaattcagccaggattcatttattccttttcactgctgtgtgatatcccattgtaggcaaatagtacacaatatttatttattttccagatgggatctcattctgtcacccaggcttgtagtgcagtgaccccatcacgattcactgcagccttgaactcctgggctcaagcaatcctcctgcctcagcctcctgagttgctaaggccacaaatatttatccattttactgctaatgcaatttgagctgttttcaactttttcctattaaaacattattgctatgaacattcttataaaagcttcccagtgcacgtgtgtgagatctttctagtgtgtatgctagcaggagaattactgagttttaccgtacatgtatcttcaatcttattagataacactgacttgtttttgaaattggctcttccaatttacactgtcaacagcagggttatgtggttgccctgcaagttcaacaacatttggtattgtcagactttaatatttttgtcaatctggttggtataaaatggtatggtgtggtgctttttatttgcatttccatgattactaatgaggttgagcatcttttcacatgtttatgggccatttacttttcctcttctatgaaattactattcaagccctttgcccatttttctgttatgttgtttgtctttttcttatcgaggtggaggagttctctgcagtctgaatacgaatcatttttcagttatgtgcattgaaaatatctcctcccagtgtgtagttctttacactttttaaaatggtatcttttaacgaactaatatgggttttaatgtgtcaaatatgttgatcattttctttatggtttgtgtttcttttgtcttaaggagtccacttctaccctgagcttatacaattttttctgtattatatttattttatagggtttttgttttgttttgttttgttttttgtttttgagatggagtcttgctctgtcgcccaggctagagtgcaatggcaccatctcagctcactgcaacctccgcctcccgggttccagcaattctcctgcctcggcctcccgaatagctgggactacaggcactcaccaccacgcctggctaatgtttgtatttttagtagagacagggtgtcaccacgttggtcaggctggtctcaaactcctgatttcaagtgatctgcccaccttggcctcccaaagtgctgagattacaggcatgagccaccacgcccgacctatagttttacttctcatatttaggtctttaaatccacttgacttattttgtgtatgatgtgagttgagttctgatttttactatgtggataatgaaatatccctgcaccattgattagcccatcctctcccagctgaactgtgtcatgttcatcgtttattaagtctccacatgcatgagtctgttggagaggagaactctctcctatgatccattggcctataagtctatctcagtactgatgtcatactgtcttcattgctactgcaactaataatacattttataataaattttaatattgtccgcaataagtcttagtattgttgaggaagtctctttgctttattcctctagaaaagcatcataacagctgggcacagtggcctacacctgtcatcccagcactctgggaggccgatcactcgggcaacatggcaaaaccccatctctactaaaaatagaaaaaagtagccaggtgtggtggcttgcatctgtagtcccagctactggggaggctgaggtgggaggatcacctgagcctgggaagtcattgaggccgcagtgagcgatgatcatgccacggcactccagcctgggtaatgagaatgagaccctatctaaaagaaagaaagaaagagagaaagggagagagaaagggggggggggagagagagagagatgaaaaaagaaagagagaaagagagaaagaaagaaagaaagaaagaaagaaagaaagaaagaaagaaagagaaagaaagaaagagagaaaggaaggaaggaaggaaggaagggaaggaaaggaaaggaaaggaaaggaaaggaaaggaaaggaaaggaaaggaaagaaaggaaagaaagaaaagaaaagagaaaaagagagggagggagagagagagagagaaaaaaaaagcatcaaagcttctcttggtcctttgccctcttgtttgatatttttattgggttgttacagtctatagatacatacatttttgtatcttgagcctgtagccagaaatcttgttgagctctattatgaggtctcctagtttgtccctggctggtctgagtgcagtgatgtttacaactaattggtcacattcagttacagatttatttgttccttctccattcccactgcttcacttgactagccttcaaaaaaattgaccatgattctctttgatttttctctgtagacaattattattcacaaatcaggacattttgttctcttcttttacagtttttgcaccccttctttgcttttcttgctctattacattgggtaagatatccaatatatttttgaacggaaacagtgatagcatgtttatctagttgctgacttaaatggagctgcttttaaagttttaccattaagtataatgtttatgtaagacttttgtgaatatctttttattagttaaggaagttagcttctagtctcagtttattaaaattttaatcatgaatgaatgttgaaatccaaatttttcttttccttttttgtgaaggtggtacattgcattaatagatttttctaatgctaaactatccttccatttttgggttaaacccttcttggtcgtaatgaattacttgtaatatagcaccattgaattagagttgtggaattttctacaggatttttgcacctatatattcataagttatattggttattttaatttgctactgctgcataacaaagtagcccccaattgtgctgattaaaatacgtaaatttagtatttcagagtttctgtgggttgggaattcaggggcagctcatctgggtggtactggcacagtgtctctcaggaagttgccatcaagatgtcagctggggatgcagtcatctgaaggcccaactagggctgggattcacttccaagatcctcagatggctgctggcagaagctctcagctcctcacctcatggacctcccatagggctgccaaccatcctcttacactgcagctagcttttcccagggtgacccaagagagaaggcagaagccacgaggctgtcatggcctagtctagacatcacatatcatcacttctgccacattctatttgctagaagcaaatcactaaaccagcccaccctcaacagcagggaaattgtcaaagggaagtatatcgaagaatgtgtacatatttaaaacccccacatggcctatcattttcttttcctaaattgtctccagttttagtatcatatcatactaaactcataaggtgagttggctggcttctctccctggctatgagagggattaattaattgcccgcaaaataatctggtctttttcaatgagagggtaactatgggagggagattactgatttactttatttcatgttaaatgtttgctcaggctaccagtttaggagatcaatatttttagaacatattccagattctgaaaacttgattctcattcgcttaaactttacacatctccatctgcttggcactggcttagagtgctgcgaaattcccacattccggcaaaacacggtgaaaacagagaagtgacctcagtcattttaaaaagtcagcatgaagagtggggaaactaaaagctttaaaaggttaaacaacagatgcttaattaattttttaaaaattcaagggtaaactcccactcattccggtaaacttagagaatagtgttgaatggaactcaaacttttttatctcgggacccttttacagtaaaaaatattaaggatcccatagagctgtttctttctttctctctgtgtgtgtgtgtgtgtgtcgtgtgtgtgtgtgtgtttctctctctcatagagctctttctctctttctttctctctctctcatagagctctttctctctctctctttctttctttctttctctctctctgtccctctttttgtctctctctctctctctgtctctctctctttgtctctttctctctctctctctctctctgattcttgctctgtcacccaggtaggggcacattgttacaatcatggcttgctacagtctagaacttctgagctcaagcaatcctcccacctcagcctcgaagtagctgggactacaggtttgtgccactgtacccagctaatttttttaatttagtttttgtagagacaggatctcactatgttgcccaggctggtcttgaactcgtgggctcaagcgatcctcctgattcagcttccccgagtactaagattacaagcatgagccactccactcagtcccatagagctttttcttaaatgtgacttatatctagcaatatttactatatcagaaattaaaactgagagtttctaaaactatgtatatattaattcatttgaacatagcataataaaccaatttcacattaatacagacaacatatttttctgaaaaataactatattttccaaaaacaaatcagtgcaaagagggtcactactttccatttttgcaaatctgtttaacatctggcttaagaaaaaaacagatacgttcccatattgccatctacatcaatgtggtggaataggttgtgtcagttgaggtatgtgaagatctggcttcgcttggatatgtagttggaaaaaggaggagtattttaatagccttttcatttaattgtgaaattctttttgtatactacataaaaactcaacaagtaatttcttaaaggctggttacagagtggaatcacaaagaatattaatgagcttttcatatcctttacacttgcaagagagggaaagtgaaaaagtccaataacattgctgtattatgaagaattttgaccctagaaccccttgaaagggtctttggggagctccctgggtccccaggctacactttgaaactggaagtttaggcactcaaatataccttgacgttaagctatttttaaaaatcacagaaccagagtatgatagactggacaagaactcagtgagtggtggggcccatgtcctcattttgagaataaaatggcagcccagggagacaacacaatttgtccaggatctttccagagcagagttcatgcatgccctgttctttccactactgtgtataaaaaggagcaagataaagggaaaaaaggaggaaaaagataatataaaagcagcacaggccaggtgcagttgttcatgtcggtaatcccagcactttcagaggccaaggagggaagatcacttgaggtcaggagttcaagaccagcctgggcaacatggcgaaaccctgtctctactaaaaatacaaaaattagctgggtgtgatggcacctgtaatcccagctattcgggaaacaggagaattgctcgagcctgggagttagaggctgcagtgaaccatgatggtttgagcctggaagttcaaggctacagtgagctatgatggtgccactgcactccagccttggcaacagagctagactctgtctcaaaagaaaaaagcaacacaatgttgtaagagcagattgtgacaggctccactctcgatggttttccatgacgattgtccagtttatagatgtcttgtcctcagaaatccctggttatgcctgcattggatcatgctgttgctgctaacagttttaccatccacagatgtgagaaaaataggggaaaaagtaaatccataaaattatacttcttatccttataagaggagggatggaagaattagatactttacaataatgctaataattaacatttattaaaatttattaagcacttactatgttctcattcattcatttgttcatcattcatttattcactcatccatctttctcgtaatatttaccaagcacctattatgtgccagtcatactactaggtatgcaatgggtaaagaaaacagacacggtctagagttttgcattgttattcactcatgactccagcaatctgatggggcaggcactgtggtaacccccatgttactcatcagatgaccgaggcaagagaggtgcttaccaaggtcacagaaccagtgagaaatggagacttcaatccaagtctcatgcttaaccatgacactatattgcctcccagataagactctaacgtggctttgagtcacttatagtttatttatgttaatttatactcccttcaagtccagcattggaaacagagagtccgtactgccctgtctgtcgtggccctttcaccttcttcctgtgaatagctggcccaacatcacaccttgtatctgtaagcaggactatccctaggagttgacaggaaatggcattgaagagggggtggtgtactagatggatcacacggtgctggtggtggcagtggtcatg

SEQ ID NO: 408 - DNA, 218288 bp, Homo sapiens
gaggattgcttgaacaggagtttaagaccaacctgggcaatatagcaaaactcccatctctacaaagaaatttaaaaattggctgaggcaggaggatttcttgagcccaagagttcgaggccacagtgagctatgatcgcaccactgcattccagcctgagcaacagaacaagaccccatctcttacaagaaaagaaaaaagaaagatactatttgtatggtacaattctgtgtaaatggacaggctacttacagccagaggtgactggcctgaagactttagtcaccctcaggccttgcctagctgccctaaaggctgaggggatcaaaaacttggccatacctgtaagccatttatggcacccaagtggtggtggcgaaccagttgggaagttcagcttaagccatgtggatggggtgctctaaactttgcagcaactgacacaatatatatcctttatgagtggagagaagaaaggatggatgaacttgatcatatacttggtgatgaaattcaggagtcatatcatattcaaaggatcctggtaaaggtgtctctggatattacaggagacaattgagactcctcaagaaagggaccatggctgggtgcggtggctcatccctataatcccagcactttgtgaggccaaggcaagaggatcacttgaagtcaggagttcaagaccagcctgagcaacaaaacaagactctatctctaccaaaaataaaaaataaaattacctagacacggtggcatgtgcctgtaatcccagctacttgggaggcagaggcggaagaatcacttgagcccaggagtttgtggctgcagtaagctacaacggcaccactgcgctctagtgtaggtgacagagagtaagaccctgtctcaaaaaacgctggaggggggaccttgcttttacttctctctgcacttctccctttattcttctctctctgcatgaaaattggctttctgtgcttttcctaccagagggcaggagacagctgccccaccctcctggtcccagtgatagtgggcccatcctctggaatcaggcttcctaggtttaaatcctaactccatccttagtatctgtgtgacctgtagcaagttacttaacctctctgtgcctcaatttactcatctctaaactactgataatgtaacatacctcagtagggttgtgggaaggaattaaatccattaaactatataaaataatttaggaccatgtattactctgttttcgtgctgctgataaagacatacctgagactgggcaattttacaaaagaaggaggtttaattgggcttacagttccacgtggctggagaagcctcacaatcatggtggaaggcaaggaggagcaagtcctgtcttacatggatggcagcaggcaaggagagaatgaggaagacgcaaaagcagaaacccttgataaaaccatcagatcttatgagacttattcactaacacaagaacagtatggggaaaccacccccatgattcaattatctcccactgggcccctcccacaacacgtgggaattatgggagtacaattcaaaatgagatttgggtggggacacagagccaaaccatatcagacagtaagcactatataagtgttagctattattatctttaattcccaggcaagaaaatctgattggctgagtttgagccagtggttcactcctggcctaatcccctaattgtgcactacatatcactaggtactagtcctctagagcatttgtctcaattgtaatttaagatttgattgaggactgtattcacaactagactgtgggaccatcttcttttgtccaccattctattctcagtgcctagcacagtagctataatctggacgaaatataattgtactgtataccacttacattgtactttatgtgcagcatatatatatatatacataaatagcttgatggtggtcaagtcccgataaatatgtgttgaagactgaattaatggtcccctccactatggctggagatgcagctgtgtggctgcagaggtctaccctcagggatggagaagttatttcctaataaaggggtataagccaaacagaaacctccaaatgtatctgccattgccaggcacagggaatacaaagtcaaatagatgtttggcagacattgttggcagcataaccggttcctccctctcacctccttcatccttagtttggtaactttatttatttattcatttattgagatggaggcatgctctgtcacccaggctggagtgcaatggcttgatctcggctcactgcaacctccgcctcccaggttcaagtgattctcctgcctcagcctcctgaatagctgggattacaggcacccactaccatgcccagctaatttttgtatttttggtagagacggagtttcaccaggttggccaggctggcctctaactcctgacttcaggtgatccacctgccttgggctcccaaagtgttgggattacaggcgtaagccactgcacacagcctagtttggtaactttaaatgttgggtatcaacacactcagggaaggaaccccagaccagaagttgaatcatggttagtctatggtaattatggtaaccattcccctatctttgtcatccagtgataaccaatgacatgtgaaaggatatatgtctcaggggcatctgatacgaagttgttccccagttgaaataaatactgtgagaaagcctgcaacctttcttgactggatgtcatcaaagacaaaagccaaaactgagggtggtacagtagaatgacagaaagaacccaaggccacatatgtttatcatataaattattattattatttttttttgagacagggtctcactctgtcaccttggctggagtgcagtgacacaatcatggctcactgcattcttgacctcctggtctcaagcgatcctccttagctcctcccaccttagcttcccaaagtgctgggattacaggtgtgaaccaccctgcccagcctacatgtttttgttgtttaagccactctaggcaagcacactcttgtagccaaacacaatgtaactgataactatagtccccttaccttaggaactgaaaatgtggaaggaagacagatcagaaaatcagaagcttaaagttaggaacagagaaggatgcccactatcaccactcctattccacgatgtactgtagatccttgactgcataagattggaaaatgaaacaaaagaattgtgacactagaattgtgccatttattttattttattcataagataaaaaattgataaattggactttgtcaagattaaaaaaactttttcactgcaaagaccctgttaagaggatgcaaagacaagctaaggactagggtaaaatatttgctaaccacatatctgacagaagcctcatatctagaaagtataaggaattctcaaaacttaggggaaaaaatccaattagaaaatagcaaaaaacatttcaccgacaaggatatagtaatgtcaaataagcacatgaaaagatgttcaacaccattagacattaaggcatgcaaattattattattattattagagaagggtctcactttgtcacccaggctagagtacagtcatagctcactgcagccctgaattcctgggctcaagcaatcctcctgtctcagcctgccaattagctaggactacaggcttgtgccactatgccctgctaattaaaaaaaatttttttgtagagacagggtctcactatgttgccccggttggtcttgagcccctaaccccaagcaatcatccctcctcagcctcccaaagtgttggaattacaggcgtgagctaccaccccctgcccagaaatgcaaattattaagaccacagtgagatactaccacataactaccaaaatgactgaaattaaaaaatagtgacaacaccaaatgctggcaaggatacagaaaactcagatatctcatacattggtggtgggaagtgtaaaatggtatagccaccctggaaaacagtttggcagtttcttaaacactaaacatgcgactacaaaatgacccagcaattgcccttctggttacttatcccagagaagtgaaaactatgttcatatgaaaacatgtatatgaatgttcacagcagctttattcataataacccaaacccagatgctgttcaatgggtgaatggctaaacaaactgtagtatatccacactgtggaatactacttagcaatggaaagaatcaacagttgacacacacaacaacttggatgaatctcaagggcattatgctgaatgaagaaaaaggcagcctcaaaaggccacatactgtatgatttcatttacataatattctgggtttttttgagatggaatcttgctttgttgcccaggctggagtgcagtggtgtgatctcggctcactgcaacctctgcctcctgggttcaagcgattcttctgcctcagcctctcgagtagctgggactacaggcatgccaccatgcccagctaatttttgttatttttggtagagatggagttttgccgttttggccaggctggtcttgaactcctgacctcaagtgatccgcccccgccttggcctcccaaagtgctgggattacaggcatgagccaccgcgcctggcctacgtaacattcttaaaatgacaaaattatagagatggagaacagattagtggttgtcagagattagggatggtgtcggggagggggttgggtgtaactataattaagtagcatgaggatgattctttgtggtgatggcatagttctgtattttgatagaatggtggttatatgaaactacatatgtgataaaattgcacagagctacacacacacacacacacacacacacacacacattgtaccaatgacttaatatcataaagatgccaattttttccaaatagcagtagtaggaaacattcttgcttctattacatgaaggctgcagactttttgtggccatattggactctgcatgattccatttgtcttttcattctggatccccacggaaggtgcagccactctttggggcatgatattctcatggcaaatggcagaagctcaagggaggtaggggaagcactaaagcatacaacatattttaagcttctgttccaatgtggtgtttgccaaggcaagtcaacacaagcccaaaaccaatggagcagactggtttacccgacctatagaaaagcatggcaaagatggaaagggtacgaataattgtgaatgaacaatgcaatccaccacatatatttactgagatttgagatttcaaattaaaatctcaagtttatcataacaaatgaattagaaaatgtctatgaaggagaaaagagctaagaatacttgagatctgtataaataaaaaagagaaataagtcagggtaggacttgtatatttggaaatcaacacttgaaataaaaccacaggctaggcacagtggctcacacctgtaatcccagcactttgggaggccaaggcgggtggatcacttgaggtcaggagttcaagaccagcctggccaacacggtgaaaccctgtctctactaaaaaataattttaaaaaaattagctgggcgtggtggcatgcaactgtaatcccagctactcaggaggctgaggcaggagaatcacttgaacccaggagaaggaggttgcagtgagccaagatcatgttactatgctctggcctgggcaacagagcgaggctctttcaaaaagaaaaaaaaagagaaaagaaagagagaaagagaaagaaaaaaaaaagaaaaccaaagatttcaggcagtatgatgctagcagagggatagacaaatggaacaaaatagaggaccgaaaacaaacctatatgtgtataaaaatccattgtaagagagttctggcattgcaaatgaaaggagaaatgaatttcagatagaatgtggacttacacatgaaagacaaaattgtaacacttgaaataaaatatgggagaatatttttatatccttggggtcagaaaggacttctcaaaacacatgaaacaaggcaaaagacaccatcaattaacaaaagaggaaacaggactagctattaaacattaaagatgctcagccatactggtaattggggaaatacaaactacaactattatgagagatcatttagatgaaaacaagtgctggcaaagattgtgggacatggatgactttcttttttttttttctgagacggagtcccgctctgtcacccaggctggagtgcagtggcacgatctcactgcaagctccacctcctgggttcacgccattctcctgcctcagcctcccgagtagctgggactacaggcgtccgccaccatgccaggctaattttttgtatttttagtagagatggggtttcaccgtgttagccaggatggtctcgatctcctgacttcgtgatccacccgcctcgacctcccaaagtgctgggatttacaggcgtgagccaccatgcccggccagatgactttcatatacaggtgttagaaatgaaaattggtatgaccactttagaaaacaattttagaaaacaaccagtttagacagtttgacattacctagtaaatttgaacgtgcacttaccttaagacctgatgattccacttctaggtatatatcctaaaaaacattcttacacacatgtatcggagaaatatttaagaatattcacagcaacactgtttgcaatagcaaaaactggagccaatccaacatccaaaagtagaatgggtaattaaattgtgttatgtttttacaacaaaatacctatataacagagaaatcagataggtgaatctcagaaacataatgctgggcaaaagctgcaagttgcatgggaataatgcagaatgattctattttaaaaaagctcaaaaacacgcaaaaacaaaccatgtagtgtttagggacacatatatttgtgataacataattattaacacaaaacttaggatggtggtttcctctgaaagagaaggatatgattatagagcggcagatggaagggttcttccttgagtggaagctttagcaaaggcagtttcagtggagtggcagggatggaagccagaatggtgtgttgaaggctgcgttgaagctaacaacatgaaagacagctaatgcagtcagctcattaaagacatgttgttgaaaataggagcagattatattatcacaaagcagtgaaaatgatcatttgcagagcaaacttctttctcacaaggcagaaggagggtgagctagggtgaatataagaggctggctgtgattgagctgaacgtaggggcaagaacagagctgcagcctgggagcccttctcataaagagggagatttaggagtcttcttcgttggtcgcccaaagactgtctgcccacttggagataagcaagcaagatctccaagcagctcagccactgcctgctttggctctcatgagacctcctgccaggaatccccattaatcaaagtctgggaacaaaagcagaccagtcagttcccaggagcgctcacatgtcttgcaggctggcttgggctttctgtttctttcggggtcattgctctgactacccacaaatataacttaaaatctcatctcaatgtgactttctggtgatgttttaaaagcctatcagggaaactgagcatttgcatctttggaagtttattcgagggactagctaggaaaactcaatgtggaaaagtacaagagagaaatgatcacattgaaaggtcatgtggctgggcgcggtggctcacacctgtaatcccagcactttgggaggctgaggcaggtggatcacaaggtcagcagttcgagatcagcctgaccaacatggtgaaactccgtctctactaaaaatacaaaaaaattagctgggcgtggtggcaggcgcctgtaatcccagctacttgggaggctgaggcaggagaattgcttgaaaccggaaggtggaggttgcagtgagccgagattgcaccactgcactctagcctgggcaataaaagcaaaactccatctcaaaaaataaaaagaaaggtcatgtgtacaaactttgactttgagggttatctaggaactcattagtaacctgcctggagagaaacctggagctacaagccagcagagaaaggaaatgtgttcttctatcagctccaggtgtagagcaacaggaatggggcacaaatctgaagaagggctgggcgcggtggctcacacctgtaatcccaacactttgggaggctgaggccggaggattacttgagcccaggagttcaagaccagccttgacctcctctgtgttaaacataaaaaaattagctgggcatggtggtgcacacttgtaatcccaactattcaggaggcagaggcaggaggattgcttgagcccaggagttcaagactgcagtgggctactgcacttcagcctgggtgacacagcaaggccccatcttaagggggaaaaaaaagtctggaaaaggccaaaggatactcagaagagagatttcacatcctgttaggtaaaactgcagctgtgactatggggttgggaaaatttcagaagcagtaggagaaaatcaagaacttccccttcctagtgtggaaacaggctcttgggatctctcctgcctaatgatccctgaaggagagagggaaacaaacatcttaaggaaaaggaagaaatcatcatgtttcttttctcctggaaaccaggcctgtttcagagggaataagaaaagtcggctgggtgcagtggctcatgcctgtaatcccagcactttgggaggccgaggctggaggatcacgaggtcaggagttcgagaccagcctgaccaatatggtgaaaccccatctctactaaaaatacaaaaattagccagggatggtggcgggcacctgtaatcccagctactcaggaggctgaggcaggagaatcacttgaacctgggaggcggaggttgcagtgagcctagatggtgccattgcactccagcctgggtgacagagtgagacttcgtctcaaaaaaaaattttaagcaagaaagaaaaaaaaatcagattcgtgataagcttgtcccaaaacctcaggtaagattgatagtccattttagggtgctgcttgcctcctcttccatctctccgcctttggagagcagatacctgtccatgcttcttcaaagggtggaatgagatcccatccatcttacatgtattcaacagtagcttattgaatgcttcctgtgttcagggagctcttctaggtattgaagaagtggctgtgaatgaaaatagacaaaaccagactgagataatggtatgtaaagtgtgatatgaatatgggggtcaggctcgctcaatgcttttgccatttccatatgggatgattccaacaagatacttatagtcaagctgttagaaataaaggcttcctttcccctctccagctaccccaataaatctgggtcattcatcattgttgttcagtttgtactgagcagccccagttaagtgagctatggttatattgaaatatccacttggccacgaattgagtgaaggtgggaggttcctcctgctaattctcctcccctcccaatacacttcctggcaacccccacgcggaaaacctcaccctactataggcccccttcctcccactcttcagaaggcggtggccccacccaggagagggctgcagatcggggccagccccagggcctccgcggtgccacctctctctcgcgagggtccctgccgtgccccggctcgccgctgggaggcgctgcggcaccggcgtaggagccgccggcaggggtggggcggggccggcgggacggggcagagggccctgcggcggcggacgcggcgggctcggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtaccaggcgacctcgccggctccctgggacccccgcttacaccggggtgggcgcctcaggtcggggaggacgctgtcgggggaagggggcgctgctccctcggcaccccaggatcgccgactgcccgcggaggagacccggacaccgcgcctcgccccctggcctgcggcctccgaaaacgcccggcgcgagggggtccccccggggcgcctccctcttcgcctggcatcagttgcctccctggaatatggaacttcgggcgagggaggtggagaactttcttctggggctcgtccctcgttctcctgctcgcttgcagtttgaaggaagggcggtgggggcgggggtccgagtaccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaagtggcatctcccggggtccagagagtcggcgtgctgtctggtttgggtccagacatcagctcacccaagcttatcttgggcttttaagtgtgttgcttccggtagatctcggggactggaggggaagtgcagcattatttgtgacccaagagggacttgaatgtctcaaagctggtcaagaatgtttcccccgcgaggtagcatgagatgggtcacgtggtagtaaagagccacttcgggcccgtgagatggagttctgactccaccacttgttaggtgtgtgactttggaaaacccacttctttaaaccttagtttttagaactctaaactgcaggtattgtacataacctcgtagtattgtgttcatgcagtgaagtgatgggaatgaaatgcttggcattgtactcttgtgtgttagacaccttttgcgaacctgttggatgttgaattcattcatgcttaggttctgttaggccagtgtaagtggaaagaacttgggcaatgaagacaaacacacctgggtccaaggtggtcccatccatggtatactgattgggggtttctcatccccaaaacaccaatagcagccttggcggggtttttgttgttgttgttttgagacagagtttcgctctgttgcccaggctgtaagctttgacctccttagctcaaccgatcttcccacctcagcctgggaccaccacacctggctaattttgaatttttttattttactagagacagagtctcactgtgttgcctaagctggtctcgaactcctcctgtctcagcctcccaaagtgttgggattacaggtgtgagccactgtactggtctgcagccttgttcttgagtgtagtaggtgtgtctataccgatacatgttacactttgtcatctttagtatttgtttagcatatggtaacaaaaaattttttaaaaattagggatacaaattaaaattggggagtattttctgccctctaggtcatactggacatgggggaagggtagaagagggatgaagaggaattaaagagaccagaaaacaactagtcgcagtgttgggaggtataaaccaatggtaatttttaaaaatgtgaatttattaactccttgttttttcatggtggcaccaaaaattaatcttagtctcccacttaaactcatcagcctccccaaagcctttccagataagcatatgctccatgtaaaagcagactgcctgcgatccaactcagcttagagacaaggcacacttccaactcccaaggcctccttcttgtatagagatgctggtgctgccactgtgaaatacatcatacactcagacagtataaaccttagagtgcaatgtaaagaataacaatagatcacacccaagtacgagtcacccggctgaagaactagaacatcgccaggcccctggagcccctgagtacccctctccattgccttccactcacttctcgcctcccacccaaggaaccactattctggatgttgtgttaactttttcccttgcttatatgaaaaaccctgaggaaaggaagtttcccaacaagcatttccacaataacctggagcattctttatttttctttttttctcaaggagcattgttattgaacttaaaagcaggctattgagggtaagatacaaaccacaaaaaagccgaaagtctcaaagtcgggggatcttttagtctctgtcttcttccaagtttctcctgtctccctggcacggatcccgaaggtgtgttctgtctgtgtaggggagacccagtctcttccaacatagattgatggctgtgattttaaaagctttgcttgagtccctaagaagtgggaaaacagtaatttgggtgcgtgcgttttagaagtttttttaaaaatgcaaattatccagaaggcattgtgtgggatttgaaggattaagctaagagtgacctttaaaaatggttttaacaacccaaattcctcttcctggttgatatgtttgtgttattgtctttgttttatttcttcaaggtcacatggctttccttggtgaatcttacactgttttgttacttcttggttaaggcaaagattctgaaacttggtttcatggagcccttagtgtctgagttaattttttcacaattcccttaggcttcagtagttagtaattttttcacaattcccttaggtttcagtagttagtagttaggttcaaacaactgagtatttacttagaagttgtttgaaaaaataatatacataaactgagagaaaaaatattttacatcctttaaagtcataattactaaccgtatgtgtgtgcctatactacttttcaaaccttgggatcgtgttggacactgccactctcatttcctgtttcacattaatatttccgcagcatttggcttttatcacagcagccacagaaaacccagctttgcaaagatgtattgtcttggataggaatgtaacatgatctactgttgaaactgcaaactacctccagttaataggttcagcagtgtccagacatgtttggtatactagtttccattgaaattttcagattttctacattgcccattttaatttgctatagttgcaaaacacccagtcagggggtccaaaatagtaaactttgaaaacattatgctaggtgaaataagttagtcacagaagggacaatattgtatgattctgtttatattaggtacctagagtagtcatacacatggagacagaaagtagaatggtagttaccaggggtagggggaggacagaatagggaattcatgtactatttttgcaacttctatgtaagactaatattatttcaaaataaagtttttaaacgttttttaaaaacaaattctgttgatggtgccccactgctggactgtaccaaggcactgaggttagggacagcagcagagaaaagcttaggggtgacattatctctatttcccagctcttcctcatcccgtcaagggggaagagatggaagaaatagctatgttctctctcttttatagggaagtgtctgcattatttactggtgggttcctttataaacctgaggatcagctattaaatttgtcactaaaataagaatttttaacctggggttcagtggtgggctacaaatactctaagatctcccaaaattatgtataagtatttaagtgaatgctcttatgtatgtttgagggggaagaagttccatagctttcatcagattctcaaatggtttcctaagtcaaaaaaggttagtaagcgctataaggaaatatttacagattcctacctacccccaccccataaaaggcccctttatttggatgtcttatcccatttcagttctctgacatatctttcccccaccagttacaagaggctttctttctgctcagaccccagataagcccgaccagttctttttcctcagagcccccagctattcatctggatcctgaaaactccaggaccaattcctcaagagccaaaggaagtcccagaatgaacatcttggacttctgaatagggcagatgtggaactgaagtctcacaactgccacatctctctgtgccctccttaggtctagaaaaatatgaagtaaataataatatattaggtacacagctatggaaaaactcatgaagatggtactgaatgactgaagtccagtacattctgctttgggggaggcaaatttaattttaagagtgtcttctggtttacactttatgttccaaatgtattctaaatatagcatacaatacgtcctaccttgtttcatatccagtgatacagatgagctatagaatttacacagtgttagaaaagatgttaaatatcagaatttacttaataagtaggtctctactcattcagactggtttcattttattttattttatttttgaggcaaggtctcgctgtcacccaggctagagtgcagtggtgcaatttcaactcactgcaacctctgcctcctgggctcaaagccatcctctcacctcagcctcctaagtagctgggactacaggcacataacaccacgccctactatttttgtatttttggtagagacagggtttcaccttgttgcccaggctcacactggttttaaactcagatgaatggggtaggtaagtggcaaaaatggtaacctgcaagctcttcttatacatatgattcctcaatagttgcatttatcttagaaatacttcaataaatcatgatttgagtctttcaccgatacaggtatattctgtatgctgtaaggtaggctaactgctgtaacaaacatttccaaacctcagtggtttaatctagctcacacaagtcctaatcagttattcctgttgggcagctctcctgggtagctgtccttcaggtgactcagggatcaaggttcattccttcttgtgatgccaccatcttcatgtggtctccagagtcactgcaagggggaaagagtatggcaaaaggaaaccgtgttgactgccttcaccagcaagggaaacacatcacttctgcttacattctattggcagaaccagtcacatggcctcaactagattcaaggaagctaggaaatacagtccctggctgggcaactgtttcttagtaaaaataatttactttgggaaaggaatagaactctttggtggatgagtagccattttttgtacaataaggtgctagtgttttaactggtcaattaagtgtaactgcctttatgtaatttatttctaacttttttttttagacaaaatctcgctctgttgcctaggctggagtgcaatggtgcgatcttggctcaccacaacctccaccacccaggttcaagtgattctcctgcctcagcctcctgagtagctaggattacaggcagccaccactgtgcctggctaatttttgtatttttagtagagtcagtgttttgccacattggccagtctgatttcgaactcctgacctcaggtgatccgccggcctcggcctcctaaagtgctgggattacaggtgtgagccactgcacctggcctatttcttactttctaaacatatatgtgtatatgtatatatatgtatgtgtttgtatatatgtatatacactgtataaataaaatgttatgtcttcatagtggagggtgtggagaagacttctatacaggaaacaaatgtatcataattgccatgtgagcagataaaaatgctattaagccatctaggctcagacatttattagggaatgaagcatatttaatttactcagaatcatccaaccatgtagagaattgtacatttgagaaagacggagcagagaaagattagcaaagaacaagaatatgcatgtcttaatggcttcgttaatgttatcataagagtttaaaactactttaggctgctggcaataggctaggtatgaaacttattcccccttcaaaaaaaaaagtttttgccatggaatgtgttacataatcacaaagtatatgtgtcaattttacttatttgctcttaagggaaagtaaaattgtaaaatttgtatctgtttttcttatttgtttgaagtaaatttgtgcccaagagggtgcacagcatcaaatggtagacattaaaggattacaagatcatgtgaaagatcccaagacccagttagagtcatggagaaacttcagtaatgtgcactaattctagtaatgcttcagcgtcatttatctgttactagttgacattgggctgttctacctaaggaaaaggcccaaataattaaaatttaccatcttttaaatcctaattttcttttttttctttttccgagacagggtctcattctgtcacccaggctggagtgcagtagtgccatcttggcttactgcaaaccccgcctcctgggttcaagcaattcttgtgcctcagcctcccgagtagctgggattacaggtgcaccaccatactcggttaatttttgtatttttagtagagacggggttttaccatgttagccaggctgctcttgaactcctgacctcaagtgatctgcccaccttggcctcccaaagtgctgggattacaggcctaagccaccatgcctggccttaaatcctaattttaaaataaagtttcctgtttcatggtgctcatattggtgtagtgaaggaaaaaataatttttcctctactcttgtgagttctcagctgggagccctgtaacaaaacataggttaacaagagaaaaacaaatggaagtttattaacatgcatatttcatatatacatgggagaaaattcagggaaagagtaattctcaaaaagatttcttagaactctggcttatatagcatcttcaacaaagaacagtacacttttagagaagtgacaagacaaaggaaaaagaccttcagtctttagcgatggcgaattgtaggaaggcaaatacatggggaactaatggcagataaaggctagttagtgcagtttgttatgtagatgcctctggtgccttctctaggctgttaaggacctaaagctgtcttctgtgactaacctttatccttcctggtggagagaggagaagggacacctttgttaatttatgtcctgcttttagcaaataggggaaggcaaggagcttttcttgtatccacttctcagttgccttcggctcaaaataatccttatgccaaagtggcatattttggggtagcatatcctgatacttttcattggaattaaagatgcactagctgggtgtggcagtgagcacctgtagtcccagctacttgggagaggctaaggtgggaggatcgatcgcttgagcccaggagtttgaggttgcagtgcaatatgatcatgcctatgaatagccactgcactccagcctaggcaacatagcaagatcccatctcgaaaaaaaaaaaaaagttgtactagactaaaggttggcaaattatagccatggcccaaatccagcttgatgcctgtttcattcctttgcatggtgtctatagctgctttcaactgctatggcagagttgagtagtttccacagagattacctggcccacaaaacctgatatattttactatctgtttttttacagaaaaacatgttgatgatgccttcactagatacaaaattagtataactcagtttgataataactctgttcctagttagaacctacttaatctctgtggcccactgttacttcactatagtggggataaatgaccttgaacaagttaccgaatgtatcttctttttttttgagacagagtctcgctctgtctcccaggctggagtgcagtggtgtgatctcagttggctgcaacctctgcctcccgggttcaggtgattctcctgcctcagcctcctgagtagctgggattacaggcacccgccaccatgcctggctaacttttttatatttttagtacagacagggtttggccatgttggccaggctcatctggagctcctgacctcaagtgatctgcctgcctcggcctcccaaagtgctgggattacaggcatgagccactgcacctggccgaatttatcttccagttagctgtctatcttccagttagcttccttagaccaatacttctcaaacttatgcatatgtcaacaaaaaaagccaaactcctgtaaagcatttaaagaggtttattctgagccaactgtgagtgaccatagccttggttttcttttctttcctttttttttttttttttttttttttttgagagacagagttttgctcttattgcccaggctggagtgcaatggcatgatcttggctcactgcaacctccgcctcctgggttttagcagttctcctgcctcagcctaccaagtagctgggattataggcatgcgccaccacacccagctaactttgtatttttagtagagatggggtttcaccatgttggtcaggctggtcttgaactcctggcctcaggtgatctgcctgccttggcttctcaaagtgttgggattacaggcgtgagccactgtgcccagccagccatggttttcaagaggtcctcggaacatgtgtctaggtggttgggttacagcttggttttatttttatttttttatttttttgagacagggtctcactctgtcgcccaggctggagcagtggcatgatctcagctcatgcagcctctgcctcccaggttcaagcacttctcgtgcctcagtctcctaagtagctgggattacacgcatgcgctcccacacccagttaatttttgtatttttagtagagacggggtttcgccatgttccctaggctggtctcgaactcctgggctcaagcaatccacctgccttggctccccagagtgctgggattacaggcctgagccactgcgcctggcccatcagcttggttttatacatttgagggaggcatagacaccaatcaggctgggtgaggtggctcacgcctatagtcccagcactttgggaggctaaggtggtcagattgcttgagcctgggagttcaagaccagcctgtgcaacatagtgaaagcccatctattaaaaaaaaaaaaaattagccaggcatggtggtgcatgtttgtagtcccagctattcaggagtctgaggtaagaggatcgcttgagcctgggaggtcgagactccagtgagccaagactggcaccactgcactccaacagagtgtcagaccctgggcaacagagcaaaaccctgtctcaaaaaaaaaaaaaaaaaaaaagacagcaatcattatctgtgaggtgtgtattggtttggttcaaagattttctcattggcaattggttgcaaaagttattatctaaagatctggaatcagtagacagaagtctctgggttacgataaggggttgtggagaccaaggttcttattatgtaggtgaagtctcataggtggccaccattagagaccacagatggcagatgttttctgtttaaacctttaaaagatgctggactctcagttgatctcattagcacatggagggactagagggggtaagatctagttatgttaatagagactctttgcagaagcaattttccccccacaaaagatggctttgtagggccatttcaaaatatggcaaagaaacatattttgggataaaatactttgattttcttctttatctgtcatgtgatactagagtcagattggaaattggtaccttattgctacaaagaatctgttttgtcagtttgaagatctctgttttaatcttactgctggtcagttgtgcctgaactccaaaagggaaggtataatgaagcacatctgcttcccccacccctgcctatttttcaggtttctttggaattctttgacccgggtgggggtgaagaggatccattcagttggttgggggagcttagaattttatttttggcttaaatgtaagaataatctggggaatatattaaaatttgggaattctcagccttactccatagattctaattcactaggtctggggaggcacacatttaacaatcaccccagattctgatgaggtgacctgtggtccacaaattattttattttttgagacagggtctcactctgtgacccaggctggaatgcagaggtgtgatcatggttctgcagcctcaacctctcaggttcaagcaatcctcccacttcagcctcccatctcagccacctgagtagctgggactacaggcgcatgccactacacctggctaatttttgtattttttgtagagattttgccatgttgctgaggctggcaccctttaaataatttgagcccttatggcaatttgtcttttggttcctaaaaattgtttcgtagctctagataaagttcttgtctcaaccagcattgaagccttgcctacctgataggagagcttggaaccaagaggggaatgcccaatggcattaatcattagcttctgagcagagcagtaagcttgtcgtataaatcaaatcactcactgtgtgagcttatctacagagacctctgcagcttcgcttccgaatagaaatgatagaaaaagttggcactggggctttagtgaatgtgaatggtttatatcggagctcagtttgcctgttgatgctaagagaaaacaaattaaagttaaaatgagcactgtggccctgcattagccatcttttttaaaaatcaaggtaaaagttaataaaagaaagagctttgatgagaggaaggacctaagtccaggcactttaagaacaaatacttgtttgtttataattttctgaatctccagaaggtactatcctgagttacagaatatctattgaacggcttgcttactgaagcctttgttttcctccatttgctgttcaaaaacttaggagagagtggcagatcagtaatgaataacagcaaaatcccctggcacctgttggatttttatacaaaacagaaaaagttaaaacttgaaggaacaatgaaagaacctcacatctccagtactcaatatgattgaagttaggttgctactgtttagaagcactgttttaaaactgaggttttgatgccttaaaacatttttcatctttgttaccttgctgaaataaaatctaaaagttgcattgggtataagccaggatatattgtactttgaaatataagtaaacattttatcatccaatgacagacttataactaattagatattttcctgttgggatatatctagggaaattgatttcaaaaactgtttattaatagggactttagaaattctatttaagggctgggcgcggtggctcacgcctgtaatcccagcactttgggaggttgaggtgggcggatcacctgagatcaggagtttgagaccagcctggccaacacagtgaaaacccatctctactaaaaataaaaaaattaggcaggcatggtggcgcacacctgtagtcccagctacttgggaggctgaggcaggagagttgcttgaacctgggaggcggaggttacagtgagccaagatcacaccattgcactccaacatgagtgacaagagcgaaactccatgtcaaaaaaaaaaatctatgtaagactatcaaaggattcctttacataatgagctcccctagtccctagatatttgatatataggcatagctcattttattgcactttgcagatacgtgtttttcacgaattgaaggcttgtggtaattctgtgttgagcgtctatcaataccatttttccaacaacatgtgctctctctgtgtctctatgtcacactttggtaattctcacaatatttcacactttttctttattattatgaaaaattgtttcggtgatctgtgatcagagatctttcttttttttttttttttttttttttgagatagagtcttgctctgttgcccaggctggagtgcagtggcatgatcttagctcactggaacctccacctcccaggttcaagtgatcctcctgcctcagccccactagtagctgggattacaggcacgtgccaccatgcccggctaatttttgtattttatttatttatttatttgacatggagtctccctctgtcgccaggctggagtgcagtcaagcaatctctgctcaccgcaacctccacctcctgggttcaagtggttcccctccctcagcctcctgagtagctgggactacaggtgcacaccaccatgcctggctaatttttgtattttagtagagactgggtttcaccatgttggtcaggatggtctcgatctcctgaccttgtgatctgcccgcctcggcctcccaaagtgctgggtttacaggcgtaagccactgcgcctggctcaatttttgtatttttagtagagatgggatttttccatgttggccaggctggtctcaaactcctgacctcaggtgatcctcctgccttggcctcccaaagtgctaggtacagccatgagccactgcgcccggctgatcagagatctttgatgttattattgtaatcattttgggacaccatgaattgtgcccaaataagaaggagaacttaattaataagtgttgtatgtgttctggctgttccactgaccagctgttacccatctctctccctctctttgggcctcctattccctaagacacagcaatattaaaattaggtgaattggctgggcacagtggctcatgcctgtaatcccagcactttgggaggccgaggcaggcgaatcacctgaggtcaggagtttgagaccagcctgaccaacatggtgaaactctgtctctactaaaaatacaaaattaactgggcatgctggtgcatgtctataatccaagctacttgggaggctgaggcaggagaatcccttgaatctgggaggtggaggttgcagtgagtcaagatcgtgccattgcactccagcctgggcaacaagggcgaaactttgtctctaaataaataaataaataaattaaataaaattaggtgaattaataatcccacaatggcctctaagcattcaagtgaaaggaagagtctcacaactttcactttaagtcaagagttagaattaatattagtgaggcaggcatgtcaaaaaccaagatagaatgaaagctaggactcttgtgccaaagggctagccaagttgtgaatgcaaaggaaaaattcttgaaagaaattaaaagtgctactctagggctgggtgcagtggctcactcttgtaatcccagcacgttaggaggctgaggcaggaggatggctttagaccaggagttcaagaccagcctgaccaactgatatagtttggccgtgtccccacccaaatctcatcttgaactgtagctcccataatccccatgtgtcgtgggagggacctggtggaaggtaatttaatcatgggggcagttaccctcgtgctcttcttgtgatagtgagttctcacgagattggatagttttataaggggcttttcccccttttgattggcacttcttgctgctgccatgtgaagaaggaggtgtttgcttcctcttctgccatgattgtgagtttcctgagggttccccagccctgcggaactgagtcaattaaacctctttcctttataaactacccagtcttgggtatttctttgtagcagcatgataattgactaatacaccaacgtagtgaaatcctgtctctacaaaaaattaaaaaattagcagggcatggtgatatgcacctgtagttctagctattcgggaaggctgaggtgggaggatcacttaagcctgggaggttgaggctgcagtgagctatgattgtgccactgtatttcagcttaggtgacagagtgagaccctgtctcaaaaaaaagggaggggggccactccactgtacacaggagtgacaagaaagtgaaacagccttattgttattgctgatatggagaaagtttgagtggtctagatagattaaaccagccacaacattccctaaagccaaggcctaacccagaacaaggctctgactctatcaattgtgtaaaggctgagagaggtgggaagctgcagaaaaaaagtctgaagctagcagagattggttcatgaggtttaagaaaccatctctgtaacataaaagtgcaaggtaaagcagccagtgctgatgttgaagctacagcaagttatccataagctctagctaagattgttgattgatgaagatggctacactgacgaatagattttcaatgtggatgaaacagccttctactggaaggagagtccatttaggactttgtttttctttctttttcttttgaggtggagttttactcttgttgcccaggctggagagcaatggtgtgatgtcgggtcactgcaacctctgcctcctggttcaagcgattttcctgcctcagcctcccaagcagctgggattacaggcatgtgccaccacgcccagctaatttttttttttcagtagagatggggtttctccatgttggtcaggctggtcttgaactcccaacctcaagtgatccgcctgcctcggcctcccagagtgctgggattacaggcgtgagccactgcacccagctccatttaggactttcatagctagaaaagacaagacaatgcttggctttaaatccaaagaataggccgactctggttaggagctaatgcaactgatgactttagttgaagccagttctcatttaccatttggaaaatcctaggacattttaagaattatgatacgttggccaggtgaggtggctcacacctgtaatcccagcattttaggagaccaagtcaggaagattgcttgaacccaggagtttgagaccagcctgggcaacatggtgaaaccccatctctacaaaaaataaaaaattagccaggtgttgtggcatgtgcctgtagttccagctactcaggaggctgaggtaggaagatcacctgagactggaaggttgaggctgcagtgagccatgattgtgccactgcactacagcctgggtgacagcaagaccttgtcaaaaaagaaaaaaaaaaaaagaattatactacatctactctgtctgtgccgtataaatggaacagcaaagcccagatgacagtacatctatttacaggtggtttactgaatatgttaagcccactgttaagacctactgcttagaaaacaagatttctttcaaaattactgctcattgacaatgtacctagtcacccaagagctctgatggcattgtacaaggagattaatattttcatgcctactaaacacaacatccattcttcagcccatggatcaaagagttaatttctattttcaagtcttatttaagaaatatggccgggtgcggtggctcacgcctgtaatcctagcactttgggaggccgagatgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaaagaaatacattttgtaaggctatagttgccaaagaaagtgattcctctgatggatctgggcaaagtaaacagaaaatcttttggaaaggattcacctttgtagatgccattaagaacattcatgattcatgagaggaggtcaaaatgtcaacattaacagggttctgaagaggctgattccaaccctcgggtcactttgagggattcaagacttggtggaggaaggaaatgcagatgtggtggaaatagtaagagaactacagttagaagtgcagcctgaagatgcaactgaattgctgcaatctcatgataaaacttgaaaggctgaggagttgctttttatggatgagcaaagaaagtggtttcttgaggtagacttgtgaaagttgcagataccagatgaaatcactttttgtcagacccaaacaaactagagccaggagagcatgaaggggaaggctcatgtttgcatggctgagataaagactgtctcaaagactttccaaaataaccctgcaaataattatttctttagaattgcagcaattcagacaagatgctctcaaaagcatacctgcccagtaacggcattttcaccaatgaacctatgccatctctgagtccctgaaaccaatgagctctgttttcaagcaccttatgtgaacctctcattctgccaataaaagcttccctttaccctcccctcttcagttgcatatgtggcttgccattgtgcatctcagtttataattctcttttctaactcccgaaaaaatttaacatatttggagatattttttggttgaaagaatctatctcgggtgaagatgctgtgaatattgttgaaatgatgacagagaatttagaatattacataaaattagttgataaagcaaccactgggctggagaggattgactctgattttgaaaggagttctgtggataaaatgctgtcaaacagctgttacatgcgacagagaaatctcattaaagaaagaatcaggctgggcacggtggctcatgcctgtaatctcagcactttgggaggctgaggtgggtggatcacctgaggtcaggagatccagaccagcctggccagcgtagtgaaacctcgtctctactaaaaatacaaaaattagccgggtgtggtggcaggcgcctataatcccagctactcgggaggctgaggcaggagaatcacttgaacccaggaggtgcaggttgtggtgagcctcgcgacagagtgagactccatctcaaaaaaaaaaaagaggaagaatcagttgattcagaaacttcattgttgtctttatgaaattgcaacagccaccccaacattcaacaacgatcaccctgatcagtcatcagccaccgggcttgagacaaggccctccactagcaaaaacattatgacctactgaaggttcagatgatcatcagcatttttagcaacaaagtatttttatctttatttatatatttttcagagggagtctcactttgttgcccaggctggaggcagcagtgtgatcatagctcagtgccaccttgaattcctgggctaaaacaatcctcctgcttcagcctcccaagtacctaggactacaagtctgcaccactgcagactttttttttttttgtagagatgggggtctcaccaacttgactaggctagtctcgatctcctgggctcctgctttggcctcccagagtgctgggggttacaggcgtgagccactgcacctggccaataaagtatttttaaataaggtatgtacattgtttcttttagacataatactatggtgtagtaaatagactacgatatagtgtaaacataatttttatatgtactaggaaaccaaaaaaattgtgtgactcattttattgtggtacttgctttattatgggggtctgtaaccaaaccacagtatctccaaggtatgcctctataattcaaattactaaaattcagccgggtgccatggctaacgcctgtaatcctagcactttgggaggccaaggtaggtggattgcttgagcccaggaattcaagagcaacctgggcaacatggtgaaaccccatctctacaaaaaatacaaaaagttagtagggcatggtggcgtgtgcctgtggtctcagctgctcggaaggctgaaatgggaggactgcttgagcctgggaggtggaggttgcagtgagctgagatcacgccactgcactgcagcctgggtgacagagtgagaccctatctcaaaaataaaatgaaataaaattcaaagtacatcctcttttcaggagctcatccttgtcaggaaggtagaaatacctttgtggactgcattctctaaagtttgcaaaataaacagccatcttctattattaaaatggtagctctgtatcatttctttctcccctccaaaatgtgtgacaggtctaatttctctctagataccataatttccttccattttattactaaatcctggagaaaagcccattttgaagaaaacagagcttacagctttaaaaactgattgttattttgatataccaaaacccagttttgcctttatgctcagtgcatttctgtcattgtacgtcctaaactaactaatttatattcttcccttggtacttaaagaatcaaaaaccctaacactgtacttgtaattgactggttgtgttaaaagtgaccatgtttttgtgcatctaaaaatagaacataaaatattgtatctgattttgctccaggacttctgtggtttcttattataaccccctctgctaccctttgaaattcctttaatgtcagggacatttactttaagagtaagataatacatcttaagagacttttaggctgggcatagtggctcacacctctaatcccagcactttgggaagccaaggcaggaggaatacatgaggccaggagttcaaaaccagcctgggaaacagcaagaccccatctcagcaccactaacaaaattagccaggtgtggtattcccagctacttgggaagctgaggcaggaggattacctgagcccaggagttgagtctgcagtgagctatgattgcatcactgcactccaacctggtccacagagtgaggccctgtctgaaaacaaaacagaagacttttagtatatgctatgaatttactagctaagtaaatcggatggagttaatatcccagttacgtaaagttgttcttcttacagtgttaatgaaagatgggtacaagagaaaacattttccccaaatttaagcaagtagaagctatgtaactcctgatggattttgtatgaaaaaacaacatcagaagctattcgatatttaagtgaggggggaaatgttataatactaaatctagaagggaaaccaaagtattgattgtaacctactcagatgtcataaatctacagcagagctgcctgagccccacagagtaaatgacattcattaaggctgaatgtattgttgcactaggatcagggaggcaaactgttttactattgtctgcaaagcctgaaccctccacttgagaaataatttaaataaataaatttttttgaagccagtgactctcttttggcctgacaattttttttttctttctgattagcagtaagtaatgtgctaaatccccagaccccgcacccaaacctggctgaattacctcacttggaaatggacaataaagatgccctttacgagaagtctgtttcatgaaagactggcaggttttaaagagaggagtgtaaacctggcggccaggaaggcctgggttctgatttcatgtcagacagcagcctttgtgccctctgccaagtaactttctgtggcttttcttttcttttttcttagaaaggtgaccgctggactgatggttcagactggtcctcatgaactagtctgcggctcccatggatttgagccagtaacattattttagcctcacaaattttcataaggcaaacaccctcataaaaccatcactctggtcagaaatagaactttgccagtcaccccagaagctcctccttgttttccatcccaattgtcattcccttcttccaaaagtaactacaggcggttcttgctttacacaacattatggtactgtaaaaatgatagctcatgctgaaacactgataagctatcctaataatcagtgggaaaaattgtgactgactgttctggaaccttttaaaatttttgtcaaaacattaaaagcccttttactctctgttataattgtatagggaaatgaaaacatagtaaagtgttataccctgtaatttaaaacattagcaacattagaataaaaggttttatttctttgtaaaaacttatcaagagtagtttgaatagtgcttgccttcttttttctcatcatataacttatgatatacaacaagcatcttttctttgccttgatgaatttttatactccttttgaagtttggatcagcttccaagattttatactttgtgctttcaatgttgggaagtgcctccaacaattcctttttttttgagatggagtctcactctgtcgcctagttaggagtgctgtagcgcagtcttggctcactgcaacctttgcctcccaggttcaagctattctcctgcctcggcctgccgagtagctgagactacaggtgcacgccacccagctaatttttgtattttttatttatttatttatttatttaatatttttattttattttattttattttattttttaattttttgagatggagtctcgctctgtcgcccaggcttgagtgcagtggcatgatctcggctcactgcaagctcagcctcatgggttcacgccattctcctgccttagcctccggagtagctgggactacaggcacctgccaccacgcccggctaacttttcgtatttttagtagagacggagtttcaccattttggccaggatggtcttgaactcctgacctcaggtgatccacccgcctcaccctcccaaagtgctgggattacaggcatgagccaccatgcctggcaagagttcctttaatgcgaagtttttgctggtgtcatttcttcattttttttcatctcaaccacttttctcatgtaagtcagtaatttttctttatgaaggtcttatgggtgcacatctagagtcttcgcatggtggtgatgctgacattcccatggtcagctatttcttctatatgtaactctgtttacattcttttcatattttacttccagtgttaatcacttttcatttctttgctacactttcatctttgttggccagtttcttccttcaatttattcattttgtaaaagttatgtgggtttatccctgggagatcaggaagcaacacagatacttggtttgctctctgtgcaagaactgaataacagatgaggagtgaccaatcagagacttggaaaggagtgatgtaattggtcactgatcgtgatgcacatctgttaattacatagtgagctgtggccagaagagctatttgtgaagtctgtacttcatgttgtttctcaaagttaattcagtgtggtaagtaaaatttgaggtacgtcattggggcactgctgtagtttaactaaactggaattgaaattgtacatattggaatcatgtaaagtgaagactacctgcatgattcttttatagcaatcatttccctgtattttttttatagttctacgaaccaaatgtacatttttagataacgtagtttggtgttgtccctttagatgtttttgttgtcttctgaggtttgtttgtttgagagggagtcttactctgtcacccaggctgatgagcagtggtgcgatctcagctcactggaacctctgcttcctgggttcaagcgattctcttgcctcagcctcccgagtagctggaattacaggtgtgtgccatgatgctcatctaattttttttgtatttttagtagagacagggttttgtcatgttggccaggctggtctcgaactctcgatctcaagtgatctgcccaccttggtctcccaaagtgctgggattacaggtgtgagccaccacacccagtgtgtgtgtgtttttttttttttttaatctatgtgttttccgtctgtattaggccattcttgcattgctatacagaaatagatgagactgggtattttataaagaaaagaggtttaattggctcacagttcagcaggctgtacaggaagcatggtgctggcatctgcttggcttccagggaggcctcaaggagcttttactcatggtggaaggtgaagggggagcaggcacttcacatggtgagaatgggagccagagtggaggaggtgccatatacttttaaagaaccagatcttgtgagaactcactcactattatgaggacaacactaagccatttgatgtggtttcagtctgtgtccccaccatatctcatgtggaattgtaatccccaatgttggaggtggggctgggtgggaggtgattggatcatgggggcagagttctcatgaatggtttagcaccgtcctcttggtgctgttttcatgatagtgaatgagttatcacaagatcttgttgttttaaaagcatgtaacacctgccccctctctcttcctcctgctctggccatgtaagatgtgcctgcttccccttcaccttctgctataattgtaagtttcctgaggcctccccagaagctgatattgccatgcttcctgtacagcctgcagaaccgtgaaccaattaaacctcttttctttataaattatgcagtctcaggtatttcttttctctctctctcttttttttttctgagatggaatcttgctctgttgcccaggctctgcagtggtgcaatcttggctcactgcaacctccacctcccaggttcaagcgattctcctgcttcagcctcctgagtaactgggattacaggcacatgccatcatgcctgactaattttttgtatttttagtagagacaggattttgtcatgttggccaggctggtctggaactcctgacctcaagtgatccacccgctttggcctcccaaagttaagtatttctttatagcagtgcaagaatggactaatacaccattgatgagggatctgccccacccctatgacccagtcacctcccagcaggccccacttttaacattgtggattacatttcagcatgagatttgggaggtgacaaatatcgaactctgtcactctctatcttagtttgccagggctgccataacaaagtactatagactgggtgacataaacaatagcagtttattttctcacggttttggagactggaagtccaaacccaaggtgctggtggaattgatttctcccaaggcctctttggcttcagatggccaccttctctctgtgttctcacttggtcttgcctctgtgcgtgtgcatccttggtgtctccagtcagactgggttagggcctaccctaatggcctcattttaacttaattacctctttcagggctctgtctccaaatagtcacattctgaggtattgggagagctttaatatatgaacttgttctgcccataacactgtccatacctttcttttctttattacttgtctatcaaaatagctaggctgtttaccactagtctcataaaacataaattatggccacagaaattttatattaaagtgttaggatcatccatgaaggacagcattgaagattagcctggattaagtagggtaaaattatgctccagttactaaggctttctaacaaattaccctaaaacttggtagcttaaaacagcaacaatgatttattgtatctcaatacaataaatcagtcagtcaggaattaattagaaagtgacctggctgagaggttcagaccttagtccataaaggcaattgcagtcacatgccaggtggggctgcagtcatctgaaaggttgactggggtgggatggttcccttctaagatggtgcattcacatggttgggatgttggtggtggctgctggaggctgtatctcctttccactggctgcttgaatttcctcaaggcatggcagctggcttccaccagagcaagtgattcaagatgctaagacaagctgcagtgcttttcatgtagcctcagaagtcatgtattgccactttcaccatgttctattggtcacacatacccagccttgatccactgtggaggaagccttcacaagggtgttaattataggacctcaggattattggaaactgtcttggagacagactaccataaattggagtggtaaaaagtgtcttatttttgggaaacctgtttgcaagtctccatcttcaaatgctcacttaccttacgtgcatgtcatcaaaattaaacattactaaatgctatctttctacttctcacttaatgaggtaatatttttaagagttttcaggataaatttttatgcttaatctctctatctgactaacaaaaaccattatactaatccaaatacatatatttatctattaatagatttatcttcaactttatcatttatttaagatactggtcttaaaccaaatggcggatcatgaactctaaaatatggcagtagattttggcttatgttactgggaaatattgtgactctcaggctaaagtaataactttgcagcttgctgagtgaaccctaataagttgattgagttatattttttctcagttttttggtctgctgtaaatgaaaagagaatttctcattgttatagactgaatgtttgtgtctcccccgcgaattcatatattgaaaccctaaccctcaatgtgatggtactaggaggtggggcctttgggatgtaataaagttgtgagtttggagccttcacgaatgggattacgtccttataaaagagacctcagagagctttctaggcctcttgccaccatgtgaggatacaatgagcagatggtgttctatgaaccaggaaatgggccctcaccagattccaaatcttctggtttcttcattttagactttctagcctccagaactgtgagagataaatgtttgttgtttaagccactgagtctatggtattctgttatagcagccagaactactaagacacgaatcatttttaatggtgaaaataataagtggaaattatgaggaaaattggtaatgattttgggctataactgtggaaaagtagaatatatgtgtgcattaggtttctttagagggacagaactaacaggatatatgtaggtatgaaagggagtttattaaggataattgattcacaaggttaaagtcccacagtagcctgtctgcaagttgaggagcaaggaagccagtggtggatcagtccaaatcccaaaacctcaaaagtagggaagttgacagtgcagccttcagtctgtggccaaatgcccaagagcccctggcaaatcactggtgtaagtccaagagtccaaaagctgaagaacctggagtctgatgtttgagggcaggaagcatccagcacgggagaaagatgaaggctggaagactcagcaagtctgcccttccatcttctcctgccagctttattctagctgagctggcagctaattagatggtgcccacccagattgagggtggatctgcctcttccagtcactgactcacatgttaatctcctctggcaacacactcacagacacacccaggaacaatactttgcatccttcgatccaataaggttgacactcaatattaaccatcacagtgtgaaattccactgaggagctgtgtcgtggtcttggctagttcttggcctatgctgtcttggggttcagcaccatgggcagctactcctgccatgccctgccacccccacatttgacatgcaaaaggggtgacagacaaccttgggcagtgtggaggggtgtgcacacctgtggtataggcgcttcgtgtcctgttggttcagagttcaccttttttttgtcttcttaaaatgaatatgtctttttttttaaaattgagacggagtttcactcttgttgcccaggctggagtgcaatgatgtgatctcggctcactgcaacctccgtctcctgggttcaaacgattctcctgcctcagcctcccgagtagctgggattacaggcatgtgccaccacactcagctaattttgtatttttagtagagacggagtttctccatgttggtcaggctggtctcgaactcccgacctcaggtgatctgcccgcctcggcctcccaaagtgttgggattacaggcatgagccaccatgcctggctgaacatatctttaaattcatcccctcagtgtccataaaaccagcataacttagaggagcctcaggttaatttaaagcttctgtgccagaggactgaactcttgaatgtccattcttggttcagtcctctagcctctatttccaatgccatctaaggatttcaccagccttgtaagggttagggttgttttaagctcactgcagcctttaactcctgggctcaagtgatcctcctgcttcagattcctgagtagctagaactatacaggtgtgtgccaccatgctcagctaattttaaaaaatatttttagagatagagtcttgctgtgttgcacaagttggtcttggactcctgacctgaagcaatcctcctgcctcagcctcctgaggagctggaaatacaggtacaagctgctgtgcccagcttagggtggtttttatttaaacattatgacagttataaggagacgtatcaggctctatcttctttccataaacatttactctgcttaattattatggacaaagaaagctgacagtagtatttctaatgtttctagaaccatgctgctactgtataaaattgattaaatattatccttggaatatatcctggagagcatacattctaagaaataaagtattactttttattcaaatcattcactttccctttgtggcagtcttttagaaattgccctattggggctcttcctcatgtttccaaactgagtatccagacagccttttcctatagcacactagatatgagaaaaatgagacctgaaagatcatgatcacagagacaggaaacttacctggcattgatgaatttggataataatgtagttattataatatcaattaacaaattttttctttttttacttaaagttttaaaatataattttccaattctcctagatcctgactttttttctttttaagagagagaatatagacaatatttatatgccaaagcaacttagataagtaactattaaaatttcaaaattttgaaagtaagtttcaaaaataccttatagattagcaagttttttttgttttttgttttttttgagacaaagtctcgcttgtcgcccaggctggagtgcaatggcgcaatctcagctcactgcaacctctgcctcccaggttcaagtgattctcctgcctcagcctctgagtagctgggattacagacgcctgccaccacacctggctaatttttgtatttttagtagagacggggtttcaccatgttggccaggctggtctcgaactcctgaccccaggcaatccggctgtcttggcctcccaaagtgctgggattacaggcgtgagcacccagccaattttcttttttttaatgaggttatttttctctcaagttttttttattaaatttgctacttaggatcatttcagaatgagagagtggagagggagagaaagaaatgaaataattatctcagagtcaccatatctacacttactggaatgtactaatactacatcggtgttttggaattctttttttttgagaccgagtctccctctgtcatcgaggctggagtgcagtaagctgttcacagctcactgcaacttctgcctcccgggttcaagcgattctcctgcctcagcctcctgagtaactgggattacaggcatgtgccatcatgcccggctaatgtttgtatttatttattgtttttttggtagagacagggttttgccatattggccatgctagtctctaactcctgacctcaagtgaaccgtcagtctctgcctcctgaagtgttgggattacaggagtgagccaccgcacctggcttggtgttttggaattcaaaggagagttttgttaatagttccttgagatttacatataccttggaagaaactgaactttttgaaattgggataagcagtttcaggtatcatatatgcctttcacataaaggcacatatgatataagagtacattagttgatgggagagaatagaattagtgagagatgagatttcttatgtgctgcagtattatgcgctgtttgtaggaagttatgtagttacccaagtgatacaacagtgagaagtaagagattcatggctttatgttaagccaacatatgtccgttgcagagctgatgctaataatttagaattcagttttttttagcagttcacattcactcataacaactcagtatcatttgctaaataaagaggctttggtatcattcataaaagaaaattaggaatattattaaaatatggtagtataagctctctagtgtattagataagctctctaatgtattgtagtttgtttgaacttcatacggctgcagaaatgaatcaacattcaacccagacttttgtgaatagagtatgagaaatgatgttattgaatctttacatccctggaagcttgtctaataaattgagtagttgtcacactgagttttgtacaattcatatcataaaaatataactattatatttatgttctactgtactccacaagctcattagagataaccagtgctagttttaaaagtgaaatgggccgggcacagtggctcacgcttgtaatcctagcactttgggaggccaaggtgggcggatcacctgagttcaggggttcgagaccaacctggccaatatggtgaaaccctgtctctactaaaaatacaaaaattagccagacatagtggtgcatgcctgtaattccagctactcagggggctgaggcaggagaatcgcttgaacccgggaggtggaggttgcagtgggccgagatcacgccactgcactccagcctgggcaacagagtgagactccatctcaaaataataataataataataataataataataataataaatacataaataaaaatgaaggaagtttacagtgtttatcttcttttggggttaaactgtttttacagagtcaaggttattgaaatttatttgtagcagagatgggtgaataataaacagttttttccagacatgtaatacaagctgtctgatggcttctatctgcgtgccttagaaacaaagacatctctgagctgcaggagaggggactggagtgaagcacctccaactagtaaatactgaagaatacagtcctaacacatataggacatatataggaatcacagtgactgattacactaactagattgcttctgaaataccagtaccattttaagtcctgatctgagtgggtttcatatgcctctgttctgtctttcatatttaatatattgcattttgttttagagacagaacaaagtctattgcgtaagacaataaaaagattatctttgggcaattcccataacagactttctgttttaacaaatctcttaagttactggagctgtcttatttatttttagagatgtttttacattgtagaaaagtacacgagtacccctatgtattgaccaccaagatgagtttttagttttttttttttttttttctaagagacaaggtattagtctgttacccagcctgaaatgcagtggtgctatcagagctcgctcaaactcctgggctcaagtgatcctcctgcctcagcttcccaagtaggactatagtcatgtgccaccatgcccagctaattttttaaaaaattcttttttgtgaaaacaaaaaatcctactatgttgccctgacttgtttcaaagtcctggcctcaagtgatcctcccaccttggcctcccagagtgttgggattacagccatgagccatcatacctggctataatttctaatatatatgctttttgaagtaaaatatataagagcagttttatcacttattttttcatttagtattttttctgagcattttgttattaatttttttaaaacaatttttaataactgcaaaatattttatcgtatggatataccataattttactggtttcctattattagacattaaggaagcctctggaatgtcatttaaaaaacacagaaagtattgtacatgaatgttttgtactctatccaattaattcctaaagatgaattaccaaaaattaaagtactgggtgcaagatatgaacattttttaaggttcatacaatacttttcaaataattatattttaacacagtatttcatcaagttggagaccttataactttttcaaaggatatatgaaaactgtctgtcacccaggctggagtgctatggtgcgatcttggcccactgcaacctccgcctcctgggttcaagcaattctcctgcctcagcctcccgagtagctgggattacaggtgcccgccaccatgcccagctaatttctttgtatttttagtagagatggggcttcaccatgtctggcaggctgttcttgaactcctgacctcaggtgatctgcccgccttggcctcccaaagtgctgggaatacaagcataagccaccacgcccagtcaaaaatcttattttataaaaaaaagcaattgaccctcattttggggtctgcttcaataaatctttctcattgaaggagctcatcctcactagtctccttccttgttagattcactcttgcaaaacaaaaatatgataatgtatatctgcgtactggacatatgaatcaatctctaatttatcaggtgtaaggccacagcccttcagtaatagagtcttgcctttaataagatctggaataacaaaacaaaataattctttatgaactctagctggggagtaccgttattagtccttgaagttaaaaaactgtccttgttttgtaataagttaattgtaacactagtggtgatattttatctagtagtctaaattcctgcctccactggcaggaacttcacttctttttaacttgatcaaatgtccaattttagaataacagagaaaaaagagaaaaggaaaaaaaaagaattaacagatggttagagcttgttttatactgattcttaatatttttccctctaggatacagaaaacgtttctttagtcccttccaacttaatcatccttgcctccatacagaaatcccaaggtgccctaggtggttcacagtgttaactgcaagcgcttatatctgtcaggcctttgtttggaggctagagcaggaacatcacatgatacacaggaaaagattctgtgttcttgcctattcacatgtgacccaccagagtttgtcaagagtcttctgtattttaataatgcatttccaagaacttactttgctttcatctaaactaccttgtaacttccttaggggaaaattgtatgcatttctatttggaagtaaaatggaaaagacattattttatcctagaatgtgagttacatttttacgtctgcatagaattctgaggggttattgatgggacctaccttggcctttgaagcaggaaaagaattctcagggaattgggtgggccaggacagaggcaggggagtgctgccacatgcggcataagatttcaataatgctatttgtttgtgtctgtgttgaagggaggaagaatggtggtagagaagggaataggtgacttttcagataatctgagtacaaacaaagacacaacctgaaaggagggaactatcagcttcccagtttgccctgaaattccccctccctatttgctccgaaaattctggcccacttagatcctctttctttaagaatttgtagtgcatgtaattatagattttctgacacattgctttaatttttttttttttttttgagatggagtcgtgctctgtggcccaggctggagtgcagtggagcaatctcggctcacagcaacctctgcctcctgggttcaagtaattctcctgcctcagcctcctgagtaactgggattacaggtgcctgccaccaagcctggctaattttttgtatttttagtagagatggggtttcaccatgctggccaggctgatcttgaactcctgacctcaagtgatccgcccacctcagcctcccaaagtgcagggattacaagtatgagccactgcaccaggcctaattattttttttttaatgtgaatatttgcaaagggattaagaaatcaggctctggaggcaggtcaactttggatgaatctgggctccatgactgcatgaccttgggcaagctacttaaccctggtgccccagtttcctctgtttaaaatgggaataggctaggtgtggtggctgacacccataatcccagtgctttgggaggtcaaggtgggaggattgcttgaagccaagaatccaagaccagcctgggcaacatggtgagaccccatctctacaaaaaattttttaaaattagccaggtgtggtagcacatacctgtggtcccatttgcttgggaggctgaggtaggaggatcacttgagcccgggagatcaatgctgcagtgagatgtgatagtaccagtgtgctctagcttgggtgacagagtgagaccctatctcaaaaataaataaattaatttaaaaaaaaattttaatgaggatattaatagtacttgcctcattaggttattatggataaagtactttgccagcaaaattaatacatattcattgtagaaaagcagataatataggaaatgagcagaaaagaagataatcctctccagtctttctacccataggtaaccactatttcttgtatatttttttgtatacacagtggacatcatactcttcatgctgttttataactttgtcccctaataatatatcatgagggttttcccattctactcaattttcaaaatcattatatttaaaacatagagctacactgagtagatatagttatgtatttattaagctgtttccatagtgttgaacctttaggtggttctagttttttatttttatatgtaatgcttgaacaaacattttttgtacattaatttcacacttgaggttactttccttgaagagaaatggaattactgagtcaaaagatatttacttatagttttcagacttttgacacatattgccaaatttcctcctagaaattttgccagcaatacatgagaatttgttgtcttgcctttttgtcagtattgattattcttggtttttaaactttcaacttgatagataaaaacattttatcttatcattttattcttctttgattataaagaaggctgaatattttgtacgtttttagcctttgtatttttattctgtatgtatgtgaaatgcctgtgaattttttgtgcacatttttctttcaaaatcttcaccttcctgtaaattgtgaatttgtaagaggttttttttgttgtttgtgtgtttgtttggtttgttttttgagacaaggtctcactctgtcacctaggctagagtgctgtcgtgtgatcatgactcactgcagcctcaacctcccaggctcaagcaatcctctcacctcagcatctcaagaagctgggataacaggcccgtgccaccaaacccggctaatttttaatctttttatagaaatggggtcttatcttgttttccaggctggtcttaaactcctgagctcaagttattctcccatattggcctcccaaagtgctgggatttcaggtgtgagccactgtgcctggctagagatttttatatagaaaagctgtcagttgacttcacaagatttttttcaagcaagctgggtgcagtggcatgtgccgtagtctagctgttcaggaagctgaggcaggagtagtacttgggctcaggagttcaagtctagcctgggcaacatagcgagaccctgtctcctaattaaaaaaaaaaaagacttagtttcaacaactttgttaaattaaggttggtcaattaagcttcattcatgaggtctcttagagaaaaacaacaaatcagtggatatttatattatagtatatggggtatattatttatagatatgctgggacatttttttctctgagtacaccaagtacttgttggtaagttgatttaacttttggagtttgctttgttggtggaatacacttcttcattcatcctgattgggtgttatgaatcccattttgtgtgatgcttatgattatcttggttgattccttaactatttactagacactatcttagtattttaactcttaacagtcagccacagggtttatgcactgtacttttcagtagctccccatgtagatcaaaagtcaagatggaaggcccacagattttgtggttttagagcagtgttcataatgcttagtatcacagtgctttctatgactggaaaggtgggattcttagaaagactgcagcagttccaaaagatttatgtttcactggttctctttggagagttatcccaagagctccccctctgtgggcagatagatgattgttgctcagccttctacacatacaactcctgcagcttcttatgttgcgggaggcattcatctgtgcagcattgtagggtctgaacatgaagcatatatttcgtgaaacctggagctgaagtgaattctcttagagtatattttgaaactgtactaggactttaaacacttttggaatttaaaacagccataaaaattcttgttatactgaaggagttcctgaggcagtgtgcctctcattttaccacctaaagttgcccatagaggtccaaggagacactgctgatagcagaaagtcttccagaaagaaattaggcgacccacaccaagcatgtatggctttgagtcttacagatggctttttaatagtttagtctcttaacctaaggaagtttctgaagttccggtcagagagtctaaaaattcacattttacctaataaatgataatgaggctatttatcttgtctgtctggattttttcacttgacatttaatgaaatatcccatattacctataatttttatttgaaggtaaaaatagactacagaagaatgtgtaaaatttgtatcaatcagcagagcacaaatcaagtttctaccagtattgcttataaatatttcgatcttatttaggcatggttaagctgtttttgatggttgaacttgaaggtttgttgagaattacattttttgtcttaatttttctatttttaagtgtctgaagcgtgggtgttcaaccttttggcttccctgggccacatgggaagaagaattgtcttgggccacacataaaatatgctaacactaatgatagttgatgagctaaaaaaaaaaaaaaaaaaaaaaaaaagtccgtgcataattttcatggtatctgtcaccacagataagcaaaaaactcccctcattcaaagggttggacacctgcggatagcccttttctagctaaccttttgtatttccctggcccgtaatctgtatttagaatttttagtagtattttgacaaatatagatgctttcctaaggcatatcattttgtaaaaattgtattgcaaacctttttctcttgattttcccttccttagcttctcccttcctttcctcccgccccttacctcctcacctctcatttatgggtctgtttatttttcaccttaagaataatgattgttgcctgggacttgtcttataaattcagttctttctaatgaggcactaaagctgtctcctggcttttgggttttcctgagaactgttaattacctttgcactttcctatacccagctcaaaagtaaattgcagagggaagagaggaggatgcacctgtttataaaaatgtggtagttgagcaaaatgcttaatggaaaatattaacagcataacctcatataatcaactcaatcttgtctagagtatgtttactgcagttgtagctgtcaaatgtttcatgttatatatagacccctaccgtgatgcctttcatatcactcttatttgttgccactgttttcattcacaaccttagctcagatctctgccacattagctttttcattgggcttttcctgcctccatgtcaaatcctttcaatttgtaagtccaacaagcagctgctgggttttaatatgtccagaggactgttaggagtgggtcactgcacacccctcccaaaattcctcctgagtacaaagttcttacctacttccagcctttttaccataagccccagcttaattttctaaccttgtcagttgtcacccctggtgatctgtatagtctgctttcttttcagcaggtggtacttttcttaccacccatatctgtgcagagaaatctgacccacctggaaagctgagacgacacctgtcctctggcattcctttccagacccttccagcttgcagtgctcctctgccttctgtagttcccgtgtcactcgtctggaattatttttacatttgtggacccttattactcttgcctgagggtaggaaccaactcatccatttctaggtcccctcagcatactcaaactgcatggcctacagcctgtgctcagtgtgacattctcttctggttcttttcctcgtcaatattctcatctctcctattgtaaaacaacagctaccccaaactctctctttaccccagattcttctccttctacagccatctctctctccttttctccataaatggttgttttaatgagtagctttgttgattttcctgataaacaagctcattcaagaaaaaaatgcaaataatacaggacttggtgaaggtaaaaatcttttaaaatgccatcacccagagataaattacttttcactaaacatcctctctcactgcacacacatacacacactcaatattcatgacacacaattttgtatcaatgaaatcacacctaaatgctgttctatgacctgcttaaaaaaatttcaacattatactgggtacatctttacaagctagttcttgttaatcctcaggaaaacgttactgaaaatggctgtaaagtattccattattccagtgagtcaaaaatgattaataggccaagcacagtggctcttgcctataatcccaccactttactagaccgaggtgggaggatcgcttgagcccagaaattcaagatcagcctgggcaacatagcgagactcttgtctctacaaaaaatttaaaaagttagccaggcatggtgatgagtgcctatagtcccagatactcaggaggctgaggcaagaggattgtttgcaccccagaagtcaaggctgcagtgagctgagatcgtgccactgcagcctaggtgacaaagtgagaccctgcctcaataataataataataatgatgatgatgtactccccctttaaatgagcatttctgttttttctgttttgttttgttttgttttgtttttcctcttataaccagcactatagtgaacatcttttatagctatctttagactctctttcctccctgttatctttttaggataaattcttagaagtgaaatcgctgggtcaaagtatatttattctaggtgctgttaatgcccaactgcccatcaaaaaggtaatgttgtacctaagtaaagttgtgagtggatttttcactaccctcaccaacatggatgttgtccagtcaccctaatctttactagttttatggctttatatatatgtttacatttatatataatgcatttctttgaagactgagtttgaaaatcattgtgtaagttaacgcctgtgtgtgtgtgcacgtgcacacacttatgtgttttccttcaattagactgaagtcttctggggacctgagcctaaataatttcaggtggatcacttgagatcaggagttcgagaccaccctggccaacatggcaaaaccctttctgtactaaaaatacaaaaaattagctgggtgtggtggcaggcgcctgtaatcccagctactcgggaggctgaggcaggagaatcgcttgaacttgggaggtggaggttgcctggattgcaccactgcactccagcctgggtgatggagtgagactctgtctcaaaaacaacaacaacaaaaaaaaaaaaaaaaaaaaagaggagatctaggcaggaagttaattgctggagttactagcacctggaaggtcattgaagccacgagactggatgggacccctagagagtaagtatatatagacaggaggcccaaggactgagcctgtggattacctaatgttacagctggggagaggaggaaaagccagcaaaagaatgtgggaaagagtggccggaaagttaggaaggaaataggtatgtgtttatctgtgtgttagtgtgtatgtgtgggtgtgtgtgtgttttactgaaagctgagcaaagttaaggagaaaggattcacatttcaaatcctggatcaagttagtccaggagtgagaactgacatttgagcttagcaatgtggaaaacaccaagaccttgataagagcaattgtagtggggtggccgaaggaaagcctgactggagtggcttcaagatagagaaggagggaggccgaggcaggagaattgcttgaacccaggaggcagagtttgcagtgagatgaggtcacgccattgcactctagcctgggcaacaagagcgaaactccatctcaaaaaaaaaaaaaaaaaaaaaaaaagagagagagagaaggaggagagaaagtgaagtcataagtgtagaccactccttctgagggagaatccaccccaccttcctcctagcttctggtggttgctggcaatctttggcgttccctagcttgcagatgcagcactccaatccctgctttcatcttcttagggtggtctccctatgtacatgtctctgtgtcctaatttccccattctataagacacaagtcacattggattaggactcacagtaatgacctcatcttaatttgatcatcttcaaagaccctatttgcaaataagttcacattctgagataataggagttagaacttcagcttatccttttggggggcacccaattcaatccataacagcaacccgttaagctcccacattgtttcaaatagtttatttgactttcttggatctttgggatatgtaatatatacattggaaatcattttgttggttttctactttgtaaagtctgtaacttgaattttgctcccttgtctaattttgttttactttaacctccttgaaagatctgactacacttatgatttctatttcttgactcctgggtctttgccacccactgaaaccactgtgttctgtaccattaaccactagcctgagttatggaacgcttatagaagttcttgttggcagagctctaatctaaactgaataagcaccttaccttacctgtagggaattaggcttaaaaattgaaagaccactcagtctcactggcccacgttggagtatctgccttggccctgtgaactggagctcatcccattcagagacggttctgccggtgccctggttaccttggctcatacgtggctaggaagagccccagaggaacggtggtcactgcctgctccccagcctcccatccacccccatggtcactgtccgcatggtcactgtccttgctctgtgttttcatggtggactacttatactttttatttaatagagtttctttaaatcggagattattagattttttttccctaatctcgcatcccaaatttcaaattcaggcatgctatataagtttttcctcccttgcctataccttttaatcttacatagccattgctgtaggtctagagaatttatttaacagcatattgtttcattaaaaaaaatttggccaggagcagtggctcacacctgtaatcccagcactttgggaggctgaggtggatagatcacctgaggtcaggagtttgagatcagcctggtcaacatggtgagaccctgtctctactaaaaatacaaaaattagccaggcatggcggcgtatgcccataatcccagctactcgggaggctgaggcaggagaatcgctttaacctggcggtggagtgagccaagatcgcaccattgcactccagcctgggcgatagagtgagactctgtctaaaaaaaaaaaaaaagaaagaaagaaaaagtaatttttactctaaaggtgttacttcttgtttacttttccttttaaatctcatctttattctcatcctttaaagattatctaagtctcaccagaaaatttctgcataccaaaaatatagtgtttactaatcaagtataacaacattatacttttgtaaagtaatgtcttatgttaccaatttggatgatttttctaaacattgttttcaggcactgttagtccagttaatggtgagagtttaggcttaaaaactgtcaacttgtagctaggtgtggtggctcacgcctgtaattctagcactttgggtggccgaggtgggtggatcacttgaggtcaggagttcgagaccagcctggtcaacatggtgaaacctcatctctacttaaaaaaaaaaaaattagcaggatgtggtggcacatgcctgtaatcccagctacttgggaggctggggcaggagactcgcttgaacccaggaagcagaggtgagaagtgagccaagatcgtgccactgcactcaagcctggacaacagagtgagaccctgtctcaaaacaaaacaaaacaaaaattttcaatttgtaatggcatagatgaaagagaaacaggtggcagtgtttatgtgtcaaacttctccaaatagacgactgtctcaccttttgaaaccctgtctcaaaaaaacaaaacaaaacaaaacaaaacaaaacacctgaaaacttactgggtcttgttcagtgacaccctcccaggatagcctgtgcctagagtgtgaacacactgcctatagattcttccagaaaacctcacagtgaagggtgttgatggacaagagagctgtgtgtgatgctacacagctcacccaacttcttttatcttttttcccacatctctgtagctgtcattagcttgaggtagagaaaaaatgttcagaatgtacagtgatccctaaacaaattattaacagaggtcataaaggcatttcaatctgaggatatctaacatgaataacttttagactcactctgtcacccaggctggagtgcagtggcgggatctcggctcactgcaagctccacctcctgggttcatgccattctcctgcctcagcctcctgagtagctgggactacaggcgcctgccaccacgcctggctaattttttgtagttttagtagagacggggtttcactgtgttagccaggatggtttcgatctcctgaccttgtgatccacctgcctcagcctcccaaagtgctgggattacaggtgtgagccaccgctcccagcctttctcatctttttaaatctgaaaactgcccactacagtgttgcactggatgtagtccagtgtgcacatccacccacagtgaaagtgaaaccaaccatgagttgaatgaagtattatgggagtgtttgtgggaagcctgacaaacctaaagtttgcctctcattttctagtgtagtagtggattcttggtacggttataagctgttctagacagtgcgaaatctagtgttgatttcactttgatttgaaattatttgtgtttttactttggctcctttacagccagagtaaaacttaacttatattcttgtattccaagtttaacttattttccaagtttagcttaacctatattcttgacctgatcagaatttttggactttgggtcaaccataaagaggctcaatatataatgagaaatttgtctcactttaagttgtcagaaagcagcacccaaaacgctctatgtaaaacatgaatagatgcatgaaaatacaacttatttaagaaacaaacccaaggagcccaaacctaaaatctggacctttcttacttaagcaaaaatatcagagtcatgcacgtatgactcttattccatgactgtcttcaaattgactcatcacatccctgttttcaaattaaatagttgccatattctaaattctgtttatgaagttaggaggtaaacagaaaacaatctaaaacctgcttatttcaattgattctgtttgttagcatatctgtactggcatgaatatgattggaacatgcagagttgtagcacacccttatttctggttgattgccaaaaataaagacatcaaagaaaatagaaaaactgggcaacaaatcataactgcataggtttttaaatttagtagttattctagatctctctccatagcttttctgaatgaaactgtccctctcacagcccccagcctcccactgtcctagatagatgaggtgattgttctcaccacctttggatttgtacatgtgtggcattgttttcataggacagattcccagatgtggaaatgctcaaagagagtgaacatttaacaaatactgccagattgtcctccagaaaggttgtacccatgtgcacatccacccacagtgaaagtgaaaccaaccatgagttgaatgaagtattatgggagtgtttgtgggaagcctgacaaacctcaagtttgcctgccattttctagtacagtagtggattcttggtatggctataagctgttttagacagtgtgaaacaatttacaggtatctttagcaaagaacattttcataggtacttttacatgaaaagtgttataatattaaagaatcttttaaaataatgcataatgccactcttgatacattttcatcttttgtagattatcatctacatgtgaatatattttaccagttataattaatatgtgtatgtttttgtgtttttgtttttttgttttgttttgttttgtttttttaagacggattcttgctttgttgtccagactagagtgaagtggcttgatcctggctcactgcaacctccgcctcctgggttcaagcaattctcctgtctcagcctcccgagtagctgggattataggcgtgcaccaccatggccagctaatttttgtattttttttagtagagacaggatttcgccatgttggccaggctggtctcgaactcttgacctcaggtgatccgcccactttgacctcccaaagtgctggcacccagccaatatgtgtgtatttttatctttgactttttccacaaaactgtcttataagctgtttcctgtttctccatatctttcatcatggctatttaaaagctgcatgttgtattttgttattataccatactttgttaattcagttcttaatattgaatatttaatataaaactagatacttaaactgcatgttcttaagtgataaggttgattggtttgatgtggttataaaagtaatacagtgcttatagaaaaatttggaagacacaaaaaaataggatgacacatacaaattgtcctgtaactcctgttaataaattctgtgagcattaggatgtatttccttcctgtcttttcttaatattttattttcttgttttatagtctgcaaccatgctatttgtgaacaacattcatttttacatgttttaaactcttttcaaatatcatttttccttttttaaaaaatatgaaaggtttttgttttgttttgttttttgagacggagtctcgttctgtcgcccaggctggagtgcagtggcacaatcttggccccctgcaagctccgcctcacgggttcacgccattctcctgcctcagcctcccaagtagctgggactacaggcaccccctaccacgcccggctaattttttgcatttttagtagagacggggtttcaccgtattagccaggatggtctcgatctcctgacctcgtgatccacccacctcggcctcccaaagtgctgggattacaggcgtgagccaccgtgcccagccggtgaaaggttttttttcttctggtgaaagtaatttgaaattgttactgtaaattgagaaataatcccagtcatctataattccatcacctagaggcaaacatcatgaataatttggtttattaccttcacatatttttctcttaaaaaaaaatttgagatcatacaccatcattgtttcttaattagggggtggtcatggacctttttaaaaatctgaaaaaatccaaattaagaattcttttttggctgggcacggtggctcatacctgtaatcccagcagtttgggaggccgaggcgggcggatcatgaggtcaggagtttgagaccatcctggctaacatggcgaaacctcatctgtactaaaaatacaaaaaattagccaggcgtggtggcgggtgcctgtagtcccagctactcgggaggctgaggcaggagaatggcatgaacccggggggtggagcttgcagtgagccgagattgtgccactgcactccaccctgggcgacagagcgagactccgtctcaaaaaaaaaaaaaaaaaagaattctttttcaaccaagtggccagttgaaaaaaatttttttaattaaaaaaaagaaaaaatagaagtcttaccatatacatacattgatacccaccctttccccctattaaacgtgataaagtaggcatttctgtataattatgaactcataaatatgcacattttctgattattgtgcattgaattatctctgtcctcaaattcatatgttgaagtcctaatccccagcacctcagattgtgaccttatttagagatgggatctctacagagctaatcaagctaaaatgaggtcagtagagtggaccttgatccaatatgattggtgtctttataaaaggaggaaattcgctaggcacggtggttcatgcctgtagtcccaactactcaggaggctgaggtgtgaggatggcttgaacccaggggttctgggcagtagtgtgctatgccaattgggtgtccaaaccagcatcaatatgataacctctcaggagtgggggaccaccaggttgcctaaggagggatgaagtgacccaggtcagaaatggagcaggtcaaaactcccttgctgatcagtagtgggatagcacctatgaatagccactgcactctagtctgggcaacatagtgagaccctgtctctaaaaaaaaaatttaattggccgggcacggtggctcacgcctgtaatcccagcactttgggaggctgaggcgggcggatcacctgaggtcaggagttcaagaccagtctggccaacatgatgaaaccccatctctactaaaaatacaaaaaattagccaggcgtggtggtgtgcacctgtaatcccagccggggtgaggaggcggggagggggcggggtggtgctgagacaggagaattgcttgaacctgggaggcggagattgggatgagctgagattgcaccactgcactccagcctgggcgacagagtgagactctgtctcaaaaaaaaaaaaaaagaggaaaaatacttaattaaaaaaaaaatttttttaaaagaaatgagacatacatagaaggaatatgaggtgaagagacatagagaagatggccatttacaagctaagaagaggggcctgaaaagatgtttccctcacagccctcggaagtagcctaccctgctgacacctttatttcagatttctagcatccagaactgtgagacagtaagtctctgttgtttaagccacccagtttacataatgcagacatttggatgaatatttactttgtgctaggcattgcactaggtttaggaatactaagtcaaagaagtcaagttctctgtctcgaaggtacctagattggcatgtgcataaagaaccctggggttgtgcaattttgggcgataaacagggcatcatgggaggctaggttaggcaagggtcagggaagatttcccggggatgtatcacttgagctgaattttgaagaaccactgggagcttacttaactatttttctgttattggacactaggatgtttccggttattcatttttacaaatgagaacttccctgtgtttttggattatttctttaggatagattctcagcaacgtaccactactgagacaagaatatgaaaccagaaacatcatttgaaggcagcataatattctaccagatggagctttcctggctcattgaatcatcttcttttattggatagcagtccccctaatgttctgtttccagtgttttgttattataaatagtgctgtagcatacattttttgcataaagcctttttccataattagaattatttctttttttattttttatttttatttatttatttatttatttatttattattattatactttaagttttagggtacttgtgcacaatgtgcaggttagttacatatgtatacatgtgccatgctggtgtgctgcacccattaactcatcatttaacattaggtatatctcctaatgctatccctcccgcctcccctagaattgtttctttagtgattgaatcatagaaatagaattacagtatgaaaaaggtttacttacttttcaaaaatactgacattctcagtaataatcaagtgaaatttattaacaaattaatttgatttattatagtctttatattgtttggggtgtgttaaaacagtttaatacttcctgcttttaaagactgaaactttcctagaaagtaaagtttggtttgtatcacgtgtgatgaagaaccccttttctttaagttcctcctccacctaaaagaaacttgctttataaagggcacaatactgtcacaaacttgcccacacaatttctgtgctggtttctcaccagctggtgtgtatattgcatcggcctctgttcatactctcctagattgttgtctgtctgaaaggtaactatcccagaagatcagccttccaagtgagctatttctgttctattttgtgtgtctttcaaaatgactcctgcattctccaccagactcaaaatcccatttatgttggcagcatatctactgtaatagagtaacagagaactgcagttatggtgacacatgggaataggggcgcatgaaggagccaggtcaggaatgacagggtgctctgtcccagtgaggggagggtttgccagcaaggattgtattgttcccttcatctcaaaagtgagtatgagtacattttagtcacttaacaaagtaataaacatcaagggctacttatatattttgtatattttttatatattttatatattttttgtatattttgtatatatagttttgtatatttttaaaaaagatatcctcctcactaattactttttaaaaattttacttttaaaaatcagaaaaaaaaaatgcaaagttggctagaaatagtggctcatgccttggcactttgggaggccaaggcaggaggatcacttgaggccaggagtttgagaccagtctgggcaacatagtgagaccacatctctacattttttttttgtttttttttgctgggcatggtggtgcatgcctgtagtttcagctacttgagaggctgaggtgggacgatcacttgagcccaggaggttgaggctacagtgagccatcattgtgccacagcacttcagcctgggtgacagagtaagaccctgtctcaaaaaaaaaaaaaatagaagaagaagaagaagcaaagttatatgtattttaaatattataggagcacacaatgtagaaagtgtaagtatcccataatcctaccccacaaagataacccaccatggtctgcagtttaggacatatttctctaaattttttccttgcatttaaaaaatacagtgatgctcaacttcgttaacaaaaaatgaaatacaaagtaaacaaaaatgagcatcccccactttagctcttaaagataaaacaaaaacgtaaaaacagtagttatatccatgttggtggccacatagcaaaatgggtactctcatacaatgttggtaggaatataaattggttcaaattgaacatctcaaacctgaaaatctgaaatgctccaaaatccagaaatttttgagtgccaacatgacgctcaaaggaaatgcttattggagaattgtagattttggattttgggatttgatatgttcaaagtataatacaaatattccccaaccccccaaaattcaaaatcggaaacacttctgattctaagcatttcaaattaaaggatactcaaccgtataatctatttagagggcaatttgtcagtaatgatcaaaattttatgtgtaacacatgtcatgtgcatttcctctgttgactttagaaaaagaggaatgttgatagctgttttataataatgttattagcaatagtgatcgtggtagtggcaggaatactgctggttgtgctgcttgcagtagtggtactggtggtacggctggcagtgctggtggtactgctgctgctgctggtggtggtactgctgctggtggtggtactattggcagtgctgatactgtaccactgatagcactggtactggtggtactggtggtgctggtgatttgagcattcactgccttctactatgtgatgaagcttaacaaagtcacatccaagtctgctttgtacccagaacagtgccagagggcagtgtgggtcaaagcacctcttttgattctctcataacatagacagaaagatgagctttccaggaggaaagatttttaccattgcccctcataaggtggaaatagctggtgtccatccaagcccctgctcacacactcagaaggcacttcctaggaactccttccccgcctttgcttctaagtcccagaccagcagtgagattctgccctttgaaatatttataacattcaattcactataaaacactttgtaaatgtaagtgctgtaagtggcccaaattatatcagcagctttttgagaaatgggaaaaggaaaaggaatttaagggaatgggatccagtgagccaaccttgctattttcaaaccaaaataaatggccgtagatctgcattttataatttcagaaatgactaatgcttggactatttttgagcattataagagtggcttcatcccagtataaatcattctttctacattacacagattatgttgctttttaaatcaatttttttatttcatagtcattttgtttccaggtctaaaaatcctgaaattcctttcttaagggggtccctttgtatcagccactaaggaagtcattgaaacctaactggcttctcccagcacccactacgtaggctaccctctccccagtcctgcaggaaaggccccttgcccacaaatgcacaggggccggaatttttcattgttggaaattctccccaccttgtgtagatactgtctccatctaatcatcactcctttgttctgctgtttggaacccccagaataaatctactctttgtatccttcatgtattgaggatggtcatacccctactcccaccctcaaatgatttcttcctcattggacaggattcctggaagttaccctcctggttacctactccactaggtagaatagtacacagactgtctattctcccgagtccccaccaacttgttcataataatgtatttctgataatgaatcctaaaattgagtttgttaacttgtttttggcacccacatcacaccattgtctcatattgatctataaacaaaccaaaactccagaccagttgctttttgagcctaagtgcaagatgtaacatgcttctctgaaatgttgtcttttttcctttgggctcattctttccagacccagacatcttttggaattctgattctgtccagtgggtcttatctaaagcattcctctctcccagcacagtgtccttggatgacttgaaaagcccgcctggtagattgctgatgtatttacttaggcccagggctctgaagagggtgacaaatctctcataacgagtttgccaaatgcatgctggcagcccacggattcaaggctccttagagaaggcagaagaacaaaacctagggcctggctgtcagagggtgccacagctgctggggtggagaatctgctggggtggaggattggaagagttttggtttggccattgacatgtaaatgtcagagaggcctgaggctgttccccagtggaccctcccgccttcccacacaaagccctggctctgtgagggccatggctttgcctttgtgaggcctgggccatcccagctgcagagggaagtccccgtaagtattcactcttgtaaaactgttccattttgcactgtggttgtcgacagcaagcttctcccagctgcatggagtgggagtgttctctttggaatgcgctcttttctggatatagacataggtcctttaaaggtttttgaaatgaaaatgaatactactaggtgattattaatttgaattatgtaaggagagaaacagagagatatatttgtgcacgtgtatgtgcatttacaagaacaagattagctacaaggttcaaaggactttttgaattttacctgatatttctgaaggataattttatttttggcattgtgttttctgtagtcctcctctctctctctgtctctctctctctctctaacctattttgagacagagtctcgtgctgttgcccaggctggagtgcagtggtgcaatcttggctcactgcaacctctgtcaagcgcttctcgtgcctcagtgtcctgagtatctgggattacaggtgtgcccaccaccatgccctgctaatttttgtatttttagtagagatgaggttttaccatgttggccaggctggtctcaaactcctgacctcaggtgatccgcctgcctcagcctcccaaggtgctggagttacagatgtgagccaccgcggccggccaagaatgaatattttgaagtgttttttcttttttcctctgaaacttcagtgtcctatattcaatatgtgaattgtgaaatacgtgatgcgcttaccacagggtagaggatatatgtctttgtcatgctgtgggcttattttttttataagtcctttactaactggccagcgattatttaaaatataaattgagatttcatattcagaatgaggagtactggattgagtaagaggaaaatcttgatcttaaaaaatcttgaagtaaaaggttttgtttggtaaagttttcccacataggactcacttccttaactgcttacagagatggtgcttttaaagaaaacattttcttaataaaatacaaatgttttcagatctctctgtctttggtacagatgccttttgcaatatgagttcagtacacagtgtgcatccttaagccttgaatattcagatacatttttgctcttttaaaagtaattacagtaatagaattatgtttacattccagaatacccataatgagattggaaaaaaaagttcaagcagtcagtcttctatccagaagccataaattctgttattgagtgtgaaatctattcttaatttttaaatgtcttttgctctaatgaacttaattagtggagtttggtacagtggaaagaatactaaacaaagtgttttgagacgtgggctctatctctagctacctaggtggccttaggtgaatgtcttctggacctcagtgatggactgtatcaatggttctcaactcaggggcccttggaaatgttgagtgggaacatgtcaggttgccacactgtatgggggcactaatggtttgggaaccctggatgttaggcatcttgaaatgccccagactgtctcacccagcccaatgaagaattggcccactccaaatatcaatgacacccctacgagtaacactggactagatgattacttaggtttttcctgctttgttactgtcaagttcataagtggagtattggcaagcatctaaaataatgtgatgccaatacgctcagtgtctgtctctcacatttagcattgaacgctatgttttctggggtgaagtcatacccagtaatgctgggtcaggacatgcggctgtggcaactcagattcagagctttgttgctgggagaaatctctactgtaagcacagaaaatactgatatggctcaaaagcaggtgcagagctggacctgggttttttggttggctttggattatccttatattctttcctcaaagggaagcagtgggtttgtggccacatgcttgccccaaggccctgggcttttctgctgtaaacaaagggcagctgcctcttcacacttctctgctgcttggtgctgtcccatctgttgggaaagggggtctctggagcctccagtgctgccctgcaaacccaaatccggctgcctgttgtcaggaaccatctagacaactctgacgaggcagaaggggatttggtctggaaaaaagattcctggggtgtctaaattttttggtaggttggcatgattaaattactccttatttgatagtgaagtgctgttaaatgaaagtcacacaggaaagcttctctctggattgtctttttgtagaaagcaaaggtgagttattactaatcctcaccagaaatttgctgtgatgtttgtgcatatatacaactcttaataactacagtgttctattacctgaagcatgcgttttaattaatgtgttattttccctataaaaataatttatttaaagaaaattcaactaagaaaaatatcagtaataactacattttgatacatatcttgccagtctttaaaacatttttaaaaaatggggtcataatgtatgatgttttacaactttctttgttcactttgtaatatctcatgtattgtttctgagacatatagtcatgtgtcacataacaactttgtagccagtgacagaccatctataggaaggtggtcccaaaagattatgatggagcttgtgtagaaacctgatgtgtggcacttgagattggcattgcagatcaagtagcagaaatgattgatattcagtaatggtgctgggacatttgattatatacatatatgaaaaaattatataaataaaaatatatataccatctaggtttatgtaagtacactctatgatgttctcacatgacaaaatcacctaacagtacatttctcagaatgtatccatgtttgtaacatgattgtattacacaattttacatgacttctgtcttagttcaggctgctataacaaaataccatagacgggtggcttaagcaatcagaaatttatttctgacagttctgagagctgggacatttgagatcagggtgtcagcatggattagttcttttaaaaattttttaaatatatttttaatttttaatttttttgtagagatggagtctcaccatcttgcctaggctggtctcaaactcccgggctcaagcgatctctttccttgccctcccaaagtgctagaggtgcgagccaccctggttcagttctgtcaatggccctcttcctggtttccttgccatgtcctcacatttgtagagcagagagaaaggaagcaagctctcttgttatctcttctcataagggcactaatcccattgtgaaggcttcaccctcataacctaattacctccccaaagtcccatctccaaatcacatcacactggggattagggtttaaacatatgaatttggggttggggggtggacacaaacattcagtccatagcagctactggtaattcactgaaaggatggtgccgaagagtacaggtcctagagttggaccctgtgggttcataccttagccctgacacttattaactgggcaaattattgaatggctttgtgcattatttactcatctgtataatggggagaatgttaataccaaccacattggtgtgttctgagaattaaatgagataatagatgttgggtgctcagaatagagccttacataaaataagcatttagtatctattaaatatcgtcttatcagcaccagcatcaccatgattatatgaccatacatcccactaacaaatcccctggcattagattcttgcaattaaattctttctgacatgcagagtattactttaggatcatttttaaaatgtggaatttctgagccaaagaacaaacagcagtttaaagctttggatacatattgctagatttctttccaggaagcttgtctcagtattcactcctaccaacttttctcagcattaaaaaattcagcttgtcttccttctaacattctgtgtgctgtgggacctccccattccaataatttggaatataaattcatttcatattgttctggggcaagcattattatgaaaatgaattagccacaaaacaaatcacataaagcatttcgccatcaaatgaaaagaataaggtggctcacctacgcttggtttttcacctgtgcttcaccttctctcattgatcaaggaatgtttatgtgtgagaggatgtgaatgtgtagtcctcagactctcttccctgcaacctagtttaatgtctagacatactggaagaaaaaaaatgatctttggtaacatgatgggaaaagtgcatgaaattagctacataaattgtgaaatagcaagtcagtctttttattctgtgatgtgtaaaaatcacttatttcattgtatttacttttacttttccacaaagaaattgctgcaagttggtatgtacagaggtaagatccacagtgtaacctttgttacttgatactaagtcctggcccaggatgcttgttcagcttgcctgtgctaccaagtgcctggtggtgactcaattctcccacctgtcgtctctttttggatgactgagagccctctctacagcatgttgtgacctagccagcctggccttcacctgtatccagtgcagtattgccagaggaagcctgctttcattttgttctcagcagtccacccacctgcatttgattataaacacaaattcaaacgtgagcatttaatacacatgacataatgaagctgggtgtagtggcacatgcctgcagtcccagctacctaggaggctgaggcaggaggattgcttgagccccagagtttgaggctgcagtgggctgtgattgtaccactgcactccagactgagggacagagtgagaccctgtctctaataaataaaaacaaaccacatgacagtgcaattatgagggaggcatccagctgatctcaaatatgttcagtttgttagattctcattaagaacatagaatgtaaaaattctcattcaggattctcagatttctgaaaatacattttaggcccccagagctatgcttagtaaaggctgatttggtttttagacactgtccaaggtactttggataattattggcattccaaaaagaaatataggttacatttatattgtttcttttgattgaatacttgactcattttgatcaagaacagtgggttttaaacttttaactgtgacccactatgagaactagtgacccagtatgtacacatacatatataaacatacacacaaatgaaacaaatgtttcccacccaaaatatatcgatctattctattctattctattctattctattctattctattctattctattctattctagttcattctttaaaatgctgcttgtgacctattaacttattttcatgacccacaaatgggccatgacctcccgtttgaaaatccaattccagaggtggtttcttaggactgtgggttgactgataacgtgtctcatgcgtcgcacattgccttcctcttggtaccgggtccaaggcaggctgtacatgtccagggcattgctcctgaaggggtctcagtgccacagggctgggcaggaaatcaaggcagagctctttgtgttggctgcctggggacttgaagagctttgcttttgagaactttggtccttccctgaaccggctgctgcagctgacagctctgcctgagtgggaaagtttaaacgaggacaataattcagtttgagtgcccctgaatcatgtctttgtctctgctcttgacagaacagaaggaagtttttcattattaaggatgccagctgcccacagattgatatatctgtagccagggctggctcactctcaagtaggtacagatctggctccccagttggtatattttgaagaagtccagaaaatattttccttaaatgtctccactcagtctcctatgcctaaaatttcatgattagaagtttggtcttttgcatcttctaagtttttggtcttctagaattccagatcaacataaaaacatcattggaaaagagactaccttaggattgtatcaggtaatatataatggggatttggacagtgctgagagcaaggcatgcccatttcgttggagctggggatacaggagcgaggacctgtggactagagaatggtgagcaggaggaaatggagtggaggaggccgcagggcaggcttggcctggtgaagcctgtgtctaacggtaattggaaagctccatgaactgtggagccctttaaatttattaatgagaattttatgaagaccttgtgacttggggtggacttcagcaaggcttagtgatgaaggaaccaacactcaacaagagtgaccagaactcttaggccacttgctactcagggattctgtgtcctgggttgtccactgtgttttgtttaacaaatttattcccatgcagacaacatgactaattgtatgctacccaagagtcaccttttattttttccaatggcatctaagcaccttgcatttacatgggcattttttccttagttttctggtcattcagattggtccagattaatccagttcaattgcatgcgcatttgcttttctagttgttggtcatcgtaggatttagtgctggaaaagaccttagcaatcacctcagtcagtgatttttcggctgtggttttcaacccattactgggtcttcaaatcagttttatgggtgcaactgacagggattgttgggagaatccagtaaatatttatcttccccaccaggtgttgtgtagtacacaaatacgtgatacctcataatgagtagcaatgtacaaaacagtgtgttttgtgtgagtgatacagatagattcttttattcgacaaatatcagatgtcattgaagcccttattgtttattggtactgtggtgaggtgtgggggatacaaagatgagtgacatgggccctgccctggagatgctcagatgatagcggggagacaggtgcaaaaggctgttgtgacacagtggtgactgcagtggtgaggatgcctggttacatcctccttacctaatgagcacctgctccggaggccctgctctggaaaagcagcaggctggctgattcagctggaccaaacacagctgtgagaagctgcagggtgtgtctttgagagaaaactcacctctgcggtttagaaaacaagagcagggaaggcttctggggagaagtgccatctccgcttggcctgtgtagtgggtcaaatggtggccccccaaaagataagtccatgtcctaagccctggagcctgtgaatattcccttattttaaaaaaaggttttgcagatgtgattaagatgaggcagtcatcctggatcgtttgggtgagccctaaatctaacaacaagtgttcttttaagaggcagagggagacttgacatagaacaggacaaggccatgtgacgagtgagactgaaataatgaggccacaagtcaaggaatgttgttgcagtcatcagaagctggaagggttctccccaagagcttccagagggaacacagctccgccgacaacttcattttggactcctggcctccaaaactgtgagggaacacatttctgttgtaccaagccaccacatttgtggtaatctgttatgacaatcctagaaaatgaacatggtctggattttcataggccgaaattacagaagggatggtgttgggattcaggacacgtgaccccaaaatatttcaagttgaagaaacttgagaaaactgcagatataggagggttgctcttacttcccccacaacccctgcccttttcccctgaagccgtccatacaatctaggaagaattgtctgaactttccctgaagcaggtcttgagatgcttatgtaagaagtcctctcctttgtagggacatggttgaagctggaaaccatcattctcagcaaactattgcaagaacaaaaagccaaacaccgcatgttctcactcataggtgggaattgaacaatgagaacacttggacacaggaaggggaatatcacacaccagggcctgtcatggggtggggggaggcgggagggaaagcattaagagatatacctaatgtaaatgatgagttaatgggtgcagcacaccaacatggcacatgtatacatatgtaacaaacctgcacgttgtgcacatgtaccctagaacttaaagtataatttaaaaaaataataaaattaaaaaaaaaaagtcctctccttatacctggaggaaaagaatgtaattctccctgaagatgaagggtcacagagaagaatctgcacaaacaggtcgtgctgtgtttcctccagtctattaccattagatcctatcgcctttgtccaatcatacttcatcgctctccacttcttcatcatacccagcataaaaaaatacatgtttccctattgctttgggtctttatttccttatgaagactcccacgtcacctaaaacttacattgaataaatgtgcatgcttttctctggttaatctttcttttgttatggggcctcagccatgaacctagcatgggtaaggaaagatgcttttcctccctataagggcatttctggagagagcgccggggctgggagacagagccctgtttgggaagagagaagggagcagcctggcctgagcgcggattttgtgaaaggcatgacaggagatactgctggaaagcatgtagctgacctggtgcctttgtgatggtttgagtaattccttgtttgtagaggatcatttggtagttcattgtgctgcctcttaggtaatggctcttaacaccgggtgacccagcaaaaaacacagggtgaggtttgtttgttacccaggtggctgtacttgtgtgtgtttgcagggagagtaatgctccctgatatgtaaatgctccttgattttgcctgctgaagacaaccacgcacaccccactagagggttgccttagccactttctgcattttgttcttgaacctgcacttctcactgctttttcctaaacagatatatttttgtggcattttatgtccttgaaatgatcaattaatgtatactcattcctgtgaggtgtagtaaacatctttaagccaggtgaagaggttcgtaacatgaaaccagtccatgcctctttcagagattcacaacaggccctccccattctagaagaactggaccatttggtaccttttttttctttagtgagctagaatttaagaatgagtacattttgggacctaattaaattttatatctaccagttgagaaatagccggtgaaagtcttgtgtcttttcagctgtcttcctaagctgcatgacacattcttatatttttgcccttccccatgccccaaattccacatatactcatggcttatggcttttcattattagtttttataatagaaataattcaagcttgttgtaaaaatgtcaaatgataggtgtgaatatatggctccataacccttcagctggctgcagacgtagactcacacttcagtcctcacatcagcttccttttgtaacaaattaccacaaacttggtgggtgtaaagcaacagaaatatattctcccagagttctggaggccagaagtccaaaaatcaatgtgttgcagggccctgctccctccagagtttctaggggatattctgttccttgcctcttgcagtttctggggattgtatgtatttcttggcttgagaaatatggctccaatctctgccttcatctttacttccttttgtcttctgtgtgtctctgtgtgtcaactctcactctctctctccctctccttttttaatttttttattctttgagacagggtcttgctctgtcacctagtctggaatacggtggcatgatctcagctcactgcagccttgacctcctgggctcaagcaatcctcccacttcagcttcctgagtagctgggactacaggcatgcactatcatgcccagctaatttttaaatttttttttgtaaagacagggcctcactgtgttgcccaggctggtctcgaactcctgggcccaagcagtctttccacctctgcctcccaaaaaagtgctggaattacaggtgtgagccgccacgcccagcctgtctgtctcttataaggatacatgtgactgcatttagggcccactgtgataatccaggataagcccttcctcacagaatccttaatttaaccacatttcggggggttatataaggtgatatccactcttttgtcatataaggtaatactgacaggtttcaggcattaggaagttgacataactttttgggggccactgttcaacccactacaattgttaaagaaaaagttattctgacacttgttaaaatggtaaaggagactttattcaggattatcctgctaggtgtcaagatagttgcactagggtagagagattgggttcaactctgaatacaacacaagtgagtaggaggaccaggtgtggtagcaggaggatcacttgagaccaggagtttgagaccagcctgagcagcatagcaagatcccctctctaccaagaaaaaaaaaatgagcggcgttggtagccaaggaaaaggccatgggggtctgtagatggaagattactaagaggagacatcaagggttgggtgattcatgctaaactaacaggattcctgctgaaggcagataactcttgatcagatgtcacctgggggatgaagaatttgattagatagtaatgggatcaagtatcaggggtgggaggattctttctaaactgacttagcaggattcttgctaacactgggctgtgcaggcctggcaaggatggggactaatactgaagccaagtcaagaagagggcccagaagagtccaactcaagtttggtcaaggagaagtctctgtcacaatcctttaagcagtgttttgcatactcacaaagaccattaataggaacctggttttcactgtgaagttatcagcaatcaagcttgtcctggtggggaaacctcaacattgcatgcagctgctgcctaattacagaagtggcttgaactcctgcagccaatcttttttgcctatccacaccatccttgcagtgtgccttcatgaggacagcagtttagagggcaccctgctttccagccccctggaaagtggcgcctacttctgcctgaagattattgtttggattcaacctataggaaaaataaaacacccacaaggactgatgttaggaaactcattaccacatcagagagaattttagatcagtcactatgtgggaagaataaattgattactggtttggggcctggtcttggaacctttggtgacagataagaagccaaggccgggcacggtggctcacgcctgtaatcccagcactttgggaggccgaggtgggcggatcacaaggtcaggagatcgagaccatcctggctaacacagtgaaaccccacctctactaaaaatacaaaaaattagccgggcgtggtggcaggcgcctgtagtcccagttactcgggaggctgaggcaggagaaggcatgaacccgggaggcggagcttgcagcgagccaagattgtgccactgcacgccagcctgggcaacagagcgagactccatctcaaaacaaaacaaaacaaaacaaaacaaaacagaagaaccaactggcttttctaaggccatgatttggcatgaaccccatgactcggggagcactggtccaacttcaggactggacctctgggaggagggtagaggggatctcttccacagcagggaaggaatctgtctgccctcagaccccaagttgacctaatctctagataggaccagggctgagcccagtacagctcttttgatgggctcacctctttgcacgtagatgtcggcttgtgttgtgtctgggactctgacaggtactatataaatggaatcaactctacaactctgcaggtggctcctgctgatgtttcaggtgtagggaagccctactttcttagtattttcagtactcttccgttggctcatttttctactacgggatgagaaagtagtgctttttacttatcaaacaaactctctcatagggctttgtaagaattcaatactgtaatttaattatgttacattcagctcattataatttattgcattcagtaaattgcatttatcaaacaccagccctttgctgcatgctgtctaggacactttttgtttatttcattttacctttacaaccacctgcaagttataggtattatctctgttttttttaggtgaggaaactgaggctcagaaagtttctgacttgcgcacattctcttgtgtagtaattgtggcatcaggatttggagtccatgctgttgaccccagtgtacatgttcatatgcaattccatgggcccccaagaaagagaaagaatcctggagctaactggtggccaccttcagtctttaggacatcttactaagcctgtctcccatctacaaaatgaagactccggagttgtgcttctccaggtctcaggaacactgacaatggggattagcaagcttttttccacactgcccccccccccaccataattaaagtacttaggaatttcctttgggaagacaatgtttgaatgaataacagaacagaattctgcctgtgaaggggtgtgaggtcttctagggtacgccgtaagtgaggttctgttggaatgattaaatggcagagggcagagtaaattaccagctgggatcctgttgataacaagcttgcaggaaactcactgaagtcaacgtgtaaacacagagatgtgggcagagatatgccggtagtaccgtcgggaccaggcccaggaagtctgtcttttctccctttgccctttcagggatgtgccctggggaaagataaaattaattaattaatttatttatttattttgagatggagtctctctctcttctccaggctggagtgcagtggtgcgatctcgggtcactgcaacctcctcctcccgggtttaagcaattctcctgcctcagcctcccgaatagctgggattacaggcacctgccaccacacccagctaattttttgtatttttagtagagatggggttttgccatgttggccaggctggtctcaaactcctgatctcaggtgatccgggagaaagataaaacttaaatcctactgtctgttttcaagtgacaacaaacttttattatgtttcagaatttggaaaacttaggtctgcaaataagaagtttgtcataacatctaagcataaacactcacctttattgtttaatagagcatctgagaatattgatgaaaaattattccacttcttactttgcagcagccaaagcttctaccccaaacagaatgtcccctgctctgggtgagtttatagcttcttcttttctgttttgtataaattccaacttgtcagggatgctttctctctgaactttcaaattaattgtttccctccttatcaggtaggtttgatctgaggtgattatgaacagattagattctcccaaaagtttaaaaaacaaacaaaaaattactttgcaacaaaaaccaggtttccattcatggttttctgaatctacaaaaattactttggtacaggctgatcatttaggatatttaaaattgaatttgaagctttaaactactatttctttattcatccattcattcactcagcatacctgtctcctgctttgtgactgttatcctccttgtcctggtaagttcctacctcctggtgagttctgctgcgtaaagtaggggctgactgcttcagctggaccaaaaacagacctctgtttccttttttctttttctatttataattttctgctttgtaggaagactacaagaaatggtatatatgactagatgctgcttttccacaataataggggatctttgaaatcctaggaaactgtcttgttttctaaattgtgtcttttaaacactttacctgcaagtcttgtcttcctaagtgtagtattagcaaataacagtggatatgtttttttctctctctctctctgtgtatctgtgtatcttcagagctttcgaattttaaaatagttttattaaggtataatttatatatcataaaatttatccattataactatgcagtttggtgatttttaaagtaatttcacacagtgtgcaaccatcatcagaatccagtttgagaacgttttcattactccaaaaagtttcctaatgccatttagtgatcagtccccactaccacccctagctccaggcaaccattggtcccctttctgcctccataaatttgccttttctagacattacatataaatagaatcagatagtatatggttttttgtttctggctactttcattgcgcataatgtttttgaggttcatccacgaagtatatgttaatatcagttccagagggatttaaaacaaataaaaacaaaactttgaattgtggcaaatttcacaattagactagtgtaagtcacccacaagtacctcactcccagattcagtaattatgaagccatggtcagtcttactccctcttccacccacttttcctacttctttgggttattttgaagctagtgttattactttataaatattttaatatatgcatttgtacttatctcattcttttctatagctaaggagcaaaatactttgagaacatgtggctacctaggtaagggggaaggtaagagaactaaacattaaattaaaatataaaattcttgctatgtttaaggcactacctatgacaatctgggatataatgatgtataaatcttatatatctgctaggtctgtaatatataattatagtacttaattcaaacatcagtctgtgcagataatagatttccctttatatatatatatttttttttaccttgtttacattttgcttttattctaaatgccaagttttgttttgttttaagggtagagagagatgtgttatagagaatgatgtgaagtgttctcttgaaacctgctatgcagagaagtgaacacggataatttcaaatttgctaatctgaaattgtgaccaaggtgagaatacaatccggtcattgtttctgttgatttgggagcccagtttgctatggattagatggattctttgaattagaataagcaaggagaaataagctcctgaatagctttgtggaccattcattaatgttttcataattattgagtatgagatatgtgccagcttctttgcagaatgtgagcacaattggatgaagattcctgaggtagatgcttgaggttggctttctcagggcccattcccaaccactctctcacttgccttcctctactgttgagactggaaatctcaatgttcaattttcctaaccaccttccagccaggagtggttatgtgatatagtttggccaagcacaagtctgtagggaaaggtctcccttcctgaataaaaagacatatctaaggtagaaaaagactttgccttcttcctgtctggacctggatgtaacacccggatgtagagcagcctttttgaaaacatgaggtgacataaggataaaagccatcacattaaggctggcaaaatttagaaataaaaggagcctaagtttctgagggtaatggtaaactgtcaccaactgtagactgccttctccaggacttattcatatgggcgaaaaagaagcctctattttgtgaggcctggtgagcctgcttttttgttacttgcagctgattacatgcttcattgatacttatgtgtttgtcacctttttgccacctcagagcactgtcacgcctgatgccattctggtctagtcatctagtcatggacttgaggaattttagggataggaagtcctagacattatctagtttaacgtttctcaaccagtgggttggggtcgcagtgctggggggagggtgctactgttatttagcacctgcaggccaggggtgccaatagcttgtattgtgtgagacagtgccgtaccacaaatgttcctgttcacaataccagttcataatgcatggtaagaaacgttagtctgcttccgtgatttagtcctacacagagcaagccacccagggctcttgagacactgctgtactgacttggacaacctaaacaccctcacggtcccctttccctgctgctcctcagtttagcctgtcttccctttcaactctgttatgatgcccactttgattcctcaagacttcagcatcaaaacagcattccaaacagaagacaaatgcactgcaaaccaaagagtaatggagacaaaaagcatgaaatgcccactgaaatccctaaagcctctataaaatcgtactctgaaaagcctccgaggcatctgggcttataatttgttcactgtctctccagattccatcacaccccagttttatgaggcctgggcttggggtgatgtgaatggtcacctttcccacctctggtggctcttttatcttgctccagttgatgaccttgatgcttctagaggaaggaagcagaggcttctgtcactgagacagcttctggtcacttgagcaacacaggggctaagttctagagctcccagccctgcctcccaggagagagccacagatcactcactctcctttttttcttcccctttacttggaggtggaattccaagcagagaagccagaggctgcctgtgctgtgatattgaagatagaaatactaccctgaagttcctggcatgaaaaatatcacagtacaggcagcctctggaaatggaatgaatataccatggttagaaaaatgcatcaggctgcaaaattttcaccaggcagtcctactattaataatgtcatatgatatattttttaataaagcaatacattaaaaaacgaatagtaactggaattgaaaaagtcctggctgtatcaccagatgtgtcttcttcagtaagccattgaatttctgagagttctcagaaatcgtgtaatgggggaagagcctaacgccctcctcccaggtccctaatctcccaggagattaaaggggctgtgggatgggaaagcactttggaaattgtaaatagctacaacaaagttaattgctattctcattagagctatgaggcttttagtggctttaggcattaataatagatgagctagcatccaggactgtgggccgtagttttaagtttctgttgattcttgttgtattttgatttattaggtccaacttaatctatttcaggccaaggcaatgggttgtgagctgagtaaataataaagataatgtgatgcacttaacacagtcagaagaggactgtccccaattagtcttttttttttttttttttttctagcacagaaaaaagcacagctcttactgtatctgaaagacactttggtaggaatgctcatcaagacggggcttgcacctgaggccatttcttaggagtagcttttgcctgcatcataatttcagaacatgtgatacttgggatgcttttcgtcattgaggtttacttgtctttatatggaacataatttgtacctgcaaaatcaagacttaacgattaattgttttcccttatggaagcctaaggcttgtttctacgtatttccagggttttgttctttaaggaacacatgcttatgaaaaaacacaaatactttcagcaaaaagtcttctgtgtctcccttcctcaagttgagcttggagtcagtggagctctgatctgcatttgcatttgagagggatgccttcttggcaaatacagcatgccagatatgtcagtattgggttgcttggaactccttaagcttacttaaacattctttagaaacacattcctttgaagagctcagcagagctcccagccacgagaatgctaggcttattcacagcgtggcttttactctctgtaactaatccacagcacatctctctggaaggaagcaaaatttagcaagttgcctgttgattgtgtaccatacagtatttttgcattaaagaaaactacttatttcagatacctggggaggggctttatggataacatccatgtggagatgcttgaaaatactgtttgttacaccaaagtgaatgggtgttttgtgcttgtgtgatgcagtaactatgattcttatttcatttatttctcatttagaaggtgtcgtggtgctaagtctctgatacaaggagttatcttaaaaaaaaaaaggcagtgacttgaactgagtggtaggaataataatatgtcccatctcatcacctccccacaggatttatgtgttcttttaatgggtctggtttgtggatcgtttcaccttcattggtttccagctgaaagtgctggtgggcagctgctgcagatgattaacactttcacctagcctcccatattcttattgttaacattaaattacacttgccttaaatctctttttattcagtttcttcattggttgttagatgtttgtaacttttttcccccaaggtccaccatgtttcttcatagcaaccatggtaattattaggatagtaggcatatctggggtttacactgcctgtttatttgaaaaatattttttcagtttcaggtatatagttatttcaaataatgtaacattgccatacttaacgtaactataataaaaataacttaaccataattatctcatgcagaataatcatttgaacattccaaaggtgatataaagagaaatagactgggcatggtgtctcatgcttgtaatcctagcactttgggaggctgaagcaggtggatcgcttgagcccaggagttcgagaccagcctgggcaaggtggcgaaaccatggcgaacctttatttaaaaaacatggcaaagcgttattatttaaaaaaaaaaggataaagggaaataggtccaaatccctatctactaaaagcttacagcctagtcttatttattttttagaagagtctgggccaatgaatactttttaaaaagttggcttttaaagcatatgcagatttgatccttgctttccttacctgacgggaccctttttgagcttttggctattgtcaagaaaatatagcaattaaatcccattatgataatagctatggaaatgtagtacttacagtggcaggtactattctaagtgttatttatgttaattgatttaaatttaaaaatacagagatcttcacttagggtatgacaagataaattttattccaccaaggggactggggtgtggaggtgggggttggctggttctaacaggatttcccccatcctttgctgcagctgcttctatttctatataactctgggctgtaacccctccaccacaccctctgcaccctccctatagtgctgccccttccaatgtctctttcatcctgcaggcagcagggttcttggcttggactcacacagttctttcagccagaaccagaggtaatctgcagaagctataatatctcactgaggttagtaattggaaaaaactactgaactctcaggctgtgatgagctttttgcattaggctagtgggtgggtctgatgctttttggctgctggggtgatcaaggaaggattgaaagagaaagacgagagtcctcagaaatggggtcccactgcttctaaggttgtgcacattaggaagtcgtgattaggccagtgcctaatgttacctctcttgggcagagaggacagaaagccattagaggacagaaggccattggttcgggtgtttattttatgcctgctgcatctcataaagcccctgggctgtagaaggagagtttaggttgctctggacagagtatgggcttctgagtcagagggaacttgagtttggccccttgtactgcttactatgtgtgtagacgtgggcaagttacctaatcccctacattcttcatcttgtcatcaaattcaataaatattaagtgcctgctatatgtggctgatataggcttgaacaaaacaagttctattctcaaggagccagagagggtgacaaatggtaaacaaaataaattaatacattatatagatggcaataagtgctaagactgcagttttaaatagggtagtcagagaaggcatcactgattaggtaacatttgtacaaacacttgtaggccctaagggagaagcctgtttcactagctggtgataagagcattccttgtagagggaccatagtgcaaggccttgaggcaggggtgtgcctggtgtgttggtagaggagcaaggaggctggtgtggccagagcagaatgagccaagggagcaggaggtgatgtaatcagagaggtaagtggggagcagacgctggaggactttggagaccattgtccagacctgggcgcttattctgggtaaaatgagaagccacagtggtagtgagggagagggtgtttgagtagaaaagtgacaaggtctgacctgaggtttaaaggatcaccttggcagttgtattgagatagtgtggggggcggggggtgggggggaaggaagaacggaaacagaaagaccaggcacggggctgttcagcatccacgtgagaggtgatggaggcctgcatcaagatgggagtggtaaacgagggagaatgatcgtatccatttaataataaccagctgatgggatgctgtgaggttaaatgggatgcgtagggaacgtgggtttgtaggttctccatagagggtagctgctgctcttattattgagactcttgttgtaggacagtctctctctcgctctcgctcgcgctctcgctcttttagacagggtctcgctcggttgcccaggctggagtgcagtggcacgatcatagcttattgcacccttgaactcctgggctcaagagatcctctgcctcaacttcttgagtagctgggataaagacatgtgctacccgcctggttaaattaaaaaaaaaaaaattatagcgatgtggccttgctatattgaccaggctggtctcaaactcctggactcaagcaatcctcctttcttggcctcccaaagtactaggattataagtgtgagctactctgcctggctgaaggacggtcttgaagtaaaggaaacaaattgggaatttgcccatccagtctgcagcagtagtgtggggaatagaacttagacgtgctggctttaaagcaaatagagggcttcttgcctttccctttaatgaaaaatctaaatcactgtgcacccacagcctggaaatgctcaattaaatcgcatgcacgtcacagaactcctgacatcacagcttctttttttggccccaccttataccgtgtgagctttaactgtaagtagcgagcttggtttccatgagtcacatgtgtccacaggtaagttgtgtggctgattggcccattatgtcaatttcagattagcttttatggttttagtttccctgtgtgtcctccccttgccctttcttctctgcaggcagagttggtctaatcctgaccatcctggggctatgctggttctccatttccttacccggcatctgtatttctgccttctccaggggctgtcctcccgtatgcaccatctgtgcaatttcagcacttgctacccatcctgaagtgcttagagattgagtagttggaaaataaacagtggagggatcattgtattttcattttttagtgttcttaaaagatacaggatttctgttgtgaataagtaagggatcagcataggaaacagcaactcctctaggcattttaagcagaaggagacagaattgagtgctcacagaatcactggcagggctgggccctcagagcaactcccagaagagtgaagatctggtcctctggcagggctgccaattacaggacattaactggacctgtaggttcaagaatccactctttactgggttccaaagttcaggaagcctgaacggagaagggtctgccactacagtgcctcctggcactcaagagagtggccctagagtgtggttacagaaaacccacccattttgtgcagccattatggaaagccatatggaggttcctcagaaaattcaaaatagaactgcattgtgatccagcaatcccacctctgggtatatatccaaaggaaatgaaatcactgtcataaagagacatcagcaccccacgtttgttgcagcattacttaaaatagccaagatgtggaaataacctgtgtccactgaataaaggaaatgaaccccagtagtatattcatccttaataaaggagagcctgccatttgcgaaaacatgcgtgaacctgcaagatgttatactaaatgaaataagccaaacacatgacactactgtgtgattccacttatatgtggaatcttaaaaagtcaaactcatagaaatagagtaggaaggtagttgcgggggctgggggagggcggtggaagcaatgggaacatgttagtcaaagggtataaactttcagttataagatgaataagttctggagatccaatgtgcagcatggtgactatagttagtgtattatgcttgaaaattgcaaggagagtagatcttaagtattctcaccacatacaaaagtaactgaggtgatggatgtgttaattaacccgattgtggtactcatttaggaatgtatgcatatatcaaaacatgtttaccttaaatttatacaattttatttatttttattttttgagatggagtttctgtcacccaggctggggtgcagtggcgcaatctcagctcactgcaacctccacctcccgggttcaagctattcttctgcttcagcctctcgagtagctgggattacaggcgtgtgttaccgtgccaggctaatttttgtatttttagtagagacggggtttcaccatgttggccgggctgctcttgaactcctgacgtcaagcgatccgccctccttggcctcccaaagtgctgagattacaggcgtaagccaccacccccagcctaaatttatacaatttaaatttgtcagttatacctcaacgaagctggacaaaacaaaacaaaaacccacttcccattccacagtttgcttgccagccaaaagctgcccagagaaggcctctgcttcacttcctccctaattttgcacaggtgactttagttggttcgcatcccgatctctagctgcaaggtgtggagcctgaaaaatgtagtgtttaaccttctgtcctctccaactaggaggcagttgaggtgagattaaacaagccaatccctagtctgcctcacctcatgcttgtctgtggtgaatactgcaggggcctcttcttccatgtgttggcattggccagtgttgaggattccatatgcaatataaataagactctatgctaaacactgaatccaactgtcaatattttccaagcttatctctagtacaatactgtgtgctttgtaacagggtaacttttattatcaattaacattgtgatgaccacctctgatatctgtaaaataaacaaagtaggctccaatcactgacaggcagattttggtttgtttatatttgaagaaaataatgggtctgtatttctgttaaacacataattttttttatggttcatatcattacataaaaagactgggctagttgcattatttatgtaaaaatatattctcagtatttgatatgaacagcaattttagcatactcttcactataaaaatatgcaggagtggatgttaagtataggtaaatagcaaggaaagcacaaaccagcatcagcactggtcttaccagtctgatttctctggagtgcagaattacccatttgttgcagctctatgttgagcaatgttctgtaaaagttaatcaagtgtctttaatcattagctgataaagcagcagggaattaagctagcctaattagtttgggaactaaatcagacagaacaaacagagcacggggtaggacaaatggatgtttggtggcctcattggaagaaataggttacctttgatattatggtaattccttgtcattcatgggattcctgagaagtgcccttgctgataaaaactgaaattggcagatcagtgtctatttcaaaattgggagttgggataaaataaagtagcacatacacatctaatcctactttatatatacacatgtatactataaaatatatatagtaaatgctccaaagatagctgcttccaaaacagactatattccttggtaattctttcaaatcattttattttattgttcaggaaactttcctgtagctgtgtcctagaatgatccagctgccagttttatattatgcagcctacacttttccccccaagtttgattatgaaaatgttcatacatacagcaaagctgacttttacagtgaacacctgtatacctaccacctgcataaattctatattttattaagcttgctttatcacctagataccacctgtattcattatttattgctgtataacaaattaccccaaacttagtactttatttaaaacaataaacatttagtattccgtactgtttttgtgcgccaggaatccaggagtggctgggtggttctggctcaaggtcccttgtgaggttgcagtctaagacattggctagggctgcagtcttctgtgctttgattgagcctggacaatctgcctccaggaggtctcacccacatggctgttggcttgaaccttaaaggatagctctggtcaggtacaaatgggtgttgacagtaagtgacctagaagtgatgagagttggggaaatcagggaattcccaggaggtggaacttgccatagcatcccagccagggcacaggtgcagaaagagaaagtcatatgaagtgtaaagcagaatgagagcatggctcagagatacgtgtggggggcaaaaaggatttccagcagaaaagatagattacattgggggaggtggctttaatggctcctaaagggagggtgcctcagctactgagattgaaattgtcggacacggtcatcaacattagaaaaacagcagcactgagatttattttcctggttacctatattttattcacatatttaagtgttaaactgaggttgaaatgttgtgaatggtccccacttcttaaagctttgctctactgggagatttttaagaaaatctcacggcacatcttcctaatttttaaatttgtattcctgttcctgaccccagaataggcccaactagacaacagatctgtgggaatgtttggctctccatgaaccacaaagactcctccaacacagaggtgcagtacccacctgggccaaggagggaagatgcaggtgaggagggtgcttccaaaaggtgtgtggagctgtttgttgagggccatgaagctcttgcacagggatgggaggaggcaactaaccagggctctgggtggaggccagctgccctccctctgggcgactgtgcaccctcccactctccctgggaggcgggcgcttcctttgaagtgcaccagtgacctgcctctctcctggctgcttcctgatgtcttgctggcagcaagtgggctagggtcggcttgcccagaggggcgcatccaggtggggttcacctttctgaaccaggtagggaatgtcttggtgctcccttgatttgaaggggaggaccatcctttattggcaaagaacagagagcaaacaatgaaaagaccacactgggccaagtcagtgacccatgaataaggaattccaagcttttagtgcgggagagccttggaaatcatctcatacagccccttcacttaaagataagaaagaaacatgaagccaagggactggacaactagtttaagggtgggctaagtaagacgtggaagtcctggttttctgttactgagggctgcagtttattttatgcctactttgtatgtattggattctgtagaatgacagttcacacagtgccaattcattatattacaaagataaaacattgcctttatttttttctcaaaataataaaggttatatggtacttgcggcattagcacttgccaggtactgttctcccttcctgacagatagaaatcgtcatttaatcttctaacagacctatgaggtgaataccattactttccccactttatgggtgaggaaactgaggcccaaagaggtcaagttaacttctcccaagtaatgtggtgatgtctagatagtgagtgacagcattgggatttaagccaagtatgctgacttcacaatccatgttcttaaccacactataccttaatcgccagtgcaaacattagcgctgtttactggcttttcaaagctttctgttttccaggcatgtgatgggcttgcgtttcctggcctccttgtgtttttggagccatgtgactacttctagccatgttgagagaagcatgctatatcacttttgggctaagtcactctgtcaccagtgtgtgaccctccagatctctcttgccctctgctgtggagactggcaaagctccagatggtggttgctctgtcagtctgggcaagttggagaggaaacagcctcagccagccctaagtgggtgtagcataaatgcaaaatcaacttatgttatttagccactgagatttgaggcttgtttgttactacagcataatttagcctatcttgagtcacataataatctctgatgtgcctaacgttttaaggggcacattagcaaataggttggccacttaaaagtctttccaaatagttttttttttttttagcctcattgggaagcattcatgttattctttatatacagaaagcacctggtactgtggcaatagcatagagcagagcttgagatggaaagttctgttttttggtccttattatttttgctaattcaacagctttattgatatctagttcacataccataaaatttacttaaagtgtataattctgtgggttttggtatattcatagagttgtgcaacaatcatctcaattaattttagaagactttcatcacctccagaagaaacctgtacttattagcagtgactcctatttccccccaatctccccggccctagtctacaagtgatacaatttctgtctctgtatttgccttttctggacattttatataaatacaatcatataaaatgtaagttctgtgaaggatcttggctttgctctatgctgtaactctgtacccctcacagtacctgtacatagtaggtgctcagtgtatatctgttgggtaagtgagtggttactgaaggtcggagtggagagccggatggtgatggctggtgttgcttagcattgccctggacagggaataaagggagcggtagaatcacctgctgacaacatctcctcttcatccagagacttctgtgtcagggcttattataaggatgtgatcataggcccagtgaaagcagctacccttgacatggggtaagtcatctataaaacaccgcattgcaaggctgaggtcatgaaggggtacgagtgggcccaccacagcccgattcctcttcctccgtagactcttcccaaatacacacttttctcaggacctcactggattccttctcctctcaggttcctggcttcccttccctggctacctggccagggctatggcttgtagccatttctcagaggcacacactgaggcattgggagattcctgctcctgctctgagtagtgctgcagccattcctggcttgctggtctggattttctacccctacctgcagacccaagtctgggtaccctgtttgccttaagtactcatcttgcattatttaagactacaaggaggcaagagtagttagtggttaaaggcatagtctgtggggtcaggcactctgaagcttgagggccagatctgccatttattagctgtgaatctccaggtgagttactaaacctttttgagcctttgtttctaatctgtagaatgggcatatgaatagtaatatgaataaatttgtaagagttacatagaataatgcatagaaagtgcttagtgcaatgcctggcccaggaaaatgtttgctatggcttttgatacaatctaatttggtcctgatattgttgatgtcactattccctagggaacaaaagaactacatttttttgtttgttttaggattaccttatgatttgcaaaatgattttgtggcaaataactgaattccctgtgcttgtcatcttctgaaagggaagtcaaaggaagtgaatagagaaatgtggccacagcagagaccaaagaacctgactgtttttttaatttttaaaaacattaaaaaaattttttttttgtagagacaaggtctcactctgttgcccaggctggtctcgaactcctgggcttaggtgatcctcccaccccggcctctcaaagtgctgggattacaggcctaagcctgacagtttggtcttaggtatgctcctgattgtggggttaccttgactgttctttgagtcctggagaagtcaacatgaaagcagttacaaggtcatatgataagcctgtatgggccatgtagatagacttccatgcatagatggtatagaaaagtaaaaattatcttctgctttgatcgttgttactcccaacataaacttacagcaacagtcttaaacgccagtcaatgctatatttgtaaaacatccagtagagaggttgggtctcctgatgaacaaaggaaagtttgcagtgttaagtgtcatacagatttgtcattgcactctattctctccactcccacatgaactaccatggggcaaatctaagccacctcttggttttggtctcagaacaatgagtgtctgtttctaagttagggggcggagtgcagtcatgggttttggggatcccatactgtcactggcagccagctgtgcagcctggagtgtggggctgtggccagggtgggcacaaggagcagcatctgtgtttgtctgttggggtaaacctggactttggctggaggagatattttcagtgctttaccagtattagtgaagcatggaattggattccctggaagtgtcagaaatgccaataagcttagcaaatggctgtgcagcatgttgcacataaatatcaattttaatcagatactgattgggatagatttcatagctaatctagaagaagtaataatctttgttgtctgtcttagaagagtgaatggtttccactcagaaaattcagatctggaagctcatagttcatagctgtttttttcttttctatttctttttcctttttttctttctttttctctcttttttttaagagataatgtcttgctctgttgcccaggctggagtgcagcggtgggatcattgctcactgcagccttgaattcctgggctcaagggatcctcctgcctccgcttcctgagtagctgggactataggcatgtgcaaccatgcctggctaaatttgaaaaagtatttttagagacagagactcactatgttgcccaggctggtctcaaactcctcagtttcctgagtagctgggattacaggcatgaaccactgtgcatggctgtcatggctgttttttcttttaactttcaattaaaatatataccaaatgaaaagtgcacaaaccgtaaaaatacagattgatgaattttcacaaagggaatgccatcacgtaactaccacccaaatcaggaaattgaatactgccaaatttccagtatcccccctcccaatccttaacctgctttcccctccaaatcactctcttgacttataatgcaatcgatgacttttgcctgttctgaattctatataaggagaatcatatggcatatcctttttgtatctgacctcttttgcttagcaggatatttgcaagatttatccacatggttataaatagtaatagtttattgatttacattcttatgtagtatgaacatatatcacagtttatcccttctgctatttatgtacattttggttgttttacagttttaaaaaattatctgtattttaaatttcattttcaactttgctgttaaattaccaaacaataaactacttaagaacataacctaaatattttggttaactacattctggaacagaaaggcattaatgttagtcttaggtggcagtgagcttcacagagacacacaaagagagagcaaagtgaagaacaaggcaatctctccctatttatggcatggcaaagcaattcagaatgcgttcactatttctatagataaattttttaatgtataatgtgggaaaatttaatgttccaatttatgaaaacaagaattatcagactgtcacattccaatgacttaagtagctaaaccttacatcaagcttgtctcacccgtggccagtgggctgccatatggcccaggatggcttttcatgtggcccaacacaaagtcgtaagctttcttaaaacattatgaagggccgggtgcggtagatcatgcctgtaatccctgcactttgggaagccgaggtgggcagatcacatgaagtcgggagttaaaaactaccctggccaacatggtgaaacccatctgtactaaaaatacaaaaaattagccgggcattgtggcatgtacccgtaatccgagctacttgggaggctgaggcaggagaatcgcttgaacctggggggcggaggttgcagtgagctgagattgtgccactgcactccagtttgggttacagagcaagactccatctcaaaaaaaaaaatttttttggagtttttgttttgttttgttttgttttaagctcatcagctattgttagtgttagtgtattttatatgtggcccaagacaattctactttttccaatgtggcccagtgaagccaaaagattggacacccctgccgtaaatggaattaaaatgttgggcataagatatcctcaaaagactgtcataatatattttgtggaaatagttcacttcatttctatgattagatggattaccaataatttatagtttattatgagtaatgctgcagtgaacattccccatatgtcctttggtgtacatgtttgtatttctgttgattatatacctagaattggaattgtttgggcatgggatatatagatgtttggcactaccaaacagttttctaaagcagttataccagtttacatcctcaggcacaggtgttaaaagagttagcattgctccagatctgtgtcaaccatggtgtttccagtcttttaaaattttagtccttcttgtctgggcgtagtagttttacttcctatttccttgatgacttttgaagttgagcacctttccatatgcttattggctgtctggataacctgtttggtgaaattaccttttcaaactctggagcattttcctattagattatctttttcttattgattttgaagacattctttatgtcttctggacatcagaccttaattggatacatgaactataaatctcctgtcactgtggtttttctttcatttgaattgattctgagctgggcatcagtctttatgaagctagtgtctttccagtatgtccttatttctaggatgattagcccttttcagggtgtccaactgaagtctggagtgtttatttactcagtttttctacctttgtgttccctaaacttcacagctgcttgcaaatcagcaaatgccacaaaggaaaacatgtcctcaaacatttggcttacctctttgcaccaccctttccttcatgatcttgaatacttaggttcttgcaaggacttgggtctttggtcttcacacagatttttttgtttgttcaatgttttgttgagcttttctggttgttactggtggtaggattggtatggtcggcaggtaaaatgtctgccctgccaaagacatactcatttcctaaccttcagaacctgtgcatattaccttaaatgataaatgagtgatattaccttatgtggccccccaaaatgttattaaggatcttgagagaaggtgcctctcctggattatatggacaggatcttgagagaaggtgcttctcctggattatctgggtaggatcttgggagaaggtgcttctcctggattatctggataggatcttgagagaaggtgcctctcctggattactagggtaggatctggagagaaggtgcctctcctggattatctgggtggaccctaagtgcaatcacatatatccttataagaaagacagagggaaattagacagagacgcacgaagagaaggtgaagtgaaaaccaaggcagagattagagtgttgtggcctgaaccaaggaccatctgcagccacaagaagctaaaagggacaaggaacaattttcccctagagcctctgaagggagtacagcactgccaacaactggacttcagacttttggcctccaaaactgtgagtgtgatggttaattttgtgtgtcagtttgactgggccatgggatacccagatacctggttaaacattattcctgggtgtgtctgtgagggtgtttctggaagagatgagcctgtgactggatagactgagtagagcagatggccctccccagtgtggatggggatcattcaacccctcagggccagtcctgatggaacaaaaaggcagaagaaggttgacttctccctgcctgagtccatgagctgagacatcaatcttctgcccttcaactaagacttacaaccatcagggatcctggttctcaggcttttagactgagactcaaatttacaccactggttttcctgggtttccagcttacaggggtcagattgtgtgacttagcttccaaaattgtgggagccaattccattctagattttttttaagacacagcctctgttgcccaggctggagtgcagtggtgtgatctcagctcactgcaacctccacctcctgggttcaagcgattctcctgcttcaacctcctgcaagtatctgggtttacaggcacgtgccaccactcccagctaatatttgtatttttagtagagacggggttttgccgtgttggccaggctggtctcaaactcctggcctcaagtgatcaacccatcttggcctcccaaaatgctgggattacaggtgtgagccactgtgcctggcctcattctagattttcaatatccatatctatctgtatatctcctatttgttctgtttctctggaggaccccaataacagtgagaataaatttgtttttggtttgttttttggagacagagctttactgtgttgcccagactggagtgcagtggcacaatcatagcttactgcagctttgatatccctggctcaagtgatcttccccacttagcctcctgagtagctgagactataggtgcataccaccaaaacgagatgatttttctgatttttagtatagatggggtctcactatgttgcccatgctggtctcgaattcctgggctcaagttaccctcctgccttgacctctcaaagtgcttgtgttacaggcgtaagccaccacgcctggccagattgctgttttaagccaccatgtttgtgtaatttgttacagcagccacaggaaacctatacagttggtctgacataaattaatttatctgtaacatttaaaaattaatagtagtttaataattttattgcattgtttctagattttaattgctatttcagaataaattggtggaatgcagttctttctttatagagggatagtgtgtaatttttaatacattgtgaaaaggcacataatagaataaactttggcctcttttattggaataatagactcaagaaactcatttgatgtttttctggtaggttgaaagttgtgcccattattagttttccttgttgtagtataatgtcgaaagaagttgttgagatacttgttaaaaacataagagtggggaaaaaatgtaatggaaccattatatatgaaaaaatttggacctatagtccacatagattgtttaatcaacatgatcattattataatttataggaaaaacttgatagttatgtttattctgaccacctgtaacccgtcagtggggatactttttaaaagagaaaactgtcttgtccttatgacagttaattgctaaacagagtagatgcacagaaacccagctcttgttttcctaagggggggactatgatatgtaatgggatgggagtagccactgtcacatcagcaggtcatgggatcttaccagtcatagcccctgtggcagttgcttgacttttttggatatacacttctctgcaagcccttgagagcaaagtcaatgtctttatgtattcatggattcattcaatagttattactcccttaccttgtagcaggtgctatgccaggtactgaagatactctaaacagcaaaaactgacatggttcctgttttcatggtgtctagtgggaaacagacaaccaaataatcataaaaataagtatcttatggccgggcgtggtggctcacgcctgtgatcctagcactttgggaggccgaggcgggtggatcacctgaggtccagagttcgtgaccagcctgaccaacatggagaaaccccgcctctactaaaaatacaaaattagctgggcgtggtggcgcatgcctgtaatcccagctgctgcggaggctgaggcaggagaatggcttgagcctgggagttagaggtggcggtgagccgagatcgcgccattgcactccaccctgggcaacaagagtaagactccgtctcaaaaaaaaaaaaaaataagtatcttatgacaaacacaggtaagtgatctgaatgaaaggaatgaacacgagtccatgggaacatggaacaacagagcttgacctaagctgggggattaggaaagcttccctgaggaagaaatgatgaactgatgagtaggctttgactggcaggagcagtggggagggattaagtatttcaggcagacagatcagctcacacagagtcatatgatgcaaaaaaaaaagcataacactgatgaggaattgaacaaaggccaaatgggaccaatgctcagaaagttaagagatgtgttgagagaggtggctccatgcagaatcttttcagtcaagccaggggcactgatctttatcctagagctatggagatctatattggtttgctagggctgccattacaaaatgccacagactggatggcttaaatgacaaacagaaatgtgttgtctcacactcccagaggctaaaattccaagatcagtgtgtctgctggtttggtttcttctgaggcctttcccctcagcttgcagatggccaccttcttcctgtgttctcatgtggctttatctctgtgcacttacatctctgatgtctcttctaaggataccagtcctgctggattagagcctcacctttatgacctcatttaaccttagttacctctttaaagaccctctctccaaggatagtcacattctaggtactgggggtttgggcttcagcgtatgaattttggagggagacacaattcagtctattaacagaagctattaaagatttttaagcaagggagatactggctgtaatttacagattgagaatatcatcctggtcatactgcagagaaaagatcagaagaagccaaagttgattcaggatggttagttgggaatctactgcagaagcccagctaagacacaataccagttggattttggcctggtagtatagatggatgggagagagatttaggaagcaaaaccaacacaatgcagtggtggattgaagcattctatagaaagaatgggagaaaggagatttcaagatcgattccaagttttttgacttgcacagttgcaataacgaacactggagaagactaggttggagacagatgagtttggtcttagatctgagtcttagagttgaggtgctgctttgaagacatccatgtggaaataagtaggcagttggctatttgaatcaggagtttggaggagagatttgaaatatggatatgaatttgaaaggcttgggcctacagatagtaatagcagctagtatacctcttggcatattttaaattcttgataaatgtcttttgaattaaaactgtggtctacactgtttctttacatgaaccagagcagagtttaaagatagttcataatcatctctttagaaatgctatctgttaaagaaaatagtagaatgcatctccaactaaacaaattattcttcggatcatagcatagtgtgtaggtaattttctactaagaattttggaaagaggttggcaaatgaactcaagttatgagactcgatggaaatttggtacctcttttcatttccttttcttttttgagataggatctcgctctgttgctcaggcttgagtgcagtggcacaatcacggctcacttgcagcctcaccctccaggctcgatcctcctacttcagcctcccacatacttgggactacaggcatgcaccaccatgcctggctaatgttttaatttttttaaagagatgggatctcaccatgttgcccagactgatcttgaactcctgggctcaagtcatcctcccaccttggcctcccaaagtgttggtattacaggcgtgaagcactgcactcagcagcctctttttcattttggcaaaagccctgcaacctacagctgtctagtcagttacatagcctcctatatcatcaggcagttacctccatggatgtctgaataggagtgtgctgcaaatgggtcagcatcacaacaaacagcagagactcaaaatatatgttagcaattaccacagctaaaccacagaggatgagaaagataggggcctatggtcttatcaaaatggtcttctttcagtagttcacatcactgtttcctggattattaatggctttggctgagccaggtgggatgtggtgttcagatggccagatgagctaagaagtatccctcggactttggatcctaggctgcagagtggaagaagtacacaaacccagcccttcttgtttcatgtgagcaatggtgcgtgttttaaaaagacagccaataatattagctttaattatgatagtagttgctgtttgttttgtcctagcacagaacagtaggaatgtaggtacaggaaaaaatggcacaataaacatttgtcttgggctgggcatggtggctcacacttgtaatcccagcatatgctcctatagtcctagctatctgggaggctgaggtgggaggatcatttgagcttgggaggccaaggctgcagtgatccatgactgtgctactgcattccagcctgggtgacagagcaagaccatgtctaaaaaagaaaaatagtctgtcctcccacattctcttattttaaaatggaattttaaaagaattgcaggaaataacatgttgagaaatagagattttatttaatgttgccctgttagtcacagcttcatttttaaataagtattaaaactcaatactgatttgagtatctaccatgtgtcaacctgaggcttctgtggtccttgccctcacagtgctcacagtccagcccaggagatgccccttaaccagtgattacaagtctgatcagagtaatgaaaagaatcctacaaggtgctgagtggatttacctggattagcaggtcagggaaggcctctctggggaggtgtcatctagactcagggttcagagatgagtgagaattaaagagatggaggagccagcaagctgacatgtcaggactcaggaatgtggcaagccccccaatgtgaggctggagtgaaggggccagctggcccccaaccatgttaagaattgtgaattttatcctaagggcaaccaatatgctggaaagtttttaagaatgggagcaacataatcagatttatgtttttaaaagagaactgtggcctcaatgagaagaagccacagaagatgcaacaagtccagttgtggtacttactaatccaggggagaggtgagaggtgacgttttagattagggcagagaataggggtctggactagactggtagcagtaggctggagagaattgtatgaatcagatctattttcctttgtaaaaatttttttccttattatataaataatattttttattatagaagaccttgagaaaatatgagttcaaatataagtctccaattccatctcccagggaatagcattatttatttatgacataatcctattagtctctcttctgtgcatttatatttattttaaaaacaaaacttgaatattgacaattgtaattgtatatacattattttataacctatactttgaataacacccttttaagcttccaatataaattatttggcctatgttgacagttgaaatgccttggcatcaacttgtggatctcccaaggaagaactccttgccagtgtatatacataaacctgaggcctgttttcagtgtgcgcattatggtcccatcatggatgagacttatcaggggggaattctctagctaattctgaatctagttaacttctggcctgcaagaatgtctacatgatatgttggcatccaagccatgggagaagggtccctggcagatgctttattgaaattctagtccacaacccctgctgtagggcaggcaactgttaggggctttttgaggctgttgctggggcttgtgagatgcttaaggagctcgactgcatctctgaatggtcagagtaaaagagtgtcatagaaagaactgccaaatacctttctgtagaatgagctgaaatagaagtgcttcctcaaaacctgctaaaggggagattaagaaatgaaatttgattgggggtgtcatcttgaaacagtgtgatgacccttcttgacaggccaaaaaagaaacaactactcttctaaattgggaattatgtgccagccctgtttcgtttgtctagttcactttgacagtgatttagttaagctttgctaaatccatgggagaggttttagcttcctgggtcagcagtttacacctgtggcttgggaagtttttctagggcagccccagaaaatttagggagtaacatctcttgattttagagaaatttcccatagaatttgtttcttttcttccagagtagatgaggaggaagagtctcatagccttgtgccctacccatttagatttgcactcttcctggtctcaggcatctgacaccaacagccagagcataaagagagaagggattaaatctagtgtcccgaagccctacctcaatcctcctgagacccagcctccagcatgtcaggtgcggggactggggattgctccaggtcacaggcattcctaggtgttgatgcagagatgatattctgtgccctgggtcagcctaggtgagatggagacagcagattccctcctgagagctggagcagcctcttcagtttgttttattctcacttaacaagtctgcaaaggtgttaatgtgtgccaaagtgtattgggttgtaggcctcagaaaagggtgtttaaggagctgtggcactatcaactctcaggtttgcgttagacaagattagcatcttcccttttttgttctgaaggctgtttgcttctctgcattggtaagtggctaccttcatgggaaaggccagggatggagggccagctcttagtgaatgaaaggagagaatttgccttcaaagactgtcatgcaaaagaactaaagataagatattgaagaaggctttttctgttattggtctagtttatagttggaggaccttctggttcttttattgggagcagtgaactttttctaagaatagctcagaggtactgacctgtggctagaagagggcagttctttatgtgtttatcctattgataactcgttcttctcctgcctagagaagagctttatttagtgcccttctggatccagaattcagtttttaccataagtccagtatttccttggttctatgccccaagtacccatagtgatgctgagaaacgtttgctatggtagaatctgtggcatacccaggctgccagcctcatacttctctgtgctcatttctttagtaggtggaacattcatttattcacagtcccttaggacactactgtgttaggtgctaagcctgcagaaatgtatatgttgaagtcactaccctcaaggagtttatagcatgaataaatcttttttgtcagcatttgtaatctagtatcaaagaataatcctaacagcaaattctctgcctccatctgataatgatgcagtccgtttggctaccaaacatgttcctataataaattgaactcatatgcaattggctaaaaggtgaatgatgtcagttcttatatggttttcaccctaggccaggagagccagactagcaggagtaggatgataacctttggcaggaaaggaaagggccatcagctcagcttttgcacccacaggagctctttctgctgttttgtttgtttttcctcttgataattttctttttattttttttcagtagctttttgggaacaggtggtgtttggttacatggataagttctttggtgatccctgaaattttgatgcacccgtcacccaagcagtatacactgtacccagtgtgtagtcctttatccctcacccccctcccaccttcccctgagtccccaaagtccactatattattcttatgtcttcgtgtccttagctcccacttacaagtgagaacatacgatatttgcttttccaatcctgagttactttgcttagaataatggtctcctacaccatccagactgctgagaatgccattatttcgtttcttactcagccataaaagggaacaaaataacgacattcgcagcaactgggctggagttgtattcagtattttatgtccaagtagtattcagccataaaaaggaatgaaataatgtggtgtatataccacattttttttagccacatgttgattgatgggcatttaggctggtttcatatttttgcagttgcgagttgtggggctataaacatgcatatgcaagtgtctttttcatataatgacttctttttctttgggtagatacccagtaatgggattgctggatcaaatagtagttcaacttttatttcttgaaggaatctccacactgttttccatagtggttgtactagtttactttccaccagtagtgtaaaagtgttccctattcacatccatgccaacatctattttttttttttaatttttaaattatggccattcttgcaggagtaaggtggtatctgattatggttttaatttgcatttccttgataattagtgatgttgaatctgctctgctttaagaaaattaggctgggtgtggtggttcatgcctgtaataccagcattttgggagctgaggctgatggatcacttgaggtcagtagttcaagaccaacctgcccaatatgatgaaaccctgtctctactaaaaacacaaaaattagctgggcctggtggcacacacctctagtccgagctactagggaggctgaggcaggagaatcacttgaacctgggaggaggaggttgcagtgagttgagattgtgctgttgcactccagcctgggcgacatagcaagatcctatctcaaaaaaaaaaaaaaaaagagtgcctgtgcccaggctccctccctaaagacctgcacccctggccttgagagctctcagatggcagcaagttgcactttctcctgcctgtttctcactgggaatccagcatttccacgctgttgtttttgtgcattttaaatatatcctgtggcatcctcttgctgctgttgtccaaaggaccaccaggatggctaatgagtagaaaggattattggcaatacatcagtaggcaaaccaggaagagatagcctctggcatggaccaaaggtgttctctttttgcatagggaaggggcaggttgggttttatgcctcactgggcctgtatcatagaatagagtcatacatattcagcaggtttaggggaaaagctatacatagttatgaggggagtcctgcacatgaacaatgagtaaacatgtaacatatatctcatgttcactttggggtgggattttaacattaaagcaaagtggaatttggctctctgtctaaaggtgaactataggccacaaaacacagtctttgtaagctggtcaaaactggcttgaggtctgcagttgcttatcaggaaagaatgtatgtaagtcccattctctgtccaattggagttgtagtggtctgggttgtaaatcagatttaggaagacaatttgtctgacagctcctatttttagggagtttggcaagagtgtggtttttcttgtagctgtaggaatttaggaattcggggctgtgcccgccaagccctgaaccctctaccctctgcccatgggtaacttttgtttccttaaccttagtgttcgtcttagtcgataaagggacatctattttagtctctcagatcacactgccatgagctgctggcttgtttgtgaggtaccaattatgtgtgtacacacactctggttgccaggggcttttaatgctccagagtggtctaatggtctaccccatccagtttccccataatctctggtgctgacatccagggagccacaaaagttgaacattcatgaaccaaagaggtggcagtttgagccttccattccctccttcagccttgctcctataccttttcatctatgaactctcaagaaagagtaacagcagctgtcagcccacagtagtcctgttggcaggctctaaaatgtgtcttctcaaattgcagccctggcctgagctggagagagtacctagtggaattctgcccatttcacagtggttcagatctgcaagaaacatatgccctgtttaccatttcctgatgggtatggggtgagggctcctaaactatggtattagtcagggttctccgagaaacagaatcaagaggacatacagacagaaatttattttaaggtagtggctcacacagttatggaaactgagaagtcccatgatctgccatctgtatgctggagacccaggaaaaccagtggtatagatctgaaggcctgaggggcagggagcctatggcgtaggctccaatccaagtctgaaggcctgaaaaccagaagagccaagggcaggagaaaattcccagctcaactgtcaggcagagacttcagccttcaagtgactctcccaccttggcctttttgttttattcaggccctcagcaggttggatgatgctcacctacattggggagggcaatctgctttattaagtccagcaattcaaatgctagtatcttccagaaacatccttgcacacatacccatacataatgtttaaccagatatctgggcatcccttaccccagttgagttcacacatgaaattaacaatcacaggcataggtatatgttggaaatagagcaggttcagtttcagaccacggcattaagcaaatattgcaatagaagtagtcacaggcatttttggtttcccagtgtatatgaaagttatgtttatattatactgtagtccagtaagtatgcaaaaggattatgtctaaaaggacagtgtatataccataatttaaaaatacttttagtcaggtgcagtgactcacgcctgtaatcccagcactttgggaggtgaggagggtggatcacctgatgacaggaattcgagaccagcctggccaacatggtgaaactctgtctctactaaaaatacaaaaaatagctgggcatgttgctgggtacctgtaatcccagctacttgggaggctgaggcaggagaatcacttgaacccgggaggcataggttgcaataagctgagatggctccactgtcctccagcctaggtaactgagcaagacagggagactccgtctcaaaaaaaaaaaaaaaaaaaaaaaaagaaaaagaaaagaaaaacaaacttttgctaaaaattctaatgatcatttaagccttcagtgaattgcaatctttttgctggtggaggtttctgctggtggaggatcttacctcagtgttgatgactgctgactaatcagggtggtggctgctaaaggttgggttgctatggcaattttgtttttttgttttgttttgttttttgacagagtcttgctctgtcactcaggcgggagtataatagcgcaatcacagctcactgtaacctcaaactcccaggctccagtgttcctcccacctcagcctccaaagtatctgggactgtaggcacacaccacaatgcctggctaattttttaaatgtttggtagtaacaaggtctcactatgttgcccaagctgatcttaaacttctgggctcaagcaatcctcctgccttggccccccaaagtgctgggattacaggcatgagccccatcgcacccagccacagtttcttaaagtcagacgatagtgagtttgccagattgattgactcttctttcacaaaagatttctctgtagcatgtgatgctgtttgatagcactttactcacagtagaacttctttcaaaattggagtcaatcttctcaaatcctattgctgccttgtcaaatacatttatgtactattctaaattttttgttgtcatttcaacagtgttcacagcatcttcaccaggagtagatttcatctcaagaaaccactttctttgctcatccgtaagaaggaactcctcattcattcaagttttatcatgagattatagcaattcagtcacatcttcaggctccacttctaattctagttctcttgctgtttccaccaaaaagtaagttatatcttccactgaagtcttgaacttctcaaagtaatccatgagggttagaatcaacttcttccaaactcttgttaatgttattttgacctcttcctgtgaatcacgaatgttcctaatggcatctagaatgtgaagcctttccggaaggttttccatttactttccccagatccatcagagcagtcacttactgtggtagctttggccttacaaaatgtattaagacttgaaaatagaaattaaatccttgatccatgggctgaaggatggatgttttgtttagtaggcatgaaaacaacagtaatctttttgtacatctccatcagagctcttgggtgaccaggtgtatcatccgtgagcagtaatatttggaagggaatcttgttatctgagcagtaggtctcaataagcatggacttattcagtaagccatgatgtaaacagatgtgctgtcatctggcctttgttgttccatttatagagtacaggcagagtagaattagcataatttgaaagggccctgggattggcacatcagcattcacttcatttaaagtcaccagctgcattagcccctaacaagagagtcaccctgtcctttgaagctttgaagccaggtgttgacttccctctagctatgaaagtcttagatggaatcttcttccagtagaaggctgattcatgtacattgaaaaatctgttgtttagtgtagccactgtcaccaattatcttagctagattttctcttcttagataacttactgtaacttctacatcagcacttgctgcttcacctcacacttttagttatgaaagatgattcctttccttaaacctcatgaaccaacctctgctagctttagacttttcttctgcagcttcctcacctctcagcctttgtaaaactgaagagagttagggctgtgctctggattaggtttggttcaagggaatgttgtgtctggttgatcttctatccagaccaaactttctccatatcagcaataaggctgtttcactttattatgcctgtgttcactggagcagcacttttcgtttcctttaagaacttttcctttgcattcacaacttcgctaactggtgttagtggcctagcttttggcctttcttagctttgacatgccttcattaagtataatcatttctagcttttgatttaaagtgagagacatgaaacttgtcctttcacttagaggccattgtatggttatcacttggcctagttttgattttgttgtgtctcagcaaatagggaggcccaaggagagggagagagaaggggaaccaggggttggtggaggagtcagagtacacataacatttaccaattaagtttgccattttatgtggtgtggttcagggtaccccaaaacaattacagtagtaacataaaagatcactgatcacagagcgccataacaaatataataacaaaacagtttgagggctgggcatggtggttcacgtctgtaatcctagcacttggggaggccgaggtgggtggatcacttgagcccaggaggtcgagaccagcctgggcaatgtggtgaaaccctgcctatacaaaaagatacaaaaattagttgggcacggttgtgtacatttgttgtcccagcaacttgagaggcttacttgggaggattgcttgagcccaggaggttgaggctgcagtgagctgtgactgtgccactacactccagcctgggcaacagagtgagaccctgtctcagaagaaaaaagtttgaaatattgcaagaattagcaaaatgtatgacatatggacatgaagtgagcacatgtcgttggaaaaaatggtgctgatacgacttgctcaaggtaaggttgccacaaaccttcaatttgtttaaaaaaaaaaaaaagtgaagcacaacagagtgaagcgccgtaaaatgagacatgcccaaatcttattgattagggaagggggagtagttcactgttttttgtttggcctcattctgtggtgaccttaagtgagtaaaaacactgtttcagtggcaactgggagttgagtagcacagtttgctttcagggagagggagacagaccatcaatggtgttcattttgtgcagtgcccagacagcaccaggctggccactcacagtgctttatcttggggccagtcagggccagcaggaagggctctggttggaggaataaagaatgtggtaaaagccaggagggcttgctttgaaaatgttccgggagaaatggagaactggattctgaaagttgtacttgctgggtggagaggttccagtaacagctacattggtatctcccggctctgccattgtctcagtcctctagtcttcatgctgctcaatggccgaccacttgaaagtcatggatactacctcaaggaacagatctatttattaaattcaacattggaatgtcaggagttacaaagtctgttgggtttgttttcatgacacatacgcataaagtgtaatcatgagataccgaggcaggcattattatccccagtgtgccttaggagttgtaagtaaaggatacatgataaatcattgtggctgcacacctcagagagctgtgtgtctatgggaaggagaggtggctcggggcctgtgagcatgcatccgcctgccagtgcgcggaaggtgcgctcctgtctgggaatcgagccaaagtgcggatctgttctttctcttagctcctgttttcacagttatgtcgctgttaggatgaggaaaggaggtagcggaaacaatagaatggaagatatgggcaaataaatatgctcaaatggagagaaccaatgaatccctgttactagcaagtactttccttgaaggaagtttatagaatgttttatctcccatttctaagagaaaaggcattaatatccaaccatgtggatcgaagcatcttgatattttatggattcttccatttctgcttctctgcattctccccctagtgcaagcctttgacatctgcacatgctgcttgcagcaacatctcacagcaatatctcctggctccgtcattgccccatccctccagtcttcatgccacactgtggcagaccatttaaaaaattggagatccggtctcttggaccttcctccaaaatgccctcctggggttcactattgccctgtatcccttctttgatcttatatcccatgacttacctgccagtatcatcggacctttgggtggcccacactaccaccttgtctctcctcactccctgtattaggattctcctacaaaaaaggccaataggttgtgtgtatatagagaaaaagatttagtagaaagaattggctcatgccatatggagactggtgaatccaaaatctgtagggtgggttggcatgctggaaacccagaagagtcaatggtgcggtttgagttctaaggccagcaggctggagacctaagagagctgatgctgcggttcaagacagtctgttgtagaaccaacgaggaagagccaatgttgcggatgaagtctgaagtcagtctgctggtaaattatctcttgcttgggagaggctggtctttttgttctgtttaggcccttaactgaatggatgaggcccacacacatatggaaccaatctgctttattcggtctatcaatttaaatattaatgtcatccaaaaacactctcacagaaatacccagaatcatgtttaaccaaatatcagggcaccctgtggcccaaccaaattgacattattaaccatcacctccctcttttgctttctgtcgtctgtttatactggacctctcctaacttttctaatatgttacattaattctgaactctgggctttgtacgtgctgtttattccatctggagtgctttttcatctggctcattctaattcatctatcagctgaaattcccctttcttaaagggcacttcccaaatttccctggctaggtttattccctctgatatatgtcaccagagcacactacactttccttgataacgcatatcacaattagagttccttgttcattgtctgccttccccactagaatttaagctccatgagggcagggagcttatctgttttgccattacatgcctgacacttccctgctgctcaaagatcattcaatgaatgaaagaacgtattgaaagcttacaagatagtaaattgatttttttttcttttttttttgagatgagatctcactctgtcaccgaagttggagtgcaatggcacgatcttggctcacttcaacctttgcctcccgggctcaagccatcttcccacctcagcctcctgagtagctgggatcacagccatgtgccaccatgtccagctgattttttgtatttttttttttttttgagatggagtctcgctctgttgcccaggctggagccagtggcgtgatcttggctcactgcaacctccgcctcccaggttcaagcgattctcctgcctcagcctcctgagtagctgggcttacaggcacgtgctgccatatttggctaatttttttttaatttttagtagagacggggtttcaccatgttggtcaggctgttcttgaactcctgacctcgtgatccacctccctcggcctcccaaagtggtgggatgacaggcgtgagccactgctcctggccgattttttgtattttttatggagacggtattttgccatgttgcccaggctagtgaagatactaggctcttgacatacgtaaatactaactgtgatcttcactttaatagactgaggcccggagaggttagggacttgtccaaggtcatgtagtcgtatagaagctgggctttaaaataataatgagtgtaaccatggagttgggtattatcctatttgacaacttgcagcaacctaatgagataagtagcccttggatgccccacagtgtcctctgcctcctgatagtcacaccataggagccatttccatctctcaggagtctggtatttgacctggtaccctcttcactctgtagtcttctctggaccatcttcagtacttttttcctctgccccagtaaatgggagcaagagagcaaggttgctggctagcagatacccagttgagaagcagaatgctgctctctgcttactgaaggtactcctgatctttacaggtgctcctttgcctccagccatcacgaatgagagagagagagagagagaaaatgagtgtgtgtgtgtgtgtgtgtgtgtgtgtgtgtgtgtgtgtgaatgaatgcttctccatgaccagtgtactcccctgagagcaaccctctctgcctgtcttccacttacagtgactgagtgggagccaattggggaagctgctttctttgagttggcatctttcagtgacctggcggtacctggtccaataaaaagatgtgattttctgaaatccagtatatacctgtatgttttgaggctgtcttcccaaggtgacttgagaatacgtctacacacacagaatattgggatattgttttctaactgcctattgcattgtgttaaattacaaactaattccccagatgatgggataagttatttttttctctgccaagtcacaatattaataatgcagctaaatttagctctgctgtaaaagagtttaattttcaaagccaattagacaatttgatggctgacttgctgcatttgtctctaactactcagttgataccatgttgccaccctaacagattcttgctgatagtcaaaggagagatgagttgtgggaagtataaagcttttcaattaatttatgatcctattaggtgtaaagcctataattaccctgcggttgttgcctctgccaaaaaagaagaaaagaataaagaaaacccatcttatgaaaaagttattttctgaacataaaagtggcatgggaaaagaaaaaaaagcttgtgcctcccctcctaagtgtgggaaggaattaagatttttggctttctcctggccagtgagttcataaagtgatttttttttgtggatagggtgatcatttagaactgtcttcagattctgtttttactttcttgattagacctctcctatctactcatccattcatccatctgttcatgcaacaaatatttataagtgctgctgtgcccagggactttccaggtgcaggggttcagtggtgagcattaacagggttcctgccctcttggagctctcatggggatgagggtgaggggagacaagatgcacagaagtaaattagtcaaccaggtaagttcaagtggtgttgattgttgtgcagaaaatatagaactcagtaatatgatggcctgtggagttcagggagagaggcagctattccatcttaacctgccagaaatgttttggacctagggagctaatgtctgagaaaggctcctcatccccaccctcccacctgaatttgcaaggcagtgctgcacacttggcagatggaaatggaaacctctgcagaaacctggcaaaccattagcaggactctctttggactctcagctcagcttaagtagagcacatagcttctttggggggaaaaaaaggcattcaaagtcttaaacaagagtaaagttctcatttgccactttaatcaagttcattaaaaatggaatgtatatttaaaacttccttttgattaacttaatgtaagtgcatcctgacttaggagagggggagaagtgtgcccctagatgatatcaaactttgaccttcattaaatgtttgcaagtggtaaacctcaaaggcctgcagtataaaatgggataaaatttccaagaattagccatcctggggggaaaaatatatatttggtttgaaactctactaccatagtctgcatgtttcctcagccattgcattttgacagctgaaacaacagactaaaactgtagtttaaaatacaagcacacacactcacagatcaatgcaaaaatactgtgctttggattcgccaataaatatggaacgtgatgcacatatggttgtttggctgaattcttgccctgtacctggccatacacaagacaacttctccattgagtgggcagctctacagagaactcctggcagtagtgaccaggacttcagggctttgctccattgaccttatgcaggacaaacttaagtcaaaatgtgtttctcctgaaagaatacaacagcacttgacctgtccttgacctaatgtggaaagttgattccttcttgaagctagggaggcagtgtcacatgacagttccaagcagttgctgtagaattagaccacctcagctcacatccagaccccaacacttaccagttgtgcaatcccaagtacatggtctcttgttcactttcctcatctgaaatgtgggtataatagggccaatcccttgggttgtcagaggattaaatgaagagagtatcacaggccaggtgtggtggctcatgtctgtaatcacagcactttgggaggccaaggcaggtggattgcttgaggccaggagtttgagaccagcctcaccaacatggtggaaacaccatctctactaaaataccaaaattagccgggaatggtggcacatgcctgtaatcccagttacttgggaggctgaggcatgataatcccttgaacctggaaaacggaggttgcactaagccgagatcgcaccaatgcactccagcctgagcgaagtagcgagactgtttcagaaagagagagagaaaaaaaaccttaccacaatgtgtggcccacagcaaaaagctcaataaacattagcactcttgctgggtccacacatgtcttttctgggtttcatctggtttccaggcgggctgcctctgcgcctttgttttcccagctgccctttctcagtaaagcggcatgaaagctacatcctcaccacctgaggcactattgagaagaaagtgtgtgctgccatgaactcaactctgcattgctttcaggctcagagtggtggaacatgctctcagtgaaatgcagcgtgactgtcctctgtggccctgtgtatgtcgaagacatgtttgggagtttgttaaggaatgtagctgattcagtaggcattgtctccaaaggcttccctgtcagggtaacttgaatgtgtgtgtgtgtctgcgcgtgcgctgtcataagcacattgagatgttggaagagcaaactgaatgctcttcatattatctagggagaactttgcaaagcaagccagcaggctggtgggtcctttctgttctgctctaggacatattgcaagcctgggcaagacagttgccttcttttaccttcatgtactcatctggaagtgattatgaggggtacaaagagacatctgttcattacaacattatttgtaacagaaataagcaataggaaaaaacctttggttttttgtaaacctcccgaggggtcctgggattgcaggtgtaagccaccatgcccagtcatagcagtttttttttaaagcaattgcaagtagtagttacgatacttgtacgaaaatatacatgcacagatgagagagtttgtgatttgtgctactgtgtgtgtgtacagaaatagtgtagaaaggatgacaccgaactgggaacatggtttcctataaggagagaatcaagataagatgaggcctaggggaattttgctttatctattgtatttgaatttgattttacaatacaatttatggtatattacttttgcaattataattaaaataataattaaaatgagcatgaggctgacctagcaaggaaagccccattgcagagtgtacagtgacatacttgtgaaggtattactttacattatttctgcaggaaccccacccacacaccccacaaggtttttagagcattgatactggtatgtttcagatactaattgccagtgattcttcttcaacccaaatccatgttcaattcagatgctaaatgagtccagtaatgccacaacaaaatggacaagtgcttgtggttagatgttggtttgcaaaggaacttaatatgctctgagcggctgcctagaccacaaaaatctgaattattatataattataatatgttttatattttataataaaaattttaaacacatatagaagtagcaagatggctcatgcctgtaatcccagcacttggggatgccgaggtaggaggattgcttgaccagcctgggtaacaaagcaagactgtctctacaaaaagaagaaaaattagttgggcataatggcatgctcctgcagtcccagctactcatgaggctgaggcaggaggatggcttgagcccagaaggtagaggttacaaacgtgagctgtggttgtgctgacagagtgagacaatgtctcaaaaaaaaaaaaaaaaaaaaagaaaagaaaaaaggcaagaatagtattatataatggactttacatgccaatccctcccaagttactttgtggcaaatcccagacagcatgtcatttcatcctcaactacagcattttagtttgtatctctaaatgcactcttctaaaaaaacataaccacaatatctttaccacacattcaaaaagtatcctaaaatatttagtacttacttacatttttttaattgtcacataacattttaagtttttttaattgggatccaaaggtcatagtcattgggtgataaatctcttaaatcttaatctctacgtttcttctccatctcatttttccccttgcaattttctgtttttgttgaagcaatcaggtcttttgtcttttacagcagagcttctcaaagtgtgatctaatgctggtttgtgaaaagtatagaaattgacagtaaatgtttagaaacttacagcaatttgacattgctgcaacatccaagcacatgagcatcatcatcggcaaacatggtttgggtttaaattgtatgtatggggatattctaaggtgctgctacaatacaggaaagcattctagagtacagagcggaagaagcatgcaccataatgtaagtcaacatactgtttccttcaagaatatcttactatgaaaaaatttcagcagaattaaacaggcttagtaatgcagtgaaatttatttatttagataaaagctaatctgttaaggtcaagactctatcatgtgttaagtggaaggtgatcataaacaatagttactacatgttgaagtatggtgggaagtatggttatctagggggaaattccatcaaatgtaggaaatcctagagttcctcaggataagaaaccagtttggttccaactttttctttaaaaaaaaaatgtgaatttgatctctttgatattttaatgatcttaatactttcatgcaaagaagaagagcaacatgtttttcaatgacaagatcaaaaggccaaaaaaaaacttgaaagaacagagtttcaacagattcttatgacatattccataatttgataactagcgaacaatgtctacatgtgattatacctaggtacaaccttttgaattttatcaatgtttgattttaattgttcattaaaagaagatccacatatgggaaatacatggatttaggaatctatttctttcattgaaagataatttaaatttaatgttacaggatgaattactagaattggctattataaatttaaggtgaattatgaaaatggaatgtcagttgtctcattttgaataaaaattaaaaagtaaatatcttggaattattatatcttggagttaattatggatttaaaaattactttaaaatctgttgtttcatttacataagcatacctctgtgagactgtttttttctacggtgattgttattaaacattgaaacagttaatataaatatccccaagtagtgttgtccttaacccagtttaggattaataggctagaagaaaacattaaaaatttttaatatgaaaaataatgatatacatggtgtttatgcagtatgtatataagcatttattatgaagaattgctacctcctttataactttaaattttcttttcatttttgtgggtatatagtctgtatatatatttatgaggtacatgagatgttttgatataggcatgcaatgtgaaatacacacatcatgaagaatgaggtgtccatcccctcaaacatttatccatcgagttgcattctttgttattttaaatgtagttattgactatagtcactctgctgtgctatcaaatagtaggtcttattctttttttttttttacacccattagccatcctcacctccctccacccagcccccaataactccccaacctctggtaaccatccttctactctctatgtccataagttcaattgatttgatttttggattctacaaaaaaaaaaaaccagatgtttttgcgatgtttgtctttctatgcctggcttattttacttaacatgatgatctccagttccattcatgttgttgctaatgactggatctcattattttttatggctgaataaccacatttttgttatccattcatctgttgatggacacttaggttgcttccaaatcttagctattataaacagtgctgcaacaagcataggagttcagatttttttttgatacactggtttcctttcttttgggaatgtacccagcagtgggattgctggatcatatcgtagctcaatttttagttttttgagggcccttcaaactgttctccatagtggttgtactaacttacattcccaccaatagtgtacaagggttcacttctctccacatcctcgccaacatttgttattgcttgtcttttggatattaagccattttaactggggtgagatgatatctcgtagttttggtttgcatttctctgatcagtgatgttgagcatcttttcatatatctgtcatttgtatgtcttcttttgagaaatatctactcaaatattttgcccatcttttgtttggattgttagattattttcctatagagttgtttgagctccttatatattcttgttattaatcccttgtcaggtggatagtttgcaaatattttcttacattctgcaggttgtctctttactttgttgattgtttcctttgctgtgcagaagctttttaacttgatatgacccatttgtccatttctttgtgttagttgcttgtgcttgcggggtattgctcaagaaatttttgcccagaccaatgtcccagagattttccccagtgtttccttgtagttgtttcatggttgcggtattagatttaagtctttaatccattttgatatgatttttgaatatggcaagagatggggtctagtttcattcttctgcatatggatatccagttttcccagcaacatttattgaaaagacgatctttcccccagtatatgtttttggcacctttgtcaaaaatgagttcactgtaggtgtatggatttgtttctgggttccctattctgtttcattggcctgtgtgtctgtttgtatgtcagtaccttgctgttttggttactatagctgtgtagtataatttgaagtcaggtaatgtgattcctccagttttcttctttttgcttaaggtagcattggctactctgggtcttttgtggttccgtataaattttaggatttttttttctatttctgtgaagaacgtcattggtattttgataaggattacactgagtctatagattgctttgggtagtatggacattttaacaacattgatttcttccaatctgtgaacacggaatatttttccattttttggtgtcctcttcaatttcttttatcagtgttttatagttttcattatagagatctttcacttctttggttaagtttatttctaggtatttaattttacgtgtggctttttttttttttttttttttttgagatggagtctcgcactgtcacccaggctggagtgcagtggcgctatctccgctcactgcagcctccacattccgagttcaagcgattctcctgcctcagcctcctgagtagctgggattacaggcacccaccaccaagcctggctaattttttgtatttttagtagagacgggatttcactgtgttggccaggctggtcctgaactcctgaccttgtgatccgcctgcctcggccccccagtatgtgtggctattataaatagaattactttttagatttcttttttacattgttcactgttggcatatagaaatactgttgatttttgtatcctgcaacattactgtacttgtttgtcagttcctatatatagttttcatagagatatatatatatagttttatatatatcttatatgtagttttcttatggagtctcataactttacctagttatgactgcagaataacagaaagttgtgagtataataggaattttctaataattgtctgtatttgcaccttcgataaataatgtgtatagctttcctaattttttttcttgttcttttttttctaattagaatgtacttttatgtcttttgaatctatgaataaaaaattggggcttatattttataagtatttttctcttttctaatgtatttttattgtatttatcaatacaatttttaaaatagtgacaggttagaactaaaaaaccaagttagaaacaaacatgcctgtggtgtcatttaacgtgctcttctgtttctgtatttcgtgtaccttggtagttagatttcctgaaagcttcgtcagagttgggcgctttttctgggtgagagggacaggactacttcacaactgacgttacgtacttttagcaggaggacacactgtctagttgctgcttgtctctttctgtgatgttacctgttgatgattattgtcaagagccattagtgtattagacaatgcacagtggtgatattctaatcctgttattcctctttcatttatctctatgcttatttacatctatgggatacttttagaaagggaaacttcatcttgtcaactctttgaccacccccccgcttcccgagacacaggaggcatagatagtatacaaaaccaagtcctttgacattactaaaagtcctcgtacctgattccacttttctagaggtctcttgtcatatagaaacagctctcaccaactggttaatgagtatctactctttgcaaaacacggtgaagacaagtcggggttaaagtagagtaggacgttgtcttttaacctcaagacttttgtctcactgtttggatcagctctgacacctgaaattatttaagatcaccagtataagtaattcagtgctaaatcacttcactccacaatctactcatatgagggcaaaaatttactgaaaggtattcttaattacagccttctaatttcaatttcagaaactggtagcatttttgttcttcctgtttatctaacaaacttctgtttctggtcattaaacagaatgtaactttgtgggaagggtggggattttatttatccaaatgaataacctttattcagttaaaaattgccaaatgtctgtttgttcttggggttttttacggtacttaacattcagcctgcctgatagcagataggatttaggttgccaaatgtggaaatgcaaggaatgtcagacgtggcgaaagcaaatctgcagagattccttgatgccatcttgtaaaggaaaatatactactttttatgagtgatggctgccagctattattccagggacaacataccatattttgctttatagacttaagaaaaggaagacctatagatattatttttctgtggagggtgttctgactcttcctcatccagggaaccattttgagggtctgctagtttctaagtatatttacctcatttatatacttggggacaaggtgcttctgtggacctactagactcactgtgaaaccgacatggccacagctccacttgtcccctggactccataagcccccactctaacgagagaaccaccattttagatcctgtggtgtcagggtcagctcagacccgtatctaacagtctgaaagatctggcattcccctttccccagcacccgcctgtggcctgtgatcctagtaggtggtagaaggttcttttgtagagggatcagtgaaatctttatcatatgaactgtgcgtgtgggtattgcaggctccttcctcaacaagacctgtcctctcctcagacagtagactctgagactgaattgcagcatctgatgtcagcctctgcttttcagctccctctcttttatacaagtcaggtaacacacgtgtcagtttctgtctatctcgcccatgccaatcagccacagatcctttgtggtcaaagaactccggttgccactctggccttgctgtccgttatgacatttacatccatccttgcctctggttaattgttaccacctggcctctgctattttggaatcctaccatcccccattaattaaaaagctcaataccgtggcagtgtctcttactgtcaactccagccaacagaggacaaaaccactgagcttctcaatgacactgtgcccctcacagatgcacttatccctttagtgaaggaagcgacctctcggccctcctgggatcatggtctgatggttggctcttctgatctttcataagagatccacactacatgcccactcttgagccttttgacctcctcaatattctgccaaggcagtaccagcatctccatttaacttacacgaggccattgttgtgctcaggccgcaaggagccatcccaatgtccgcagaccagctttaggtgtctgccggaatactaaactacaagtcacagcagagtgctcccatgcagataaagcctcaccaatctagcctgacattcacctcatcaccctcccctttccgcctgttccccaggctcccatcagtgcagtgagtcctgtccgggcacagtggctcacgcctgtaatcccagcactttggaggccaaggcgggcagatcacaaggtcaggagatcgagaccatcctggctagcacggtgaaaccccatcgctactaataatacaaaaaattagctgggcgtagtggcaggcgcctgtagttccagctactcaggaggctgatgcaggagaattgcttgaacccaggaggcggaggttgcagtgagccaagattgtgccactgcactccagcctgggtgacagagtgagattctatgtccaaaaaaaccccaaaaaacaaaaaacaaacaaaaaaaccagtgggtcctgaaagtccttcagcatgaagctattctctgcatgatccttatcaactggagtgaaaaggatttgaggacgggaagcatcatcttaagaagtagctgcctcagatgaggtctttacaggatttctaggcaagaagaggttgctctcctctagtaagaaagggatgtttcgggccaggcacggtggctcacgcctgtaatcccagcacttcgggaggcggaggcgggcagatcacgagatcaggagatccagaccatcctggctaacacggtgaaaccccgtctctactaaaaatataaaaaattagcagggcgtggtggcgggcgcctgtagttccagctacttgggaggctgaggcaggagaatggcgtgaacctgggaggcggagcttgcagtgagccgagatcacgccactgcattccagcctgggcgacagagccagactccatctcaaaaaaaaaaaaaaaaaagaaaagaaaaagggctgtttctactggcccagaaagttcgggggaatttgggagttcaagattctgggacttgtccaccaaatgtccttatcgcaagtatcagggtggttccatctgggtaaactctccacatctctgggttgtgacagtggtttcctgtagcggtagtcccactctttggtgtcagagaaactctatcccaggtgaggtgctatgtagctctactggtcatagcagcagtagctgagatagtgcagctgagaggattatgaagtagcgcacaggaggtgtttgtacaagccttctctatgagactttatttctgaggtcagataagtacttcatttaaacccagaattcctgtgtgacgggtacagtcacaggaatctcaggaggccaagtgttgcccctgaagtttttcaaaccccaaaagatgaactaaatcttgaagaaaacaacattgaacttgaatcaaacgtggttgttgttataacaatgataatagcaataataatcatggctaccatttactgaccattattaaaagatggcatctggattaaatgttctgtgtatattattttaatttattgagacagagtctcacactgttgcccagactggagtgcagtggtgcaatcttggctcactgcaagctcttcctctcgggttcacatcattctcctgcctcagcctcctgagcagctgggaccacaggtgcccaccaccacgcctggtaatttttttgtattttttttagtagagacggggtttcaccgtgttatccaggatggtcttgatctcctgacctcatgatctgcccgcctcagcctcccaaagtgctgggattacggcgtgagccactgcgcccggccttactttaatttttataaccatctatcagagagatagtatgctcagtttacaaaagaaacagctgacactttgagaagttaagcagcttcttcacagtaaaaacaccaggaggggagtggggcttgaatttgaacctaaatttatatgactctaaaatgttaaccatctggtttataacagctattttgcttctccagccaagccataaaaacttaagaaatatatataccagtcagaatctttcatatatatgtaatttttgaaaaagggacagtgtaacaagctaatgatgttccaaaagttgtgtggtgggcggggggacagaagggctgaaagcagtgtgatgattgattgatcgattgatcgattgattttgagatggagtctcactctgtcacccaggctggaatgcagtggcgtgatctcggctcactgcagtctccacctccaaggttcaagcgattcttgtgcctcagcctctcgagtagctggggccatagccgtgcgccaccatgcctggttaattttgtatttttagtagagacagggtttcatcatgtcggccaggctggtctcaaactcctgacctcaagtgatctgcccaccttgacctcccaaagtgctgggattataggtatgagccttgcctattatatatttttaactgcagtaaaccacatttaagagaaaaagaaaagaaggaaaaaatggggagatgtccctgtttcataggaccttctcactgtgattggcgttttccaagatgagcgcctgcagtcagcccctctctagtccttggcacttacaggatacctgttgagctgctgtgaaatatcacttttaagaaacctcattttttattttgatttttttgagacaaggtctcactctgttgtccaggctggaatgcagtgacgtgatcacggctcattgcagccacacctcctgggttcaaatgatcctcccacctcggcctcccaaagtgctgggattacaggtgcataccattgtgcctggccttaagaaacttctttatggggcactgttgtgggccattgctaagaacggtaactagttacaacttgttatttggggggggggttacatatgtgttctagcaatgagttgaggcagatgtagggggcagtggttaatctggcaagggttggtcttagaggtgggaaaccactgttggcagccctttctgctgctacctccaataagagccagcccagctgagtggtttcactggtgtgtgggatgtgcctttgtcatggcctgcagacctgatgttgatgctcttgcccatgactgaggacaaaggggcggggtggaaagccatcaggtgtggtgtcttgttcccaggcctccgggggtgtcacctgcctctggggggcagcctgccctgctcagctaactcatgtaggggctccctgacagcagctgcttggcagcgcaccagcggggctcgggaaacaactcttgccatcccctcagtattagttgctgtttctctgcttgtggatattccttgatggcaggattttcctctttttgactgaacagcaaaccagtttaactccttacataatattttatagaaaattgtatcctttattggatctgatagaaatcattgagtatatcccaggaatgtcaaaaggtaagttggctgagagccagctgctaccatttctgtcacttcaattgttaatgggcatttcctatgttcatcactgtggcaaacactttattaccttctttggttctcacagtaaccatatcaatatttttttatcaccctcgttttacaaagaaggaaaatgaggcttacagggcttcaatgacttgcctgtggcatatagcatgcagtcagttggaatgaaatccgtgtctgatttcaatgccccaacacctaaatagaattttaaaaattgagatatattttacataccataaatttacccttttaaaagtgtacaattcagtggttttcatgtatattcacaaagatgtcagtcatcgccactaaatccagaacatttacatcaccctaaaaagacatcccatacccattaatagtcattccctattctttctcctggcaaccactaatctactttccatctctatggatttgcctattttggacatttcatataaatagaagcatgcactatgtggtgttttgtatctggcttcttttacatagtttaatttttcaagatgcatctatgttatagcatgtatcagtagttcattcctttttatggctgaataatattcatggtgtggctatactacattttgtttatcagttcaccattgatggacatttgagttgtttctactttttggctgtttgaataatgctgaagagaacatttgtatacaagttttgtgtggtcatatgtgttctgttcacttagacacagagctaggagtggaattactgagtcatatggtaactttatgaattaactggacttttacttgaactcctgagtcttctcaaggtatgaaaataaagtagataaggcaatttttaaggcagtgctgtagaagcccagcatattatagagaggagagttcccactgctgtgaaaaaagaggcttctcctttggagctttgttattattttgataaaattatacagtggcgaccagtgttagcaaatgagggttacgcagcgtcttagtgtgtaggctggaaaacacatgacttgcatagtaatagttaggtttccatttctgttatctctgctatggtttgaatgtttgtcccttccaaaactcgtgttgaaatttaattgaggctggctgggcacggtggctcacacctgtaatcccagcacttcaagaggcagaggcaggtgaactgcttgatcctaggagtttgagaccaacctgggcaacatggtgaaaccctgtctcaacaaaaaatacaaaaattaactgggcatggtggtggtgttcacctgtagtcccagctatttgggaagctgaggtaggagtattgcttgagcctgggaggttgaggctgcagtgagccatgagcgcgccactgcatgcctgcctgggtaacagagtgagactctgtctccaaaaaaagaaaaaaggaaaaagtttaattgccattgtaataatattaagaggtgagatgtgggaccagtaagaggtgattaggccatgagagctctgcacttgtaaattgattaatgctgttattgcatgagtgagttcattataaaagagcaagtttgcctccccacccccaatcccccaccaccccacaccctcccttgcccttctgtccgtagctatgtgatgatacaacaagaaggcccttgcaagatgatagcttctcaatctttgatgtcccagcctccagaactgtgagaaatagatctctgttcattatgagttacccagtctcaggtattctgttatagcagcacaaaatggactgagacaacctcccatgcattcaggtattttttaagcctgctttgataagaaatcaaaacaaaaacaacttggagtttattcttacatgactttcttttttttatgtgactttttgaagtcatagactgctttttagagtggtgaggaacagacagaagcccagtgccctgcactcctgcctctgggacacccaatgccttatatgcttcaaacagactgatgggtacatttgaatgtgagaaatatgcatagaaacatcagctacatcaaggtgggaggattattgaggccaggagttcaagaccagcctgagtaacatagtgagacctgtgtctctttaaaaaaaagaaaagaaaaaaaaagaaaaaaaaattagccagacttggtggcaggccactgtagacctagctactcaggaggctgaggcaggaggatcacctgggcccaggagtttgaggctgtaataagttctgattgtgtcactgcactccagcctgagcaatgagattcagtctttaaaaagaaagaaagaaagaaagaaaccagctacagttaaacatatgtatgcatacctatgacctagtaattctgctgttaggtatatatggtatatatatatgtgtctgtatattcaccaagagacatgcatataagaatattgatagcagcaccactatttttttttaatacacagaatgtaagattacctaaaatctcttcaacagaagaatggataaatgagctataatatagtcacataatagaactctatacagcagtgagaatgaaagaatcataacaatattggataaatttcacaaataaaatcttgagtgaaagaagccagatgggaaagaatatatcctgtgtagttccgtccatataaagttcaaatatgggcaaaactgacctgcaatattaaaaccaggacagtgactactcttgagggtagtgattggaaggggtgtgaggggctgctggatactggttagtcttttcttgactgaagtgctggttacacaggtacatcctgttagaaagttctacatgctgtaagtgtacacttttctatatattagaattttttaaagaatgagtaggccaggtgcggtgtctcacacctgtaatcccagcactttgggaggccgaggaggggtgatcacttaaggtcaggagttcgagaccagcccagccaacatggtgaaaccctgtctctactaaaaattcaaaaattagcagggcatggtggcgggcgcctgtagtcccagctacttgggaggctgaggcaggagaatcgcttgaactcaggaggcagaggctgcagtgagcagagactgcaccactgcactccagcctgggcgacagagacaaaaaataaaaaacagcaaaaataaaaagaatgaaagtatatgtatacacacatacatataaataattggtttcatgttttccctatctctagttctaaaataaatcttaaacatgatacagactatggaaatgtaataaattcaatcagagagaatccctttgttaattcagcaaatatctgaagagcagagcctgggctgggaggcagtcttcttgttaggaagggggtgggatttgagaatgcctcaggaatgggagggactgagcttgagcccccacctatcgtcagtagctgcatcttttcctcacgctggtatgctcactgtcttttcatgtcattcttcttcctttgcgtctcctctcctacccccagctcttcctgcctttttttctgtcaccctcttcccaccatgctgtttgttttgacattgaactagatataaattatccaagaggcgatctggctgaggctggggaatgtgcaggactgtcctcgcccagggctttgggagatcccccaggaaaagggttgtcaggactggaatgtccacccaggagaaggtctgtggattttccctacaaaggactccccaaagactgggttccaggcccctgagattagggaagaggcaagcccaagagagaaagctccatcatctaccacagcaaatgcagattttctctatgaagagaagaccaagccttttgctatgagatcagtagggaaagggcacagggttaacctgggactattcacagaagagtcttaagctttgtaatttctcaggttattttggatcctgcctcctgaagactgctgaatctcagctaatttttgttgtagaaataatttgcctatgataataatgagactatcctgagagagatgtttattttaagactgtttaaaactctcaggaataaatatccctggggctgattctgggcattaaaaacacaattcaaggtgagtttcatttctcttcctgcggccttcacattaggaacctctttttacaaagatgtggcagaattttgattttaaataattcataatgatactgttgacaattttgtatgtttgtcatgtgacataattattggttaaggaatgtagtggaccaaacttgctcatggctaatctgtggctgaaacttaaaatatggacaatatccaatttggaagaaagccttagctcggaaataatcagatataaccaggattagggagatgctgactgaagataagctgacttcagacagggtattcttgcgaagcatgtcctccacctaactggagcattaccttccttaggggtcagagtccaccaggttagagtgcttcttcctgccatggactgcacatgcacatggctaatcatcatgtatgatgacatgagtataggagaggaccctcagggcctccctgatggccagctgtacctgaagtcctcctagtcccccttatctgcagagacacttgatcccagcaaagctcagtgctgaagccaaatactgtgtcatgctgcgtgctgagtaaggccaagagaccaaatgaggatttgggcagcgcttgggaactataaagaagaggtgaaggtttaagagacagaggaaggagtagatgttgggaagggcttggaaatctaattggagaatttagcctcttgttgactttacataggcatacatacaccctaatatttagtgagtgctttttctgtgccaagtgccgtgcttatcatctactcccttgggagtagctccctagcgtattctcctagctaccctatgaagtcagcagctatcattattatccccatttttatagatgagaatattaaggcccaaggaagttagtcatataacctgcctagggccatgaagcgcattctatgggtggactgcttaaatagattctctccttcccttgcttctccccactcctgcctcagccaaccttggaagagaattgagaaggggacctagcggagtcttttgtggatagtggtgtggacagtccatgtagtaccggtgtttccagaccatgatgtcacctctcacaggtggtagacattatcagcggaaaatcacacctaacctggacatgcatgttgatagctgcagagagctgtgagagaaggtcatgtgggttagggagagtgagggatgagagggaagagcagtgtgtgtcatagtatctggaataatctagcatcagatggatatcatttcaagaaatgcctcagtggcagaatgattgaataaaatgggactcctggaatgaaaaccaggcccagaagagtcagaaacaccatttctggaggagggtcacacagccgactgatagcagaagcaagtatgtgtcactgggagagattgagcgtgtgcctgaggatggcgggctcactgacttgcaggtgtcctccagccctgggagaaggcctctgtcctctgtgggatagcgtagaagaaatactgttggaaaccaaattagagtagcaaatcacagttggtgtttacttctgagtagatattcatgtttatgggaagcaaaggcttccctttgccatattcaggactatgtttgcaggattatagtcagacatttaattccccgctagcagagcagcttcctggttttttcaagcttatggtgcagaattggaaagtgacaggctgtcacgctcatttcagttcagtggtgtttcctgtgggagattactgaggactcagtctgactcagctggcagctggagagaccccagccagcgtgcctctcgtctcgccctcaccagcaggacccacttctcctgctgacatcatgcccatatcaagtgcttccccaccttactttctccctcacaaaggaatgagtgatggataattaatatgtagaagtacatataaagtgtatgaaattgtatgaaggatatgtagccagtaggactactcttgcccctggaacctgaccatccttcaaacagcagcaagggacccttaggttacaaagtatttacaggtgttgaagtgacatattggagctctggttcttggccctaaagatgggggggtgtgagtgacttcaaaaagggagcacagcctgtgattttcagtggctgagacaagtaattggtgaagagttattgagcatccattacgtagaaggcattcctatttcctttgactgccgtaacaaaccactgcaaacgacatggctggaaacaacagacatttatgctgtcacagttctggagggcagagtctgaaatcaagccactggtgaggtcgcattgcctctggaggagactgttcccttgtatcctccattctctggtagctccagggttccttggcttgtggccatatcactccattctctgcctctgtggtcacatggcctctttttcttctgtctcaaaactctgcctctcttataaaggacacatgtgactacccacccagataatccaggacatcaacggattaacttaatcacgtcttttttttttgtcatataaattaatatagattctggggactaagacatggacatatcttttggggacccaccattcagttcactatagaattctattagtttatctggaaacatgaaaaagtaagagaaggtatcagctctctaagagtctgtaatgcagttaggtgaatatagatgtgtttatttatccaataagcctgtattgtttccatgccacgtattgttcgtgtgacaggctgtgtggttgcattgaacttacatagtggaatgagacacagcccctgtgctggagaagctcagagtctgagaggaaagacattgtacacaagactaacctgagagaatttcagtctctcatggtccagtgtttgtaagaagatattcaaagaagcacaatccgaagaccaaaattaacttgtaaatgcattttaataacttcttgttctcaaaagtaaaggaaatccaaaatataaccccatagtacaatgttcatatcctggttttctttcctaattctctcacattcccccattctgcatggcacattcatttctccctctccgcctctctctatcctctcctccctccccgctttctctccatcctctcctcccccccttctcttctcatcctctcctccctcccccctctctcccccctcccccgcctcagcgtttttttatatagatgggcttagcctcccttgacaagtcagctttattctatctcaactctcccgcttgtcctctaagtctacatcctaaagcccaggaatttctctggttaggacagtctccttagaaggagaggcacatggagaagcctttttacttagaatataagaagagaggccaacagtactgacatcacacaattgcagtccagtttgataagtattacagtgagattttaaaaatacattattttgtgctggcctcattcaatttttgcagcaacccagtgggtaaaaactgtagttattcctattttatacataagggagtgggcttatagtcattaagaaacttgctcaaaatcagtagcagacctgggatttgagctcagggcagggtgatttcacccttgggaccctggaggttggaagagtattaggagaacctttaagaggaggacgcctttgaatcaggtatctttgaagtctaagaaggagtttggacaagatttaaagagaattctaagcaaaaatgacatggtggggctttcaaggtgctctaagtaccttttggccaagctagggtgcaggatgcagcgggggagaggtatcagaagaaaaggtggttggaaacagactgggatgagactatgcatggatttgtatatctctggactttgttctgggggaaatatgtgtcactgaggttccaaggagaggagaaacacaatcacatttgtgttgtgaaaagagcactgtaacatcagggatcacataaatcaaggcgggggagggagagggcaggacttgaggcagggagagtaacgtggcagaatggcttttacatgcaaattcagcccataattagcagtcccactagccccctgtatggtctgtttacataaaacactctgacaagaggcacagaggaagagcagtccatagataaaggcaccatagacctagcaaacaccgccagcagtctgccccctggcaagtgggcacagtggcagtggctcctactgcattgcagctcagctgtctgttctcaacctttgccatcttgaaacaaactgaaggggaagggctaggttctcattatccctttcttctaacactgacacaacataaagcaggaacttgcctctcattggctcattgccctctaagatccagacagagcacagagaatttaaccaccatgggctcaatggttctgtctttcctgggagtcaagttaaagaaatcccaagaactagctgaccagcttgtgctgacttgtataaagttatcttttattgaggacctgttttgagacaaagcacactcactatctgaatcctgaatattagtctggctttggcttctgtttttccctaagtgaaaacccatctgcagaagcagatttccatatataagctgaaacctgctttacctcttgtcccaatttctaagtttagataatcacagaatttcaagaaacattagcaacattcagttagagaccgttgcaataacccaggtaagaaatgatgacaacttaaggcagtggcagtacagctaaagaagatggaacagatcaaggaacatctaaacagtaaccatagaaccatgcttatgttaactgagcactttctatgtggcgggcattgaataaaatgtgcattatctcattcaatctttgcaacaacctaatgaggtaggaactgttatcccttctattttacatgtgcagaaacagactcagagtcattaagaaatttgcccaaagtaagtggcagagctgggatttgagcccaggcagtctgacttcaaagcttatatttttagtctctaggccttactgtctcaaatcaggatgatttggtggtttagtgaatgtgggatagggggaaggggaagaagagaaatgggggaggaatgttccagattagggaaatagatagctagatgaaagatggagcccctcatcaaggtgaggacacaggaaaaggaacaggtttgggaggaaggatggtgatttggttgtgaatacattgatgggggacatccaaggaagatgtctggtaggtggttgggtgtttaaatatagagcttcagagaacgtgattgagggtaaagaagtagactcagaggaatctgtatctaggcagcagaggagcatgtgagcagaagggagggggagcactgagatctagagaagaaaatgagcagagaagatgcccaaaaacctcaaggacctgcaacatttaaggtgtcagtgaaaaaagcattcagtggaagaaaggaatcgtccaagggatggttaggagaatgaggagagaatggctcacaggaaccaaggaggaggaattttgagggagggatggtagcagggcccagtgcaacagagaaatcatgtaaaggaagagtcaaaaagttactattgcatttggcaattacgtcaatgtaaaaccagccggtgggagtgcaacatggtacagacatgttagaacaggggtccctaacccccagaccgtggaccagtacttgtccgtggcctgttaggaaccttgccacacagcaggaggtgagcagcaggcaagcaggtgaaacttcatctgtatttacagctgctccccatcacttgcattactgcctgagctccccctcctgtcagatcagcggcagcgttagattcttataggagtgtgaaccctactgtgaactgcacatgtaagggatctgggtcatgttctccttatgaaaatctaatgcctgatgatctgtcactgtctcctgtcacccccatatggaactatctagttgcaggaaaacaagctcagggttcccaccaattctacattatggtgagttgtataattatttcatcatatattataatgtaataatagaaataaagtgtaccataaatgtaatgtgcttggatcatcctgaaaccattgttccccactgctgagtttgtggaaaaactgtcttccattaaactggtctttggtgccaaaaagtttgaggactgctgtgttagaagacagtatagacatttcttacaaagctaaacgctgtgctgccatattacccagcaattgtactccttgttatttatgcaaatgagatggaacttatgtccacacaaacctgcacatgaatgtttatagcatttttatttgtaattgctgaaacttggaagcaaccaaaatgtccttcagtagatgaatagaaaagcaaattgtggtacaatggaatattatggtatacaatggaatattattcagcaccagaaagaaatgagccatgaaaaggcaaggaggaaccttaaatgcatattactaggggaaataagccggtctgaaaaggctacacactgtatgattccagccacacagaattatagaaaaagcaaaactctggagagagtaaaaagatcagtggttgccgggagctttggggcaagagagggatgaataggcagagcacaggggagttttagggcagtgaaactactctttgtggtactttaatggcagatgcatggtattattcatttgtcaaaacccatggaactgtacaacacagagtgaaccctaatgcaaaccacagactctagttaataatactgtatcaatattgactcatcaattgtaacaaatgtatcacactaatacaagatgttattaaaagggaaatctgtaggggtgggggtgggcaaagggctatatgagaactctgaactttctgcccaatttttctgtaaacttaaaatcgctctaaaagtctatcagtgaagataaaaaggagaggaaaggatggaatagaagaaataaatgaaggaggaaacagggcaggaagaaagagaaagccgtgcatatacaatcttgagagtgtagcataaaaccataattataattaattctgtatgcttgtgttacaagtagaacaaaaatatgactagccactcttcttgccaactcctagggctctccatcacaagtgtaagatgcagttcaagtaatttggcatgatgtgaaaatttttcactgcctgactgccacctcattttctaacaccatcactggtctttgccgtgttacaagctccagctgcagttgtctctttgcctttctttgctactcatgacacatactttcagaccactctgcctttttgctcttgctgtttcctctgcctgtgtcttctccccttctaacctaaccagatcctacctcctctaacacactaccttctctgtgaaaactttcctgacctcctttcaccccagcacagcaagcaagaatgatccctctcccagtttccacagttccttatgcccatctcttcaatatatgcttggtactccacaaaataaataacaaaaatggtttcagtggaaaaactggggacagaaaagccagatcagagcagatttaagcaatgggtagaaattgagatttgagtacatagaattggttttattgtgatgctgtgttaattattttgatttgtctttagcatttggatctttacctaacaggggttgagggtggtgagaagaaattcccagagtggccgtggtgctgtccaatgctctggtgctgacaggcctgtctcactgaataaaggatgcctctagagtgataatttttttggccccagaaactgtagtcctctattttgagggggaagggagagaggagaaagaccatgtcccttctctgctatcttttggagggtctggagccagagcctgcctcatctatttggaaaggaaaaagattagttgactaggtgagtacctcatatatttcttacgggatcacaggctcctgaagaccaattgatgactaaaaataaattgattattggtttttctgtcattcattaaatggacattaaaggccatctgtgttcccggcaccatgataggctctggggatacaagatgaccaaaacggggttcctgccacaaggagttcatataaccagggagaccaaccttgagcctataacagcaattatgcttgagctaccatgtctgcttgagctaccataacaaaataccacacactgggtggcttaaacaacagaaatttattttcttccagttctactttccagttcttctggctagaagtcccagatcaaagtccagcagggttcagtttcgggtgatggctgtcttcttggcttgcagatgggctgttttgtcctcacatggctgttcttctgtgtgtgcacactcagagtacgtgtgcaagcatgagtgcgctaattctatcagatcagggctccacctttatgaccaaattcaccttaattatctcctatttccaaatacagtcacactgggggtgtgggcttcaacatatgaattgggggacgcaattcagttcatagcagaagcttatagaaaactgtaggtgctggctgggcacggtggctcacgcctataatcccagcactttgggaggctgaggcgtttggatcacctcaggtcaggagtttgagaccagcctggccaacatggtgaaaccccgtctctgctaaaatacaaaaattggccgggcatcatggtagtcgtctgtaatcccagctactcgggaagctgaggcaggagaatcacttgaacctgggaggccgaggttgcagtgagccgagattgcgctattgcactgtagcctggggggacaagagcgagactttgtctccaaaaaaaaagaaaaaagaaaaacggtaggtgcacagatgagggaatggtcatcttgtctagggcaaggcagggacagcagaaggcttagcagagataacacttggtctgaactttgagtatgcgcatggtcatttgccaagtgatgggagtgcccagccctgacttggaggctctggtggtctagcagtgctggtcagtcaataagttattgtcctacataaaaagggacggtctctacctcccaagccttctgtcagtcacatctttattcggtgatatgtgcttattcctcctatgtgatttttacatctgtaagcagcttttcttggaagggtatgtcacaggtttcctgaataatattcagatgtcactcagctttcactgtaacagcctctatgcctcctgcagaggtggttatttcaaaagattcagtgacagagttagaagaagagagtttttgtgctttaaatggctcaagaaataaacatacttgtttctttgtgacagtggggtgtatttataatgagtcatgggcttgctaaagcagagcgtgtccaccctgtcatttcccttctttcgcaaatagtcctggtgggcaccaggttccgtgagcagtcagtgctgagtgtcctcataggtagtactgtgttaagggccctacctgtgggagtagatcttctcagaaggaggaagtgttctggaagctgtaagaaaatgaaccactccttgctttattcttccttcccactcagtttacacttatcttctggcaactggacttttggtccctgatcgtggcttttcagtggccagatgatgagtttctttaaagtacggattgagtcacattcctctctgttgcagccttacttgtcccccagtggtgatcacagtaacccagtagtgattgcttttggataactagtatgatggttgtatatttttttttaagcttgtgttattctgctggcaatttgtttccccagtgggattcagcctctttgcaatgcacccaccagagtctccagctattctcctgcccttggtgtaaggcaaatgatgaccaaagcaggattgcagtccattccattgccccattacccttggggaaatagggcaatgctttaggacggcaggtggtaagagggtttgtactgacagagtaatttccccatctctgggaccaaaaattctgtctttagagacagagaggaaaatgtggggatattggctcaagtcaaaatgaaagccctctcctttctatgatctctccaggtgggaattagatttctgttgcttcaacaagtgggctggagcacacgcttacaagtttagggcagtcgacagcactcagaacagcttctgaaggggctcagttccctgtttactcccttccccctccccggcagagactgttcagaggagtatttgtgagacaaacgtcgggaacagctgctcagccagacccttgtctcctgtgctgccgcagtcactgtgctggaactctctgccgaggagggtggagtgtctgggctccgctgctcccacaaagcaagcattttcctgttttcttggaggcagtttattacagatttcaaccctttctgcatccctccctcccttacaacacgcacactcatcttttcttgcattactgctgaaattatgcaaacttcgtttctctgtcatctgagcgtcattcagaaatgttcctccgatctgtgaattgttccctgacttcaatcggggcagtgttacaggtcctctgctggcaggagggagcagtccgtgaaaatctgcagacacaagactttcagaagctgtgacgagcagactagcaagccacaaaacattgcaagctgaatggatgtcttaataagcttttagatgtgatttggccagcatcagcagaggaggctaacgggaaaaggcagcgaacattgtaacgtaaatcactgcagatttgctgggagtgacagccctaggaagctaatgatctctccaggaaagaattgaccacagttatccagaaactgaacacgatgtagaacagagaggacagcccctcggatgtgagtaccatctcttcaacacaaggtttggagcagtaggagcaaagctagtttatagctgatggcgctccatagccaccagttcctgggtgcctgtgggccatctctgggtgggttgtacataatgcctggccgggacttttatttgcaggtctcttctggaatattttgcttgtcgggagacagaacgtagtggctttaggatattggcaaattctccaaagtataggagaatttgttgtaaagccccaagagaacagcaaaagcaaaccttatagacctttttctgtaaaaagaaaactgattgcatcacagacaagcagctgtgtgaccctctggtatttgtgatgagagacaaaagaattagcaaattacagagcaacaaaaatggggcagtgggctgggaggatggagggaaatcttagcaagctaaatccctatctagattcagaatgtgcattgcatacttatgctcatgtgtttatttcctttttgcttaaagaatgggcagcgtgtttgcgtttaaggttttcctccagaatgctgtgaaaaatgaacattgtgacaaagaggggtgtaattgataggcttggggcagaatacatttctcactgccagcaatgggaagtatcttgaatgatagctgatctacttggaagaggaggctcagatataaggaggggatgaactgctacagccaaggtagccaacaggttggcagtgaagtttaactctttgattcaagactggtttcacccctctattccctttccctcccaatttactgtcaggggttcccccatcccttcttaaactgccccccacccctgcaacacacacatctctatctggtccaatttgtcaggtcagggcatcagatgagaagaagcagagtgtcttctcactctaaggaatgggtatcattgttctagatgggaggtaaggatttgggacttaggaacagtgaccatgagggagggagagaggtggtgtctctgcttggcctgcacctggtatctctgctgggcctgcacccacacccaaggctgaaggtgcaggaagaagcagaaaggaagcagaaaagaagaccctcatttgataccttcccacccacaaactgtgtgtaaatgcacctgcaggtgaaggctggagatcctagtaaggaggcgattactgggcttaaattgaaaatgagtttgagatgtccaagcacatagggatggtgttggcaacagactaggaattggaaagctggggttctgttcctgatcttgcaggcagttttctgtatgactctggtagggagagtatccaaagtcctgtgtgagggacctgttctggaggctgctctgtgggtgctttggtcatggtggaggggatggaatgagagaggaacattcttaagtagctgtaactgaaaagcaaaaaaatagaagggtgtttctgcttggccaatgttttctcaccactgtagtatttttctatctttaaccaaacaaaaaggaaaattaatgtgggctgtgcttgcaaagggctgtttaccagtggtaattatctaaacaaggctatctcagtagcctgcagctatggcataagtgtacttcagtctcagtatccaggaggctgaattcattgcatgggactggagggtgggaggggagtggctatcaatttactatgggccagctggacccctgcatccattgctgaggaggctgcacagcactgctggtgtggagcttgtgacctcaactgatgggctgtactgaggttgcagcaaaaaaaacctctaccctcaggggctaagccatggagcagaatgagtagaattttagccatgaaaatgtttgtatgaactgggctgttgtacttgagacatttaaatacccattgcaagaaaggttctagaatggaagggggccgttgggtctagtgtctagagttaacaaatgggtagatgacgggggggagggtgtggctgtggaagggagatcatttcataagtcatggctaatactctattttcctgccatttaggcctggagtgattttgcaatatttgggcaaacagagcagaagctcagtataattggtttgaacaaagcacagattacctgaatgaaaagaggcagcgcacctatgtttttaaaaacaaaccacttcaaatagtgtaacggtctgggaaagataaagcccagactgtggccgttcagcgtgaccatgagaattttcaaaggcatttccagttccattactttcagtgttttgagtctcaactttattccttctttttttttttggcttgttctatttctggcatatcccagggatctcagaccgtgactcaccaagctgctttacagcagacccttcaccagatctgttttgtttctaatgacccagtgagcaggagcaggatgggtttgcgagagttcctctctctttttctgctattctttacctgcattttgagcaacagatggagaatgatgagaaagtttgataattcacaagagtggggggtaagaattctttccgaagttacagtattcacatctgggccatactttcacataataaaataccctctttaatacccaccacagtcctgggagataaatgttctcatgtctgttttatacgtgggcatttaaccctagcctcacagagtggttggccaaacaacctgcctgaatgccacggtgaacgagttcaaacaggatatggtccagggctttccagccgtatcatggccaattccttaatctttagagactgaaaggacatttgggtgtgcctgggaacaaatgtaaaggatggctgcatcttccagaccttcagagttaggatgtgtggtagggtttgggttgaaggatggtatctctgttgtagcattttctttccatttgtatgtactagtatttttaataagtatcttttaaaatgcaaagaagccctcacttccttgctgttctagcaggactggattagacatttaagtatttcttcttctaccattcacccttgaaataattaccagtggctttggttgggtctaatggcagcccaggtatactggggggagtcccagtctttaaaattctcttcattttgctatgtggtaggaagaattcagtttgctactagttactaccctccagatcactgctctgcgacagggctttagtgttccataggtggttttggtgccacttcttttcctcctgttagcaaggaagcaacatgaccagccccctgcattggcagagccactgttagtgtttagcatctgtgttgtccccaaggtggattgtttcagccacttggaacaaggaattggcccaggcctgtgcccagctctccatctgttccagaactcgtgaactacactatttacggtgaaaaaaggttgaagggagagaactgcagtaaatgctaggagaaaaccccaaagagagaacccactcagcagggtctctgtggggtgtgttccacaggccactgacccactggggaagcggcacgttagccatggtggacgcacaaaatccaaccagggggcctttgatgatcacacacggtacagttccctgccaaaggcggtgtgtaaaccaggtggtgcttaggggattataccaggcctccgctccctgggagaaaaacagagcaaaccttgcagttctggccatactcctccggaggatgtccctgataggggaagaagggagggaagttggcacattctgctgccttccacttggaagttctgttcaggggctttgctgtggagtgtgcttcctgtgtgtcctgcctcccacagctaccctcccctgcaacatgcaagcagcagaatgccttaaaatcacagagaagaggtgtgacctgtccttgtgtgtcaagtggccctgatggcacctttgttttgtaacccctaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaaggtaacaagagaaaaatacgctgtagccattccctgggaactggcctacctcttaaccattgtctgaaaaactgctgtgtttggttcacagctttcaaagaactggcttttcttccaatgatggaggtttggggagaaggaggattattaagaatgcttttgttgccatctttcaagtggagcaacttgtaattagcatttgacagtctttaaaatcacggtggcttttctcacctatttctttagctaaatggagaggagatctcttgggagaagttgggacacaaaagcttactggacagagtgtgcgataatcacgttagatgggcctcccggggaggtggaccagcttgtacacagcccctccactgtgcagagtctcattgtccccgtctgtatgatgacggcctggaccagatgactgctacaacctctataggctttgatttcatgtgggtcagtgaagatgggtggtaagctttggagggcattgcttaccctgcgccaacagagaagactatgaaagataagagaccatactggccaaaggcagttttgtagcaaagccaagaaaaggcaggctccgcgcagctagagggagagtttaaatacactggcaaagtaatgctgatagcaagcacttattgagccctagtattgctgtaagcactttacagccttctagaagagattctcttctcattcctgttttggagaggaggaaacttgtccagggtccctcagccgctgagtggtggaaatgcaacttgtacccacagagtctggctccgaagcccaacctccagtcctccccagaaagagctgtgaagaggggcaaagtttaattttcatagaaggtcacctgttaacttctgacctcctgtggcagatcggtcagctcctattttcatgtttacttatgtgcagttttcacattccatgccggcctccagagaggtcttgagctacttgtaggtccccatggaggtgaacaggggtttgcccatagatggtgattggattgtttggaactgaaggtgaagggggccttaactcagagcttgtgtgatctacccatagcactttccagggcccaggcaatcacaaatgggagagagtgcagactctgtagttagggcacctgctcacagattttaactctgctttgtttgctaattgtgcaagttgcttaacttctttgagcctcagtttcttatctgtaaaagagggatagtaatgtcagcttttcagaattgttataagaacaataacttatttaatgcacttagggcatagtctgcaagttttttctatacatagacttaattatttgctattttataaacagctttattaagatataatttacgttcattaaattcacctattttaattgtacaattcaataatttctagcgtatttataccaccactgctatgcactgaattgtttctcccccaaattcgtttttttcaaccctaatccctaatggtatttagagatatagggcctttaggaagtaattaggtttttaaatggggtcatgagagtggagcccttgtgatgaaattagtttctatgtaagaagaggcaccagggtctgctgtctctccttctccctgctatgtgaggacacagtgagaaggtggtcatcagcaagctaggaaaagggcccccactggaacctgaccacgcgggtaccctgaactcacgcatcccggcctccagaactgaggaacaaatctcttgttctggcaacctgagaagactaatataagcacattcaaatattagaacatttctattgtcacaatagaaaattttatatatatataatttttttttttttttttagacagtgtgtccgtctgttgcccaggcaggagagctcactgcaacctccacctcccaggttcaagtgatccttgtgcctcagcctcccatgtagctgggactacaggcacataccaacatgcctgcctaatttttgtattttgagtagagatagggtttcaccgtgttgggccaggctggtctcaaactcctgacctcaggtgacccacccaccttggcctcccaaagtgctgggattacaggcatgagccaccgcgcctggctcctagtaaaaatcttcgtacccagtagctgtcacttcccattcccacccccagctcctggcaaccatgaatctactttttgtctctataaacttaccttttctaggcattttatgtaaatagaatcatatggtatgtggtcttttgtgtctgacttctctcacttagcataaagttttcaaggttcatctctgttgtagcatgtatcagtacttcattccttttcatgactgagtaataatccattgtatacatatattctgtttatttctttatcagttgatggacatttgtggttgattccagtttggggctattatgaataatgcttttgtgaaaatttatatacaagtttttgtgttggaaatatgttttcagttctctagagtatattcctaggagtggaattgctgggtcgtatggcaaatctgtttaacacgttaagaaactgccaagctattttccagaatacctgtaccattttacattctaccagcaatgtatgaaggtttcagcttctctacaatctcaccagtgcttgcctgtctttttttatacatcatttgctttttcatagttatctttagcaaagattcccattggaattttaaaactattagttcaaatactgctaaaggtttttaataaaaacagtgatcccttagcccagtcccatttacactccaaagaaacaactttcagccttctagatgtttcttttctggtatttgtctccatatttccaatgaatatgtatgttctaccacctgattcaacagtttagtttttttagtgaagtcaagtttaatattttatttatgttatactcgtgtgtgtgtatgtgtgtatatgtgtgtgtgtgtgtgtgtgtgtgtataatttatttaagatatgctcccctctgtcacccaggctggaatgcagtggcatgaacatagctcactgtagcctccacctcctaggttcaagcaatcctcccacctcagctccctgtgtagctgggactacaggcatgcacactgttaattgttaagacagggtctccctacgttgcccaggctggtctcgaactcctggtctcaagtgatcttccctcctcagcctcccaaagtattggaattacaggcatgagccaccatgcctggcctttcttttatatttttaaaatttatttattgtggtaaaatatacatagtaaatgtactacttcaaccatttttaaatgtatagtttagtggcattaaatacattcacattattgtgcaaccatcaccaccatccatcttcagaaatttttcgtcttccccagctgaagctctatacccattaaacactaatttctcatttcctcctcccagaccctggcacccaccattctacttcctgtctctgaatttgactgttagccgcacctcaaataagtggaatcataccatattgtccttttgtgactagcttattgcacttagcgtgttttcaagattcactcatgtagcatgtaccagaatttcattctttgttaaggttgaataataatccattttatgtatatgccacatctggtttatcccttcatccactgatggacacttgggttgctaccgccttttgcctgttgtgaatattgctgtatgaacatgggtatacatgggtgtttgagcccttgctttcatatcttttggttatatactcagaagtgaaatatggtagttctatttttaaagttttgggtaacttccatactgttttccatggctgttgcaccattttacagtgctaccaacagtgcacaagggttcccacttttccacatccttgacaatacttgccttctgtttttgtttgtttgtttttttgagtcggagtctcgctctgtcgcccaggctggggtgcagtggtgctatcttggctcactgcaagctccacctcccgggttcacgccattctcctgcctcagcctcctgagtagctgggactacaggtgcccgccatgatgcctggctaattttttttttatttttagtagagataaggtttcaccgtgttagccaggggtggtctcgatctcctgacctcgtgatccgctggccttggcctcccaaagtgctactatttttactgaccttcctaatgggtgtgaggtgatatcttgctgtggttttgatttgcatgtctctgattattagtgatattaaatgtctttttatatgcttgtttgccatttgtgtatcatctttggagaaatggctattcaagtcctttgcctattgtttaatctggttatttgattttttttggtgttgagttgtaagagttctttatatattctagatattaatcctttatcatatatttgatttgcaacattttttctcattctgtggttgcctttaggagtacttttttagagccgttttagattcacagcaaaattgagaggaaggtccagagatttcccgtattgctcccgcccctaaacatgtttaacctatcccattatcaacatccgccaccagagtgatacatttgttacaactggtgagcctatactgacgcatcattatcacccaaagtccatagtttacattacggcttattcttgtacattctatggatttggaaaaatgtataatgacatacatccaccagtatagtatcatatagattatttttactgctctaaagatcctctgtgcttcacctatttatccccttccctcctcccaccccaatccctggcaaccactggatcttcttactgtctccatagttttacctttttcagaatgtcatgttgttggaatcatacaatatgtagcctttttatattggcttctttcacttagttatatgcgtttaaggttcttccatgtcttttcatggcttgatagttcatttccttttaggactgaaaaatcttccgttgtatggatatactacagttttggaagcattcacctactgaaggacatcttggttgcttcccaattttggtaattatgagtaaagctgctataaacatttatgtgcagttttttgtgtggacatacactttcagcttttttcactagataccaaggagtgcagttgctggatcacatggtaagaatgttttgttttgtaagaaactgccaaactgctggattcccatcagcaatgaatgagatttgctgttgctccacattctcaccagcatttggtgtttcaatcttacggattttgaccattctagtagctttacagtggtatctcgttgtttgtagcttgtctttttactctgctgattgtgttctttgatgcacaaacattttcaagcttgatgtcccatttgtctatttttgcttttattacctgtgctagcattgtcatatccaagaaatcattgccagatccaatgtcatgaagcttttccccttgtagaagctttatagatttggatcttatatttaggtttttattccatttcgagttaattttttatatagtgtaaggtaagggtccatctttacttttttgcatgtgggtatctggctttcccaggaccatttgttgaggagactatccttttcccattgagcggtcttggtatctttgctgaagatcatttgaccatatacatgaaggtttatttctatgctttctattatatttcacaggttttatatatttttattctaataccaactgttttgattactgtagcttttaatgtgttttgaagtcagaaagtgtgagctcttcacagtttgtttgtttgtttgttttgacacagagtcttgctttgtctcccaggctggagtgcagtggtgtgaacacggctcactgcagccttaacctcctgggctcaagcaatcctcctgcctcagcctcctgagtagctgggactacaggcatgtgtgccaccatgcctagctgataataatgagcaacttcctgggcgatcctactgcctcagcctcccaaataccacaattttaaaatcagacttataattattgtgactatgtaaatgctgctcactggttagctgagaatgattacttttttaaaaaatatatatcttattatttttcctggagctgatagttaccctaattttttcacttgtttaatttgatttaaatttattggtaaatgtttcatctactatctgataactctgtaaaaccgttcttagtgcaattctccatgagtaaacctattacatatttatcagcccgagtcttttcctggggatatcccctctggagtcatttatccttctttctgattgatctgggttgctctctagttctgcacagtcatcttgagaagtcctttcacctctcccctgtattagatccctgtttgctggaacccatgtcactctaactttgatactgcacattctttgatttcttcctaagaaagggaatatgtacataaattttttgagagtctgcatgtctgaaactccttattctaccctcttgcttacgggacaatttggtatagaaacctaggcagagaattattttgcctaagaacttcaaacgcagtgcctcatctttgaacttatagtgttgctgttgggaaagtcagcttatagtgttccttgcaactgtcttctgaaaggccttttgcatccactctgccccttgaaggacctgcccattcaggactcagctcaggagccaccaccaacatgaagtccacccagtgaatggtaccctggatggaatttgctctcctcccaattgatgtaaccttgttctctatgcattctgtgtccttcatactgctctgtgggtgctcagaactccccaccacatcatcactgtgacctgggtcatagtgtctctcttacatttatctgtgtttgacagaggagaaaggcactgaatttggaatccaaagaccttggtgtaggcacctgttctgctgcttattaaaggcttattaatgtaggccagggttgttcagccttagcaacatcactgacattttgggccagatcatcctgtgctattgggactttcctgtgcattgtagggtatttagcagcatctgtggcttcttgccatagatgtgctggtagtacttcctttccttggattttgacaaccaaaaatgtctctggacactgacagacatcccctgaggaacaaaatcatccccgcctcagaaccatggattaggccaatcatgacaggagtctctatttcctcacaaaccttagagtttccataagcactaaatgtgatagcacatgttgccatagttataaaatctaagtggacataaaatattgattattttttaactcatccagtgcctagcaaggtactcacatcccatctgtgccgaatgaggggaataatgttattgactgtgaatttcttacactttgatagcaattgcaaggtattaggtactcttgtaagagctctacaacaattaagtattttaaacctcaccatggctattatccccattttacagatgaggaaactgaggcaaggaatgatcaggtaacctgccctaagtttcccttagaaagtgtcaaaactgggactcaaaccctggccatgtggttcgagagtccttgctcccacaggaggcaaggaggaaagttccccttggcccttgaaggctcactgaaaaatcagctgacaaatggcagataaattgtagaagaggcataaaaatttatttaacatgtacatacaggagccttcagaatgaggacccaaaaatgcaggggaaattgtccatttttatgcttaggttcaaaagagtgtggatagccatgtagaaatatgattggacagaaagggcacgatctaatgctgattgcatgggaaacccagcaaagcctgtctgtctacattcttcttggcctttctgagctgagcatttctgccttctaggtatgaggcaggaccctctctggaatggagtgttaagacctacattcaactaggtcagataatttctttatggcttgcttttacgcagaaaggggaggaggggaaggttagagtaatatttttaagttttatggctggctttgagggtagcagattctggtttctatgacctgccttgggggaagagggattctagtttctatggttagcctctggggaggaattgaggggccagagataggagggcaggaagaggtcagagaaaaacttttgcttgtgaggccttccttttgggttgttttttgagccccaacactggtaaccatcatgtttccactatgtggtttataagtttagattgtgaactttctatgggctgctgcttgttagagcatattccttggcacctgacacattgtggatataatctgcaaatgttttattgactgggagctcaatatgcccaggtactttacttaaaaaaaaataagcgatttcccaataatgggattgtacttgtataaaacatttccgaattattttcatgtatatgttgcttgtccccagaggcttgtaagatatatatggtttcccttgagaggaaatgaggtcacagaaggaaagtgacttgttcaaatagggcatgccagagcccagatgagaactggaatgtcctggctcctgtggacattttctctgccacagataagggcatctcttctgtcctgggaattttacttcaactcctagtgggtggttccagtatgttgtccactaagtaaggatggggttgtcatgcacagaacatgtcttcagagcaagtggggttgggagctggaaattgatgtgggaactacatgtaagaatttaaaactcatgttttaagagaaaggctcactaagaactatgattttccatttgcacaactttctttcttttttttttttgagacggagtctcgctctgtcacccaggctggagtgcagtggtgcgatctcagctcactgcaagctctgccttctgggttcactccattctcctgcctcagcctcctgagtagctgggactacaggcgcctgccaccacgcctggctaatttttgtatttttagtagagatggggtttcaccatattagccaggatggtctcaatctcctgacctcatgatccaccctcctcggcctcccaaagtgctgggattacaggcgtgagccaccacacctggccatttgcacaactttcatatttcgaccagttgtacttcatcatgttgacaaacacattttcagctggaacaggtaatctgataaaagcactgggtatgctgagaagtctgagatatctctggagcagattattaaagacaataactcaggctcatgacccttcacttttctgctactcctttcaccaaagtcaccttttccttccctcatctagacaatatattttgagcttcagctgtgcactggtgaacaagacaggaaaaaacatcttggtccttgctggagcttgcattcttggtgagacaggctagaatttgacactgttgcctgcactcctatccctgaagctcccgttgggtctgtcagctctgcctcctggttttcctccccaaggtgccttctccatctccttttgcttttcctgcctctaaaattggctttcctcaggccctctgcgctcatctgctctccctctggacacccacttggcttttccagctcaaggctggttaccatgtctccatctccagcttcgccctgtctcctgatccccaaggccagctgccttcatgggcattttttattttttatttttttttgagacaagagtctcactatattgcctaggctggtcctaaacttctggactcaagtgattctcctcccaggtaacagggactacagtcatgagccaccatgcccagccttcctgggcatctttatgtgcagaatccacaggttcaaatcgaagtgcccacactggaagctgcagcccctcctgaggcctggtcctcttcccaaggtccctttttatcagtacgagggagccccatttgtgcacacctcaagcagaagcccaaagccatcgtttcttcttttgggtctttgacatccctccactgacgcttcctgtcagtgaccaagtgaggctcattatgcctcctaacttctctcaactctgtgtctttctagttgcccctgcaggcactgcttgagatgtttgatactaaaacaaaaaaatgggatatattttttctttgcaagaaagctctggttttataaatgaacatattctctccagttcccttgtgctttagtcaaataccttctgatacagctaattttgttacctcagtaccaacaggtgttttgtcatctggataaatcctctacatgctccttagtgccaagcattggccataacattagagttgagagcctctaggagtccccaggcagagtatcatttcctagaactgttaagaagctggttagcctgggaaacatagtgagaccctgtctttacagaaaataaaaaattagctgggcatggtgatgcacacctatagtcctagctacataggaggctgaggtgggaggattgcttgagctcaggaggttgaggctgcagtgagccatgattgtgccactgcactccagcctgggcatcagagggagatcctgtctcaaaaaacaaaacaacaaaaatgctggtccttggaatgttttactgaagtttttatcttctccaaaaggaagtagacaaaggttgttttatgcaagtttggttaagaagaaaattcagtatcattcataaaattcatctccatttgatacctaccactctccctgagtaacgaaattggaatttagataattaagcacaaaccccagggcctcaaagagcttgttcatagagggtgagccccccagagttctctgcagagtgggcaggcagaaaactcaggaggtgccacagggcaggtagcatggagaccatacggtgtgatctacttcagtttaaataggcaagtctacttctctccacaaatgtatgctttcatttggtgagccaggagaacgacatgggacacatgagactgttaacattggctgcctagcaaggaagacgattagctttttccccctcccgcctccttttttttttttttttttttttttttggaaacagagtctcactcttttgcttaggctgtagtgcagtggcccagtctcggctcactgtaacctccacctcccgggttgaagcgattctcctgcctcagcctcttgagtagctgggactacagacacgtgccaccacacctggctaatttttgtatttttagtagagatggggtcttgtcatgttacctaggctgatttcaaactcctagcctgaagtgatctgcccgccttggcctcccaaagtgctgggatcacaggcatgagccaccgcatccagcctgatttttttcattgtattgtttcagttattaaaataagcatatattaattttgtactttgtcaaagataaagtcaagtttaaaaatatgtgttgagtgcctgcaccagcagtgggccaggtgcttgccatatactatctggttgaaatccttaccacagctctgccaagctagtgctcttatcgctgagataccaataaggaaagggaggtgctagacagaaagtaacttgcccatgaccaaagaagtagtaggtgctagccctgagaaggagccagctttatgtggccctgaggcccacatgtaggcactcctgacccttgtttccagcacctccatagtccttgcccttccaccactatgctggccacccctcagtgcagacagagaaagaagctgtctgcagggtggcccaaagggaattttctcctcccctgtccttgcctcctgcacaccatttccagagttttatagcaagttcagaaattcctgatgaaggcggtgtagtgtagaaggtacaagcgtggatgcaggagccaggtgctctgtttcaaatgccaatgatatttactagctctatggtcttgaggaaataactttgtgcatcatatcatcacctctaaaatgaggattaaataatagtagctacctcattaggttctttaagcactacctgaatcagtatatgcaaactacttagaacagtgcttagcacatagtcagtgtcaaatatagtaggcactgaggggattctgacaatgcaacaatgctaagagctgtggtccaagtatcaggcagggagtcctgagtggaagacacaaggccattcagtatcctacctgaaaagtgaggataatctcagcctcatgagatcgccatcaagactaaatgaaggccgggtgcagtggctcatgcctgtaatcccagcactttgggaggtcaaggctggtggatctcttgaggccaggagttcaagactagtgaaattccatctctactgaaaatacaaaaattagtcgggtgtggtggtgcacgcctgtaatcccagctacttgggagcctgaggcaggagaattgcttgaacccaggaggcggaagctgcagtaatccaagatagtgccactgcactccagcctgggccacagagcaagaccctgtctcaaaaaaaaaaaaaaaaaaaaaaggctaaatgagatgacaaagtgtctcagtgtccaacatttaataaaactatcagctttttggagtagaagttgagaagctgattctaaaatttatatggaatgcagaagacctagaatagccaaagtgacgttgaagaacaaagttgaaggacttctgctacctgatttccggacatactggtatcttccagacttactagaagagtcaaaattatagggacagaaaatagatcagtgattgctaggggctggagatggtgggaaattattgactgcaaaggagcaggagggaattttgggtgggggtgatgaaaatcttccatattttgtttgtggggttggctgtgtacatttctccaaccacatgaaagtgaatactttaaaaaagttgattttgttgaatggaaattatacctcgagaaacttgattttttttttttttttaaagataactctcttaattgttacagatgaggaaacagaagcttcaagaggctgaataagtcctttgtaggttgcttgtggttcccgtggggcttttgcatcatgttgtctccccatgctggtaactactgtactccaatatgaactttaaacttttaaaaagagaaatgcaaagagttcaattgtagtaaagtagtaactttccccagcatgagcacctgatgatgttttcagaaatgaagaggatgcctggctggtaaatattttccggcagccactttcaagagaacgctggaagtcagtaagtggtatacattcatggcctcaagaaacacagtgagaacaggctctgcaccgagaggctctcctgctgccactcgctgggcttcctgctctgaaacctgtttccagtttcgacaaaacctcacttccacgagggatttgcgatgctggtgttctaaggcaggggagcagtggaaacgaaggatcttttgtggtggtcatttgctttgtttttgatttcctgggtttgtgtttaatgttaggacttaccagaatggcgtggcctgaactcgtgtttgccgacctgctggttcctagtcatttgctttaagctgtcactccccaggacgtgggggaaattgacacttacaaggtggttggtcaggtgaaagttttcacttgggagaatgtgttgtatatagcatgctccttccaaaggaccccatacacttattttaattggagtaggtaatggttctactacagaaggcacaaagtttgcctagtcctcctcccatgctgcccccaccactcagtgtttccctccctgaaggcacctgtcttacctgcttcttacattgttcctgagatatttacgtacatacactcaagtagatgtatctctgtgtgtttccccattttatacaaattgtgggatactatactctccttcattttaattggcttaaccaatcccctattgatggatatttagattatgttaatctcctgcccttacaaagcatgctgcagtgactctgtttggaggtcttattgcacagtacgattatgtttgtgggataaatttctctaagtggtacttctgagtcagagcatgcatgcccttgcaattttgacagctagagctaaattgctctgcagagaggttgtgccagtctatactccaccagcagtgtgtgaggagcccaatgggactgacctttaaacacacagtgccagtggtacactgggctccctctgctgcctctcctggcccttcaccatctgagctcatcttacctttctagccttctctccaggagctctctgctaaggtgcatttggcctctggcctcggttcctcttcacttcagcatgggttttgcagaattttctctgggaatcccagctgcctgggaatcaaagggaaaagtgggggagtgactgatgggaggggaatagaagagggggatctccacacctctcctccccttccccatcctccattccgaaatggaaaatggaattccttcccaagatgcctgggtcttttgttctgaccccaagtattccagtgtgttgtcacatccagagcaagggcaggagcccatgcagggctgctgcagtgcttcgttctgctccgggttagcacatccacacactgtgtggagcaggtgtcttttcactgaaacaaacagggcattgagggtatacggttacatggcaagtcaaacaaaatctgcttgtgttctacaatagctagaagcatcactctgtgggaagaaaatctcaactgggaaagcttaggcttttgtagtttatcatcaaaaatctctggggaagattaacatatggtgctaattctgagaaagttataaaatgagcacgtgttaacattttatttaactcattaattaaagaggaaaccagtaagatgatacaactgttttgaaggagaattgtcaggccaggcccagacaattaaaaaaatttttttgtagagatggtgggggtggagtcttgctatattaattgcccaagctggtcttgaactcctggcctcaagagatcctcccaccttagcctgccaaagagctgggtccacaggtatgcaccaccatgccaggctaactttttttactttttgtggagacggggtcttgccatgctgcccatgctggtcttgaactcctgggctcaagcagtcttcccacttcagcctcccaaagtgctgagattacaggcatgagccaccatgcccagccccgtcttaattattttcaactgttcaatccagtggcattaactgcagtcaacacagttgtgtcatcatcaccaccatccatttccagatcttttttcatcttcccaaactgtaactttgtacccattaaacactaactccccttttctccctcccacccagcccctgccagccaccattccactttctgtctctatgaatttgtgatccattttaaagtctctcacaatctttccttacctagaggcaatgaatcacatttaccatcttttcgaccctgcccaagttattagcctccttgagccttcatttcctgtctgtaaaatcagcataacagcacttacctcaaggatatgtggtgaggattatatgaggtaatccatgcaaagtgcttagaacagtgtaattaaggatgtagaaagagctcaacggatgggagttgctattatcatgaagaccatctctccacctgagtcagctgtccttggagacacaaaagtcagtggttctcagtattgactgcacgtgtaaccacctttagagccttaaatactgatgcccaggcccatacctagatgctgtggtttagttggtctgggatatggcctgggcttggggatttttcagagcagcaaggcagagaactactcactgctgttggtatttccccctgaggtttcagagccttccatgcagggcaggacaacactgtccattgagcatcgggccaagccagtggttagacatctggaagttgtactgctctttgtagaacaccatgaaatattgatattctaaatgccatgactcaagctagaaacaagtttattagcaggaaataaatgtctcaaatatgggaaagcaaacatatgctgtgaattgttgtgtggcttgtctatgagataatgcatggaaaattatgggatcaataatatgaaagtcttaagtgttaacttactatgataaggatggtaattaggcatgtaccacagtgactcatgtttctagcaaaggtaggtaggtgtccctaggagatgctctttggaggaaaaagaggcagcccctcagattgagtgggataatggaagaattggtatggcaggtcagacacgctgtaattgaggagaacaagcttcagaactttggggatgggcccccaaagctaactcaagcatcttaggagaggctattaggctgctgttaaagagtctaggtaagagttcatcctgaatctcttggctgctctctcctgcccctcactgcctatgcagaattgcaatgtcttttcctcctgccctctgtaaaagcccaccttatttacagtggttctcagtggcagtgaaggcaggccctgtttgccccctgcttctctcctcaactctaggtaggcttggtgggagtttgggcccagaggccccaccaacccctgagtgttcaatcagcaagccatccaccatctgccaccaccgtgatttgtccatattgcatcctgttgccttagcagattgcacttaaaagtaagtctaactacactgctgagtgctttataacccagattatgtgctagtaaaactccctgaaaacatatatttagtaggtcctaaccactctagacgagacattataatattgtggcacagctgggtgtcagcgtttaaaaatcctccctaaatacctgtacctttcctgaacaaaatgcgttggaggattgctggtttccaggccagtaatcagcatgttgtgaggcttgcatgggtgattctccacatccccaccctggtagtgctgtaaaatgaagaagccaaagagaaaaggagctctcgaagccactgagctgcccacttgggcctctgctcagatgccagtgcaggtggtcttattggcgaattccctgaggccctcttagtagttgtcttctttttcttttctttcttttaagttataatgacttaggtttcagaaaataaattaagccaggaacttgtcgggacactgaaaattctttctcagcaggccagtcagtttgtttctagtgagagtgggctgttacatgtttccttgttctaagccaataatttagggtatgtgggtgaataggtagcagctctgcctagtctgcttttagctcatcttttcagtgaatttattgagcaatgtgtaagaattataaactatgatgaagtgaaatttattccaagtatgcaagactgggtcaacatcagtgtaatctaccatatcaacaagtgccttagctcaggctgctataacaaaataccacgtattcggtggcttaaacaacagacatttatttttcacagttttgtaggatgggaagtcttaagatcacggtgcctacagattcagttcctggtgagtgctctcttcctagtttgtagatggctggcttctctctgtgtggcagagagaggggtctctagtctctcttcctcttataggggcactaatcttatcagggccctaccctcatttcctcatccaatcctaattaccttccaaagggccccatctccaaataccatcacgttgaaagttagtgcttcaacatatcaatttcagggagacacaaacatttagtccataacaagctaaacaagaaaaatcatctgatcatattaataggtacagaaaaagaatttgacaaaaccaaacatgcatttggggaaagaactctcagaaaaccagaaattgaggaaaactttctcaacatgataaaaagcatctaaaaaaaaccaagagctaacatcatatttgatggtgagagactgaatgtttttctgctgtgataaggaacaagacagggtgtctgctcgttcactatagtgctggaagttctagccaccacagtaaggcaagaagaatgcaagcaatttaatccccaaagaagtcctagacatggatggtggtggtgcttgtgcaacattatgaatatacttaatgccactgaattatacacttaaaaattgttaaaatggtagattttatgtatatgcatatttgaccacaaatttataaatcacaaaaaatgggcccaagaataagcagaaaacttagtctaattagcataggaaatattggaaacacgattagagatgcaagttttagaaagtactagggccggccagatgtgatggctcacgcctgtaatcccagcactttgggaggccaaggcgggtggatcacttgaggccaggggtttgagaccagcctggccaatatggtgaaaccctgtctctaaaaaaatacaaaaattaaccgagcttgatgatgtgtgcctgtagtcccagctactcaggaggctgaggcagaattgtttgaaccctggaggcggaggttgcagtgagccgagattgtgccactgcactccagcctgggtgacagagcgagactctgtctcacaaaaaaagaaagcactagggccagatggtttcatggtcctgttttatattttatcaacaagaaaaaatccaatgtttaaattattgtaaagcacagaacaaaatagaaagctgtactttttcatgtagtcagcacaaccttaatgtcaaaaacagatcaataagaacaagaaacaccaatctcaattatgaatgttgatttttaaaattctttataacattacctaatagaatgcagcatttatgagaataataatacagtgtgatcaggtgggttccaggaatgcaaggattgttccataatttgttataccaacaaattaaaagagaaaaacacatgattatattaacagttcctgaaaaggcagtgattcttgttttctggtttttgttagaaaccagaagagaagcaagaacagtccttatatccaaccatagttcatcatgtattggcctaccgtgctgtgctctgtcagcgtcaacccattgaaaatgtagtctggccaggcgtagtggctcacacctgtaatcccagcactttgggaggccgaggcgggcggatcacaaggtcaagagttcgagaccagcctggccaacatggtgaaaccctgtctctactaagaatacaaaagttagcagggcgtggtgtcacatgcctgtaatcccagctactcgggaggctgaggcaggagaatcatttgaacccgggaggtagaggttgcagtgagctgagatcatgctactgcactctagcctggtccacaaagcaagactgtcttgggggagaaaaaaagaaaatgtagtctgggctgccacctgtgaggagtgtgtgggccattaactgatgtcttaccactcagggacaagtgtactgtagaagctgatggaattcttaatacccagttaagttgcctgaaatattttggtccttctttttggtggatctttatagaaggaagcccaaccctagcaattactgagttacctcaaaaggaattcttggccgggcacagtggctcatggttaaaatcctagcactttgggaggctgaggtgggtggatcacttaaggtcaggagttcaaaaccagcctggccaacatggtgaaaccccacctctactaaaaatacaaaaaaactagcggggcatggtggtgggcacctgtaatctcagctacttgggaggctaaggcaggagaatttcttgaacctgggaggcataggttgcagtgagttgagatcatgccactgcactctagcctgggcgacagagtgaaactccgtctcaaaaaaaaaaaaaaaaaaggctgggtgcagtgcctcacgcctgtaatcccaacacttcgggaggccgaggcaggcagatcatgaggtcaagagatcaagaccctcctggccaaaatggtgaaaccctgtctctactaaaaatacaaaaattagccgggagtggtggcgcatgcctgtagtcctagctacatgggaggctgaggcaggagaatcgcttgaacccgggaggtggaggttgcagtgagccaggatggtgccactgccctccagtctggcgacagagcgagacttcatctcaaaaaacaaacaaaaaaggaattctcttatcaattaaacccaattgttaggaataactgattcctaacaatatacatttcaaatcacctctccatatcatttatgattattattattttacagggccatcctaatacttccatccttgtgtgatgggactgttggcccccagtgcaggaattaccctctgcccccattacattttatctttttaaaattagcctattccaatctgagattgttttggatcctgatttgtgtcagccaaggaatttattcccttgccgtttcttgtcaactattgtctgattaagatatgatgtgtcactcatgtaagtagactagtagataaaatatatttgcaacaaggaaagaaaactctgaaagcttcttaaattataaattgtttttaaatgtaaagttttattttctttgatcgatggtactttttcaatttttttctcgaatgtgttccatttttttcttgaatgtcttcataactttgtcttcattgaatcataagcctgagaaggactttgaacttttctgacccaaatttacaccattccaggctgttgaagctctcagggaacaccatctatgataagaggacccttggggcacttagaaaagttggtggagtcttccactttttaaaatctaaacgaggagccaggtggccagaattccaccttgcagttcttgcagttctgccagaaataagattggaggtattgagaattcatttcatctcttcagccaaatgaaactctcaaagactcttcccattctgaatatcatgtttgtaaaatatgcgccactcttattttagtaatgttacaactttcttgcctcctactacctctctcttaatgcgacagataatataggcagactgactcaaaaaaggcttgactcaaaaaagactgcatgaccctgatccaatgtatttctcatggtctcttgaagaaaagaagctttatgaaatgattacactaatttaacctaaattcttcccattacaccatttctccttgtctgggtcacagcatgcagctgccctccttgttacagtccccagtagagatggttaaattgttttattgtttgagccaatgagtctcaattcctttatacaacctttccctactcccttccttcagattttctgcccttttattcctttggcttctgccccaggtctccttttgactctggtcataagaatatcattgagaccaggcacggtggctcacgcctctaattccagcattttgggaggccaaggcaggtggatcacctgaggtcaggagttcgagaccagcatggccaacatggtgaaaccctgtctctactaaaaatataaaattagctgggtgtggtggtgcacgcctgtagtcccagctgaggcaggagaatcgcttgaacccaggaggcagaggctgcagtgagctgagattgcgccactgcactccagcctgggtgagacagagcgagactctgtctcaaaaaaaaaaaaaaaaaaaaaaaaggtgttccaggaatggctaagcaccacacctttccttctcacttttcaggtgcattctgttgggacgggtcttgtccaggtctgctctgttagacctgtcattcctgggacaggtactgttggtctgaaaggcctgccctttagtaagtagggtccaagatactgaagcaggagcgaggagctgggacccaacctgcgtcctggctggagtgatgagggaccagggtcatggccctgggctcccaggccccgtgcagtcagtgacaggggcagttgactggcttgtttctgtaggttgtagttctcaaatggctctggttcgcctccttccgagggtcctggcccctcctaggaagggttttctgacataacgccttggtctacctggagaatccaggaaggaggctgagcaccagtctgacacctgctgggaacaaaaacacctccacttcctttcagggtttcttttaagtggattacctttggctgggctcccttgtcatcctcactggcgggagatcattatcttaacgggaattcttctcctggaagattcccactcccaactgggaattggcctcttcagagtgaatagcagagactgtttcattctaggcatcattgtgatcacttgttcatgtaatttattgcctgctggaatgggagtcactctgatgttcccatgcagcagttatgctggagttagatccacagggctcagcctgaacaaatcatcatcccagtcagtgccccagtggtgtggacagtggggacacatttttgtggttgttgcttcgcaacatctcaagaccctttgatttggttccctggaagcaaggccctgagtctgtgcctcttcctgattggatcagagggagatgcaggaagtcagggtgaatactgcctcttctcctcacccctgccggcctcagatggcccagcctgataccagggccccttgaggaagcagcacctttaaagggtcaaaggcagtggtgataacctccagccacacgtggagatgcactgaaaatgattggataaaaatgataatagttgtattgggttgtggaattatagaggatattcttttccatatttttagtaatgtcattacattgcttatatactctgaagatctgggaagctgtaggttgtggcaaggcagtattttaggtgttttatattgataggctgatgagagcatcaacaagaatgtaaaagagatatggcccttgctggagcaggcctgaagtgcgggtttagcctaagtgcctgtagctgtccagggagggtttatcctggcccctcctcatcccatcctgtggttctcaacaaggtcacacattagagtcacctggggaggttgtataaaaactgcctgggcctcaccacagcgagttgatgagagactctggagggagaggcttacacaccaatacagagaaatgacaacagaccaacctccccaggagagccagatgcagagaaaatagaaaacatctctccttgtccttgagattctaaaaaaatcaggttatttttaaacaaaccccagaggttagtggctgggctaaggtaaaacacccaagaacttgggagctgagcttcctaagggtgagacatgaagcccctgctctgccagagaagaactttgctcctacccttacccccaacacaaccagggcagcacacagagtggtagggaaagcatgcggctgagctcagatggctgacggggtgaatccagactccagttagctgctgtataacttagaacaagtgacagtctcccaagcctcagtttccttatctataaaatgggttcgataatagtgtccacctcataggataattgggaggatagaattagctaacgtgtaaaattcttaagatagtgccttctacgcaataaatggacccaagcgttcaataaattctggccgctgctgtctcttgctctgcccaattattggtctcgctgggctcaccagggcctaggttgagttaagctgaactgatctttgacgataactggggtaggactcagggcaaattgatgctttaaaacttcgtcctttttttcttttctttctttttttaaggagaaggtcttattctgttgcccagactgaagtgcaatggtgcgatcacagctcactgcagccttgatttcctgggctccatccatccagcctcctcagcctcctgagtagctgggactacaggcgcacaaaacaacactcagctaatttttgtattttttggtagagatgacattttgccatgttgcccaggctatagaactcctgggctcaagtgatccacccgccttggcctctcaaagtgctgggattacaggcgtgaaccaccttgcctggcccaaacttcttattcgttaatacatggtcttttctcctgttcccatttcttcctgtggccagtcctaggggcatggaaatggaaatgagagcagttgcatccttaagtctaagtcattcaaaggtgcctctaaggatcaatttttatttgctccttcacccttaagaggggttccagcttttcccattagtcggacatgcctgggggcattcctatgtgctggataggggcagcctcttctccaaagggctctatttttgttgctatttactacagaatgttctggaaaaccaagtacatgtctgctgctttcttgcttttctcctttggtaggtggtgtgtgtttaagagggtgggccttgtgctaggaaagccccaggacggaggagacagcttcagcttctataggaaaccgattactgcctttgctattgctgtactttaatcagaggccagaaaaggagccaagaatgtgcagggaacacagcccctcctcagaaaagctcctgtaccattgtagctcagctcctgaagctctcaggatgtcacacctccttgctgacagggagcctgagtgctgtgcgaggccaggagcattgctggagaatcagggaagtcatagtttggagaatggtgttcttggtgaagaatgcccttccaagaagagacacagagactgggaaccacagtttacgtttcaaaaatggaagtggacaagagggccaggactggctggtgggtacctggaccctccagccatagcccttctggttggaagagatccaactcttcacccaaatctgtttgacattggaaatatctcactggtctttgcgaaggcaaaggtgtagggtgtcgaagagcagagggagtggttggggtgtcctctggggtgggggctaaggacagctggagggaagggagacccatgctagatgatggacgttacctcgtgtccttatttcaagcctgtggagtgggcagtggaggttattcctattttacagatgagaaaatgcttagtttgggggattaagcaccaaatgacacaggtgttattagtcagagctgggattcaaactaagctctgatacctctggcctttcatttctccactggcggttcttcactgactttggattagaaaggtgcctccaatccaggcccatcctgttggtaatttagtttctaaagtgccctcccagaagtgatcttctttgaacctgtcctagtccatttggcctctctaacaaggtaacatagagtaagtagtttaaacaacagacatttgctcctcatggttctgggagctgggaattccatggtcagagtatcaggaggtactcatgcatctgggaccccaagcacagcaggaggatctcttgagacacacacacaaaaaaacgttgccaggcacatggctcacacctgtaatcccagcactttgggaggctgaggtgggaggatcacttgagaccagcctggccaacatggtgaaacccgtctctactaaaaatacaaaaattagctgggcatggtggcacgcacctgtagtcccagccacttgggaggctgaggccagaggattgcttgaacctagaaggcagaggttgcagtgagccaagatcgcgccactgcactccagcctgggtgacaaagtgagactccatctcaattttttaaaaagtactcctgggtctgttggcctctttccagcctccccaggcagcttctctccttgctggtctgtattttccagctgcccagaagcacttgtgtcccaccatgctgtcacctccctcatagcacacacttctctgtcctcatgtgatgaactcccctgtgtttcagaatgtcttaggaaactttgtgaagggcacatactcaatgtcaagaagtccttgacaaggatatgtggtgacagatgaagctggggaccaggcccagccagtggaacctggtcatgccactctatctgatcagctatgatttcattggaagaatcgaggttagggagcacatggctgagcacagtcactgtcagagaaaggtcactcttcatctcagatgctgcctttttctgaaggctttttatagcccacttttttggggagtgattaaagtaagctctgacctctttccagaatcattctagtgctttggtcacatttcatggggagaaattaagatcctttattgtctgttatctctgttttcctccatggctcattacccatggcaaactggtgctttcttgaaatcattaatgtgtatcctgctagagtatcaataaaggcctttgggaagaccttaggggtatgcttcagcatgggtggggccatggttcattgatgtttgaatgtttcttcacagtgaaacttgtaggggaaagcaaaggaaacatgtttgcttgagaatttggagtttggcagggcagttctctagatagaagttgattcacatcaaaaagtgttatttcttctggatgtcacccttgatgtggcaccttgggagccgacatgcttagagcatttgaagcgaatggtcttctctatgacccagcaacagggctaagaaggctactcaggtgcacaaggagaggaacacgctgtgttctgcaacctcctggcattagcctgggtgcccatcaggaggaggatgagtaaataataagtgaaccagaactacatgaataacatgaaaaacaaatctcaaaaatacaaggttagacaaaaaatgccaaattatattgtatagttgaaaactattaggccaggcacagtggctaacgcctgcaatctcagcactttgggaggccgaggcaggcggatcacttgagcccaggagttcaagaccagcctaagcaacatggtgaaaccccatctctacaaaaaaatagaaaaaattggctgggcatggtgacacatgcctgtggtcccagctactcaggacactgaggtgggaggatcgcttgagccaaaaggttgaagctgcagtgagccatgatcatgccattgcactccagcctgggcagcagagtgagaccctgtctcaaagaaaaaaaaaaacaaaggtttgaaacaagcaacacaatgtttatatatattgtctttgactataaacatgtagtaaaaaatataatgaaaagcaaaggagtgatgaataccaaatttgagagagtggttacctctggggatggaagagaaatgagacctgggagttgttcacgaggaatgtcaatgatttattttttttcttgaaatggttggtggttatgtgaagtttagaatattacttatgttttttagtggttgaaatacttcataatttcagtttagtgtttttgtttgtttgttttttaaggcagggtcttgctctgttgcccaggctgaagtgcagtggtacaatcacagttcactgcagccttgacctcctgggctcaagtgatcctcacaccttagcctcctaggtagctgggactacaggcacatgccactgtgcccagctaatttttaaaaaagaaaatgtttttatagagatagggtctcgctgtgttgcccaggctgatcgcaaacccctggcatcaagtgatcctcccacttcagcctcccaaaatgctgagattacaagtgtgagctactacacccagcgtagaatttttttttaaaaagaggaagaaccggccagtcatggtggctcatgcctgtaatcctagcacttcgggaggccaaggcgggtggatcatttgaggtcaggagttcaagaccagcctggccaacatggtgaaaccctgtctacttgaaatacagaaattagctaggtggtagtggtgtgcacctgtaattccagctactcgggaggctgaggcaggagaatcgcttgagcctgggttagcctggcattagcctgggtgcccatcaagaggatgatgagtaaataataagtgaaccaggatgcagaggttgtggggagccgagatggcgtcgctgcactgcagtctgggtgagagagtcagaccctgtctcaaagaaaaaaaaaaaaggaagaacctttcctaatcagttcaatcaacagttttaattttcacctgttactaactggactcctctggggctgatgaccatgacatcttgctgttctcccacctcttgcccaggttcatcatggccacttcattattcctcagtattagcaccagtgagaaattaagagaaggcacaaaacccctcgttttgctacttgatagtctgatgagtggagagtagaaataatgcactaaaggaaatcttcacattttgaacatatcgtgttcattgattgcaatgacaatagccaaggttaactgagacaaacttgaattttggttaacccataagaatctcctgccaatccaaaggggcaggagggagtgatcatccgaaagcccctgtgcaaaccttgctctaggccctctgtctcccaagggagtagcattgaggacttgttccgaaatcattgttcattttgcattcacagcatggccggactcccctgcatcttgctgccaataagggccatcttcctgtggtccagatcttgctgaaggctggctgcgaccttgatgtccaggatgatgtgagtagaagccatcattctatcaggctgagttggcaggggaggttttctggctagaaatccacaaagtgtaagctgtgagatgggagggtagtagatgctctcgcagcacattttagctgcatcttggtctctgtggcagcaagaacttcctctggaagacctgctctgaggcccattctcagtagcaagttagagtttgggagtgtggggtggttctccatcatggttcacttcctgtctattattcaagtgatcacttcctctctattgtacaaaatgcctcaaaggggatttttgcctgtgtcctgtctcagcataaagagacacacacatgcacattagtgagtatgggcaagacttgccggaaatgtgtgtcaatgaccaaatttaccattggagaaaaaatggggattaaaaacttaatttttttctcatcttaatttctcttggtcagtgaatatgacatggaaaatgatctattcaagttggggagttgggggaagacacagatctcatggaatctaagaaaaaggaggcctccagaaagagtttactctgccaccatgctattattgagacatggccatcaaccaactcagctctgagtctattcattcaggttatctagagatggactctgattggctcctctggcatcaagtggccaatcctgagtgagtcagcagtggctggggtggagtcacgtagtacagtgggctgccctactgggtctttggagaaggtggttctctaagaaaggaccatataaattgtcctccaacagctattaggaaaaggtcttttgataatacagttgaaaactatttttagaaatggttgcaacactaattcatgtagtagaactctaagaaataagaacttttatggggaacacagaatgttggagtgtttgcacttataacctcttccaaattcacctttaataactgtagttatagagtgtgattcaaatttcacatcttcagatatgctacagtgtggtttactaaagtgcttctagttttctttgggtctgtgtataatgtcataaaacttggcaaacacacagtaagaaggacagtacttgcaaagaaataactatgactgttttatgcatgggcagaaggccatccagtgtctttcataaatctctggttatatctggaacttgctgggtcatcaaagatgttattttcaaaaaatgttgatttagctttaagccattgatttctaccttaggtcataatacttttttattttcctgcactatggtcatcataacattctcaactatatcatatccttagatgacaggaacaaaaatacaaggagagagaaaagattttggccacagaaaaggtggggaattgagttattactggtgcaaacatgttgggatgcatttggtcttctcttcgcataattaaaggctttgcttgccacagtggcaaggccaaaatgccaggcatgctaacccattccaacttgacacccctgcctcacatcctgggctctaagtatcactgtgttctcatgcagcaaaagccttgctaatttcctagaactgctgctgtttataccaggcaaggtaggaagtgaaacaggcaagaattttcttaggtagccaaagtgagacgtgtcagcagaagaaaagccagctctacttttagacagagagagtcccttttatttattgaaggtattttcttgcatcttttccttgtcctagagagacaatgcatatattgcttctcccagataaattaaaataaaaatacaacaacaagaaataattgggagtggagaaggtagaattgaccttcactagttctgaagaaatgcatttgccagcaatatgatccatgcctgttctctgtgtatttaccatgctgttgatgaccagccttgaaatacatgcaagaaatcaaggaagaaaactcttgatgtgtgtcctttaaagaatctaggagatcagttatttgaaaaaatctcagaagttacctgtcttggatggtgggtagaaacagagaatgttaatgatatgaagaatttactcctaacttcatattctacagatactgatctttatggcatggtaagaactgagaattagttgaagaatgacctccagtggcctggagtgggattattatgaatttcaacctgtggaaaccagttctttagattatgcaactccaggagcaaattctttcttgcttcctgccaatcgtgtcaactctcattggagcgctaatgccatctctgattggtcaatgagcaatcacatagctcccgcctcagaaatagtccaggatgctgtggccacagtgaaagccatgaaagaagacaaaaataagaaaaaccacagagggaaggttaggaaggaccctagaagatcagagagagaaaaagaggtcagcaacttgctttacacacctaacctgtcttgagcttccttgcagtatgtctgcctgtgccacatgggggtgtttcctcttgaagaggcgcacactgcacccttgcatgactgaaatctgccaacactacactcactctttttcaccatgtaggaaagaaaaataacagtatttcaaaacaaagatttagaccttataggcaccaaagctcttaaaatcccaaagtgagaaacactgtctcagaaaaactgagagctggcagttcacgtacttcgcaaatgggtcaacatgttccaaatcaaagtgccaaactgcaaggttgcaggcccttcaggtttccagctacagcatctttccttctgcttcttgtagttaatcattcaacaaatgcttttggggcagctctagtggctatgctttactttatgaaagaggcagtcccaaccccacagatgcatctgaccttttctgaggctcgtcctaaggttaatgacttcacaggttggaagcagcttggggtgagtgcaaagagccttgacaatttgatttctggtccaagcatgctgtcctaggcttatcaataaaatgagagaattagacatcaataaaatgagagaattagacttggcacacagtagggagtcaataaatattcagtccgggcctggtggctcacacctgtaatcccagtgctttgcgtggctatggaggaaggattgcttgaacccaggagttggagaccagcctgggcaacatggcaaaactccatctctacaaaaaataaaaaaattagctggacatggtggcaaatgcctgtggtcccagctactcaggaggctgaagtgggaagattgattgagcctgggaggtggaggttgcagtgagctgagatcatgccactgcactctagcataggtgacagagtgagaccctgtctcaaaatgagtggatgttcaccaaatagataattcagtaaacactgttgagagtgctctaccttttcccagcatttaagaatttcatgattgacttaggtaggtatcatatgcaagtaagaattatgtcaaagtagccacttgtatgtattgaggccacatcttgtttcttcgtgtcatttcaaggaggaaatgtttcaatggtaaattttaatcttataggaggaaagagtccatttgtagataactgaccctgtttcaactgagggcctcaaggtactaaattgtttgtgttgtattctagggaagaatagatccaagatgataacctgaggcagctattgtttacatgtttcatgtctctcacctcagagcctttaattctcatcttggttacttgagaagggtgggtttttcaaagcctgagaaagcgtattgcccagtcctccagaaccattccagctagtgtcagcacagctagcagtacagccaaggacagccacttttggtagggagagtccgagcctggcctgacagcagtgtttatctgacccgggctctcggtgaggtctctgtctgagaggacggctggagggggagctgtggcctggaaacaggcaggacagccaaaaggtcccccagaggaaggggtgtgcaggacctttgccagcagcttaggacactatgtgttctcgccgcaacctcacacaagtcattagatttccttgagtcttgctagtctggaaatgtcctcccaaggtctgaactgaaagttagattgagctgcttgcattgagctagagtttcacaaaggaaaattttctcaaaggaagcaaatacagtagattgatgatgaaagcaagtaataaataacttggtgccattccggctccaaagatacctcaactcataatttagagggcagcttgtgaaacatgacaaaaaatatttgacctaaaccaaggcttaggttagtctgtgccgtaccatccagtgaaggcccttcgtgaaataatttgtacagcaagagtggctaacacgacccatatgctcagggcttgttgctcatacttcatgaacaatacagagtgataagctttgtcctggaaaaagttgtttttattggtccaaagagcactagagtgtaagtagtttgtggttatattaaaaagcctgtaagaagtggaaatctaaccaagtcagcactaccctgaaagcgtgagctgcagtcgcgtggttcttgctaagaagggcactgtctttcttagcaggtcagtaatcatcattgcactggaggcctattttgggaaattccgtcaccattctgatagagaaatgggaagtcttggaaatcttacggaaattttaaaaagttgagacgtggggccaggcacggtggctcgcgcctgtaatcccaacactttgggaggtggaggtgggcagatcacttgaggccaggagttcaagtccagcctggccaacatggtgacaccttatgtctactaaaaatataaaaaaaaaattaggcatggtggcaagtgtctgtaatcccagctactctggaggctgaggcagaagaatcgcttgaacctgggaggcagaggttgcagtgaaccaagatggcaccactgcactccagcctgggcgacagggcgagactctgtctctaaacaaaaacaaaaagttgagacttgggcagtatctcatatgattactagtttccttgtctagaactgctttctaagaggtctgaggtagacagcgcaaatggcacagcctacctcctgcagccactgacccagcggccacattctttttttaaccactgcaagggttctctttgaataaggggtctgggaaggtggatgagaagaaaatcagcctgaacctaactgataacaggaataatagtttaggatgctgaaggggggaggtcggtggtggcagtgctgaggacagtgatctgtcctcagtgtcctgaccccccctcactgcagaaattccttaccttccacaaatgaacagtgggaagagagtctgtgacagggacagtcctgttactggggtattgtttctgctcagacttctaataagtagcggtttttcctgatgctaaaagttatccgtgttaaatataaaaagctggaaaatattaaaaagtataaaaagttaaaagagaaaaatcctttcatggatttttaaagggagactttttaattttaagaaagcaattttgagttttaactaggattttttattgtaataaaatatacatagcattaaatttactgtctgaacatatttacgtatacggttcagtggcattaagtacactcacattgttgtgcaaccatcaccaccatctatctttagaactttgtttcagattacatgtttttaatgtgcattgtttgttacagatctggggagtttagtaagtagaatcagtatttcgttaaggttgtttataggtagcagtgcatccttcttttaaaaaatctgttttatcttatgatggcctctgtcctcttttgggccaagcaccagggacgccccagaatgttttctttgcccctctggtgctctgccaggaaacttcacaaaactctgaccagccacatcatagaatccaagaaggcaatggagggaccctgggatcatccagggtgacacacctgaggtccagcagggtgacaggcttctagcaagccatgcacagcccaggcctcctgaccccttgtctcgtgctcattgctttccaccagaacatttccacactgcccacccatcctccctttcaaggctggaccacaggctcagcttgatttacctcaacttagcttcctgaggacctgtcagagataaagggtgctcttagagacttcagaactctcctgttacagtcttgacctgcttacctctgggagtgtttcatccttcactcaactgcaattaggaagagtcaagttccctttggcgcctaaaggagaacaacggccggcaatcccaggaatccgatcatagagaagagggctcagagtgcagcataaatcagtgaggatgttgtcatgaactctctgaagaggcttcttagaaatatgcagtgatagctgcagtccctggagtcctcagatgaaatagggcaaacccctgcattgccgttgactagtacaggtcaatgaacaaatgacccgcctgtcatcaaatcatgagtgctgctaactggcagagctggacagtggtccccctgcaagctggaaactcggcaggcagtagagattccaggcattgctgctttaattgcatagcacacacctgccctcacacccactcttcacacctgtgatagtcatagcccctggatggcaggagagagcctgaccctcattttgaggttggctctgtggccgagggctattcttgctgtcggcttaaggtccccctcttagtttatgaacaaaatttctctgccagcgtgcgttgtctactaacaagaccacaaagcccgccttgcctgtggtaaccaagcccttctgcgaataaccgctctgctctgtgtggggacgggaggggtccttgtgtccaagtgtcaagtgagtagtgcaagcagggggtgcaggggagctgactgctgttcctgcctttgtgtcactttgcagggggaccagaccgccttgcaccgggccacagtggtggggaacacggagatcatcgcggcgctcatccacgaagggtgtgccctggacagacaagacaaggtgagtggacactgagcttccttactccccaaggcaagggaagccagtggctcaggggagctggaggagcccgctctggaaacttttgagtcctcgaggtattataattcctgtcttaccacttatgatttaacatgattaaatcagcctaaaattcctttgaaacactatctggtatcccagccaattgtaatttttttttttttttttttttttggagagagggtctcactctgttgcccaggctggagtgcaatggcatgatcatagctcactgcacctggaactcctgggctcaagtgctcctcccacctcatcctcccaaaatgctggcatgagccattgtgcccagctgccaattgtattttttaaaaatctttttccttgttctatggcaccagtgacaaccacataaatcttaaatggtaaagaaaaaaatctagaaataaggacctatgtaggcctgggtcgggggggtaagggatgtgccccagactttctctttactttcttagataagtgagcaagttaatttctttaaactatattgcagggaaaaaaaagtaagctcaactgggccaaacacagtggctcacgcctgtaatcctagcactttgggaggctaaggtgggaggattgctcgaggccaggacttcaagaccagcctagtcaacataacaaaccactgtctccacaaaaaatttgaaaattaagaaaatatatattagcaaggcgtggtagtgtacacacctgtagtcccagctactcaggaagctgagatgggaggattgctaagcccaggaggttgaagctgcagtgagccatgactgcatcactgcattccagcctggacgacagagtgagaccttgtctcttaacaaataaataaataagattgatagatagatagcaaaattggccaggcgcagtggttcatgcctataatcccaacactttgggaggccaaggcgggcagatcacctgaggtcaggagttcgagaccagcctggctaacatggtgaaaccccgtttctactaaaaatacaaaaaattagcagggcatggtggcgcatgcctgtaaactcagctacttgggaggctgaggcaggagaatcgcttgaacccgggaggtggaggttgcagtgagctgagatcgtgccattgcattccagcttgggcaacaagagcgaaactcttgtctcaaaaaaaaaagaaaaagaaaaattgattatttaaggaatcctaatgacttcttacatattaacctaatgtttttaaattttcaaacaatcttaaaacacaaaacttcacaattaagtgcaattcagcctctgcttactttttttttttttctttaaagaggctatgctgggaagaactctgctttactttttaaaaataacttttcattaaagtataatatacatacagaaaagtggacaaataagtgtgcagcttgttgaatttcactagcagaacacacctgtgtgagcacccagctcaagaagcagctcattgccagcacccagaagccccataccctgtgccccctgccccttgcatccccgctttcctttggcttcctccttctgcagtcagtcccactgcccgggccacacaccgccaatacagttcccagcaaccaccccatcccctggcctttgagaccctagacttccccttgtggaggtcagctgtgttaggcctttatttttagctgtttctaggggcatggatgtggttgagttaaagctgaagccagagcctggatgtaattggagaatgcacctgcactgacctctgctgattgccctgcacccttccttctccgggctcttccctccctggaactcctgccttcccgcccccaccccactcaattcattgcacttaatgatatttatttgtttaaaatagtaagctaagcaaatacgagctatgttcattaaatgacttctatttaaaagcaacacattaggccgggcacggtggctcacgcctgtaatcccagcactgtgggaagccaagtggatcacttgaggtcaggagttcaagaccagcctagccaacatagtgaaaccctgtctctactaaaaatacaaaaattagcaaggcatagtggtgcatgtctgtaattccagctacttgggaggctaaggcaggagaatcgcttgaactctggaggcagaggtggcagtgagctgagatcacaccactgcactccactctaggtgacagaacaagactgtctcaaaaaataaaggccacacattgaggatacttgtttgttttatttccaaatcactgtttcctcagtccctgttcattatttgtttggggccctgaggcttttgaattaaggtgggtgagattaagtttcagtgaaaaaaagttggggaatcgatcaggcccctgaatcttatgaagatggcctcttcctttgcctgatctttgcagggttctctctgatgccaggagcagagcagactctaagggtggtggaggtgggaagaaatagatggcatgctatcctgatgatgctttctgttaaacgagagctgtggatggggcctagagcctctctcaactggggttcctagagagacttaacctctaatgccttatgaacaatcatccatggttcgtcatggattcatttctcttctgtgcatctagaatggttcttatgatgtatcatttctgggataatggagaaacttaccactcaaatcatcttctgtagtctgtggctcagatgagaaagtccaattgagaaaggccgtctggtgttccgtaaaaatccactgtgatgtattgatcataatgagaagaattaggtcttgggtaatgtgcctttcccacctgtgtgtcttccttaggatgggaatacagccttgcatgaagcatcctggcatggtttcagccagtcagccaagctgctcattaaagcaggagccaacgtgcttgccaagaacaaggtgaggcctggcagatgctagaatgcctcattcacaggtgaggatggctgtgggtttctccccctgtgggagccttcttccagtgagaagagtgagagcccagagtggcacgaggaacctgaaggtccattcggcccagaagtttcatttgcagaaaaggctagaagctgattgatattccaggtcaggagcaagtgcaccaacagcgccaaaaccctgcttatgtgagaggcccctgactgctgctgggaatctacatgcgattactgtcccatagtttttttgtattcaaaaaatatggcaatggagttggcattaaaaaaatcagcaaaagaactttaaaatgctaataccgaaaattagtaaagtgggctcccctagatgctgctgggaaagtgtgatacgaatagccacctttgggagacaatttggcaaaacaaatcaggagccttaaaatggtccttttttggcctggcatggtggctcacacctgtaatcacagcactttgggtggctgaggtgggtggatcacctgaggtcaagggtttgagaccagcctggccaacatggtgaaaccccatctctaataaaaatacaaaaattatccgggaatggtggctcatgcctgtagtcccagctacttgggaggctgaggcaggagaatcgcttgaacctaggaagcagaggttacagtgagccaagattgcaccactgcactccagcctgggcacagagtgagagactgtcgtgggggcaggtgggggcgggggtgggccttttttggccaggtgcagtggcttatgcctgtaatcccaaacttttaggaggctgaggcaggcggatcacttgagaccaggcattcaagaccagcctggccaacatggtgaaaccctgtttctactaaaaatacaaaaaattagctggatgtggtggtgcatgccgtcatcccagctactcggaaggctgagacacaagaatcgcttgaacctggtaggcggaagttgcagtgagcttagttcgtgccactgtactccagcttgggtgacagagtgagacccggtctcaaaaaaaaaaaaaaggtcctttttacttggtacctacctttcttggactctatcctaaaaaggtaataaaacctgctattgaaatgaaatatggaaaagaaaaaaataagcaataaaaccagtaaaattttaccgacaaagatgttcatgacagcagtagttatatttttttaactgtggggagggagacttagaattatggttcattcatacagtggaatataattaatattaaaatcgtagttttgaaaataatgctttccactgttaaagaacatcacaaagagatataagatcatatatagtacatgtcccagtgcttaatataaatttgtgtatttaaaaatttaagcacagaagaatatcatcagaatattaacagtggttatctctgggaattgaggctaagattgatttttatttttgtacctttcccaaattttccaaaatgaacccattatttcttttacaattgggagaagagactttttttttttttttttttggatacagaatctcgttctgtcacccaggctggagtgcaatggcacactgtcggcttattgcaacctctgcctcctgagttcaagcgattctcctgcctcagcctcctaagtagctgggcatgtgcccccacgcccggctaatttttccatttttagtagagatggggtttcaccatgttggccaggctggtcttgaactcctgaccccgtgatctgcccgcctcagcctcctaagtatctgggcatgtgcccccacgcctggctaatttttctatttttagtagagatggggtttcaccatgttggccaggctggtcttgaactcctgaccccgtgatctgcccacctcggcctcccaaagtgttgggattacaggcgtgagccactgtgcccatgccaagagatatactttatctcaaaaataaaaaagcgttatcagtactctggagatatttgcagttgaggtaagaagggtcataaaagggcttaccctcttttctttccctggatggccagattgggtctgtagcaggggcctgagaatttcccacagtgcactgccacatcacagagtggtagcttcagctaatagtggtaggataatgaatcaggtgggctagaatggggttctaggtggcagtagcctggggacaatgggcagcagtaagtaccctccctaatacacacacacacactatatatatatatatatgtacaatttcatggccaagtcaaatctgaaaccatagtatctctagcttatgacacacagacatctgcatacaagatcttcaacagcaatgccaggcaaatcaagctatagaaatataccccatcaatgaagtgacttctccagaccttgcatgctgcaggaaatagaaatgacagcctgaaactcctttgtgaacgtaatctctgtgggagcaagagaacccacctcagtggctttgccctccggtgaaatctcctggctctcactacttttccattggttcattagagagcatagttaagcaagccatgccttcgtcattttcatccgtctcccctctccagtccctcattacatcttaggacatcttcaagtctcacacctgttcctctttccatgctcattcttaagcatgccctggattatttcagatgcctcaagcagattggcaggctcaaatctagtccctcctttcatcctgctcttcctctgctcagcgaccttctcataaagctcctgtctgacactgtctataagcctctgctggcccacctctggagttcctcctggctcctttcccctagagcacctcctgtgccctcagagtggggctcactggcctgcttctcattcctgcctatagacctccaacctggccccaggccctctccctccccgaagacccactgggctgcttctgcaactctcccttggcaccgcatgcagctttgtgctgtcgtttcctagttcatatttttcatggttccctcatggatcaaaagcttgaggtctgagagcagcaagctacgtatggtaatatcgccggtagtgcctggctcacagctcaggaggtgggtggctgcccatttcttcaaaatgcatatggtctggaacaggagttgatggtgtgtaatcacttttttttttctttttgagacagagtttcactcttgttgcccaggctggagtgcaatggctcaatctcggctcactgcaacctccgcctcccgggttcaagcgattctcctgcctcaccctcccgagtagctgggattacaggcacctgccatcacgctcagctaatttttgtatttttagtagagacagcgtttcaccatgttggccagactggttttgaaatcctgacctcaggtgatccactcaccttggcctcccaaagtgctgggattacaggagtgagccaccgaacccggcctgtaatcaccacgtttttttgtttgtttgtttgttttgagacagagtctcactctgttgccaggctggagcgcgatctcggcttgctgaaacctctgcctcccgggttcaagctattacgctgcctcagcctcctgagtagctgagactacaggcacacaccaccatgcccagctaatttttgtatttttagtagagacgaggtttcaccatgttggctgggatggtcttgatctcttgatcttgtgatccacccacctcggcctcccaaggtgatggattacaggcgtgaaccactgcacccagcccagaaattgtttctgtgtaaataaaatggcttcagaaggacaggtcaggaaactcatgcgtctcaaagggagggacattttgtaccagccatagcccgtagaaagatccttcttattcagcagatgtagcagctcctgtctgggaaatcagtacccactactcagggtggggaaaaacgcctgctacatatatatctaccctaggtcacattttctaatgtcaggttttgagatataggtatgaagtcacgctgttctgtgagttttgacaaatgtatacggttgtgtaacccccaccataagatatagaatgtttccattgccccttaatgttcctttgcgccctctggtggcaggcccccagtcaccctctcccagccccgggcaaccacggatctgttttgcttgttcataaaggtcatgtaaatggaatcatacagtatgcggccttctgtgtgtggcttcttaaacttagcataatgtttttgagattcctccgtgtcgttacatggaggaatggttcacgcctctttattgctgaggagtattccattgtgtggatctaccacaatttgtttatccaaacctatggtttttaattttcttggtgcaaatgcttttccacatcatcgatatttccttattggcaatataagctttggtatgatctatttctagaggcatcagatttctttcatttcactcatgtattcaacacgtatttagtggttgccatgaagcccataacttgcagacaacttgagagtagtgtttttaaaacctgggcagaccccttgttgctgagaactaaactagcagtggttctccacctggctgcacattagaccctcctggggaactataaacaaacgaaaaaggaaaaaaaacaaaacttaaaaaaaaaaaaaacctgaagaccaggcctggggtgatggactgtcccagtttgccctgggctaaagggtttcccggaatgtgggactttcagtactaaaatagggatgctggatacccatccccaaggccacataaatcagagtccctagaacggttgtggctgtgcacagggctggtttgaaagcttccccaggtgattctaatgtgcacccaagggttgagaaccagcgagcctgctagaacctcaggcctgtaatcctccctgtgcctggaggtaaaagtgagacaaaaggtccaccagggctggttggagctaaggtgaagagaagggggataagcaaactggccgcatccagtattcctctattttttttttttttaactcatttctctttttaaaagatcaggaatctgatatactggagtatcggcagccaggactgtgagatccagaagggtgtgaactaggtgagggagaagcaatgaacaggcagtgtaatgctctgagcccacgcacctgcaagcctgacccagcacttgagctcagcagaaccaacgcggagcttctgtgtttaacctcctgagtgcttgcaggctcttggatgacacaatgtcacctatcacacggccttgctttcttgttacttttctaggggttatcagcggcctcacatgccctactcccatagactcaaaagttctgttcatgtcctgcaattttttcctgcagtattgctatggaccttattctgacccttggttgtcattgtgatgtggtttgttgaggttctcaaaaacaagaaggacccaaaaagcaagagggtctcaatctgtgtcctaagtgatagatgcaactgtactgcctgaaaggcagggcctggtgtccatagttaaaattttgatgtttcaagaaaaatacaagaatgggtgacttgaaaaaggctaacaagttaaatctcagttgcattagcctgcccttccaggaagtggctagttttactttttttagcccaccattggcagggattgtaaccacagctattgcccatgtggggcaggaagtcatctgataggaattgagtactgtgcatgtgtccagcattgtgtgttaagaaaacaccttcctagacactctgagtcaatccccatagttttaggatgtgggggtcatgctccatttcccaggtaaggaatttgagcatttgaaaaggctggcttttagttagtaagttgcagagccaggacttggaaccaaggttttatgacaaataggactcttctgcctgttcagactccaaattaaatgttcttacctctgaagcatccccactgaaaccatcgggcaagaggcagagaatgtgagcgttgccttttcccccgagtaagtactgcccctctgcaaggcatgcaagtctgtgcggaagcatgttgctaatatgtcctccctctctctgcctctctccaaggcggggaacacagctctgcacctggcctgccagaacagccactcccagagcacgcgcgtcctcctgctggccgggtcccgcgctgacctcaaaaataatgtgggtgaacaaaaccagattctcacgttctctctttcttgtgtcacttcagaaaataacttcatgagcatacttgaaccttaacatctagaaattaaaatgtaaaaagtatttggggactatctctaaagtgttctttttttggcaattttctaagggatcattcaggcatgtgagaagaagaatcaaaagacttggaaatactgcttttctcccatcattttcccttcatgcctcatctttggtttatcatttcttacagtacgtgtctggccaattacagactaggaaaccagttaatgttttaagaaagtctctacccacatagagtgttgagtgttgtactattatcagcaaatatgagctggtgccatttacaggggaggtcctctaatgccccatgcccagcatctatagcgagcaggtcctactgatgactgaggcgtccttgggatgagctgaccggaaaggtcacatgggtatcgcttcttcacaaagaagctgtatttcctttataaatcccctgccttagccacgttggctaaataaataaataaatctgaggcttctttctaaagtgtcctcaggtgagggtctccctgtttggggtagactcatctaatgctctgaacctcagctttgagcttggttccgtcttaatgcaggggagaaaagtatgccaagtggccagtgttctccagacagagctaggatggaaatggcaagaaaacactgcaggcagctttttgtctccagttctttattgtctttgtgggaacagggttctgcctgttgtgcttactgagcatcctgcccctgagtttttcttcataccctttttttgctcccagtgattgcttccttatgagctcccctactacatagctccatataggatattggggtccaactgaagtgggatactccttgaacttcagggggtacgtgtaatcttaagatttgacaacccccctgctgccctgtcctttcatccatgagggatctatgctgggaagggctcatttccaaagcaatgctgttggtcttaagtcagtatactactgaccttttgggttgtagggaggctagggtccctggatcctcctcaagcacaggtaagcagagcctgccttagctcttggaaaggtctcatggggagcagacgtctagtttcataaacgtggaagcagtgattctgtgaccacgtggttgttctgcacaggcagaaagggagcagggctgcccacagcagcaaagaatggcgagccttggggtggagcatctatgttaaaagagctgcttatgattccctaaagagtacatgatagtctgctagcttttaaataacattttctttctacttttctctatttgttttgtaactgctcagattgtgcttagagtttgatttttgtccgcaggcaggagacacctgtttgcacgttgctgcgcgctataatcacttgtccatcattaggctcctcctcactgctttctgttctgtccatgaaaagaaccaggtcagtgcatgtattctcttcatggctgccagcacccttcccacaaggctaccggacaggtctgttagtgcaaacgggagcagaggctgctgggaagctgccatgtcacctacctgggactcagccagcagtgggctttgcatgggtgtcacactgagttctagtggccctggcttatctggcctgctagagaaagtgtgcccttataattcctgtgcatatcaccacatttgcatattgaacattttctggagatcctggggcaggctttgttttttaaatgtgattttaaaaagaaaacccacgaggaagaatgtgatttagtaaagaagcaagggaggccgggtgcagtggctcacatcccagtactttgggaagccaaggcaggaggatcacttgaggctaggagttcaagaccagcccgggcaacatagcgagaccctgtctctacaaaaaatttttttaaaaatttggccggccgtggtggctcatgcctgtaattccagcactttgggagactaaggtgggtggatcacttcgagttcaggagttcaagaccggcctggccaacatggtgaaaccctgtctctaccaaaaatacaaaaattagccaggcgtggtggcgtgcacctgcaatctcagctactcaggaagctgaggcaggagaattgcctgaacccaggaggcagaggttgcagtgaaccgagatcatgctactgtactacaacctgggcaacagagcaagactacatctcaaaataaataaataataagttaattaaatttaaaaattgggcagagtggcatgtgcctgtagttccagctactcaggaggctgaggcaggtggattgtttgagcctaggagtttgaagctgtggtgagtgagccatgatcttgccactgcacaccagtctgggcaacagaatgagaccccgtctctttaaaggaaaaaaaaaaaaacaaaaaaaaaaacccaccaagcaagcataggaattagaagtcttataactccctaagttctgttccttgcactgccacttacttacacttgagctgatagtctttcattcccataaaattgggcatataatctgtagagagtgccatgcaatggggttttgaaataaagctgtgaatattaccgtcttccttagaaatgtgcacaatttccagcagtcattggatttgaaaattagattgtcttggtatttattgacacctatgtggtacattgtttcacttttctttgttggagtgcataaatcttaactaaaaaaaaaaaattagattgtggtgtagattaaaaataccatggaatggtggtttctgaccctggctgcatatgagaatcaacaggggaattaagaatactgttcctggatcccaccccagttgaaagagtcagaacctctgggggtgaggtccaggcaatggtgtttttaaaaagctctctgtctgagtatacagccactgacctaatcaagtagcacggcctccccagtggggtgctagatcatcaggtgacccctgcatagcccccaccaaccagtgcctttcaaccttggcagcgtgtcacggcacttgagagctttaaaaagtccccctgcccagcccacatggtagaccaatgaattcagcatctctgagagtgggacccaggcatcatcattttttaaagctctgaagcttattccaatattcagccaaggggaaagcactgtgcagagcttcccttcaatacacatagctaagtgactcagaaatgaaataaaaattttcccacccctcacaaagatggctgaatgttcatgctacccaggaaaaaagtatcaggcgctttgcctgatcacctgataggagaaagaatgaattgtttcacttctcctatatttgtctggtttatttatatcattgtgtttggaaaatgacagcatttgcatttggaattggcccactaagctgcagttgtctttatcctcctttcatagttgattttgtgaaagcatatttcttgtataaagataatatgaacatttatttataggctatctgtaagatgtagaaaacagttggtcttgagtgaacactggttcttggtgtttccacccgcacaaagcatatcctgagcctgcagatggattgagtcccagtggccccttcagatctacccgctgtagctgcaggctggcctgtcacctctccggtgcttgcagaagtagccatcttcacggcttctcctgctcaatccagcactcagacaccaagcagttttctgacctctgacctccctgggtaaaagaacagagccaaaagtggaatgactagcctgcctgccccaggcctcctgcctgtcctcctgtcctcgtgaggcttcaggtcccaccattctcaacaacccaggccagcattactttgcccctgcgtttaatcctgctgcgtgatttcaggtatcctcactcagaaagaaaggtgatattggtgccgaggtcacttagttccaagacctctttaagtagagcctcataacgctttaacaaagggccccatttcagtctcaggcaaatctcagtttgactttgaagagccacacctaggccaggtaatgaaaagctgggggctgtaggccatgagcagatgaggtttagcagaccttctaatcaattccaggctggagacacagcacttcacgttgctgctgccctaaatcacaagaaggtggccaaaatcttactggaagccggagcagatacgaccattgttaacaatgtaagttgagttgcaacattgctttctaaagtggttcccacccctttccagaatgggatgtgtactaaacccctgcagacccccaggcccagcgcactctggaagacgggggatctctgctggaaccacagcccccagggccattggggtggacttgaagggtacccctgctctgagcagccccaggagttgacaagccttggggcctgcttttagctgcctgactgcagtgaacacaacctggcatgaaaaagaactcagggatgtccagttaaactgacgagtggatgttacccaaagtgagttccaagctgtaaatgcatgtgatgctcagaaaaatggccacatggccctcagtttagtcagcttcaaaattctaaagcaactcctttctcttccactttgcctgacctcactgtttccctttccctctccccctctcactgtgtgtcctgcagatcctagagcaggcaccagctcaggtgcgctttcttcttcgaggctgtcctgcggtctctgcccctctgaatggttcagcagggcctggagggtgcaacagctgctgtgtggaggtttttttgaggggtgtgtggtctgggactgctgaagctggcacaaggctcttcagcttccttggctcctgtatctagctcccctctttctcctcctgccttcttttagctctacaaccagtactgggggtgcagttccatgatgccttgaatatcttccttttgctatcaactcctgggttttggcttcatctcctgagaacctacattatggccataactcgtagttgcttttcatattcaacttcctgaatctctctggccagccctgatctgctcctccggcgtcttcccactgttttccaggggagattaatcactgggctgggcctcagatcctctgtggtgtttccccaactgaaacattccccctggatgctgtctgagtgctacgttccctcccctctttgcagggaagcactccttggtgggtggtacccaggccttggcctcctaaagcacttcttgcccccttggtctgcccttgccctctggtgtcatatattttacttagcgtgtcttccagtgtgacccacctccctcactggagggtctgaggctgatgaccagggccatatcacataggtggccatgttttgccacgtaggtgctgggtgtgactgggtgtggaactgcctgctcctggccagagctgtgccagctgggctatgtgcgtgtgggacccgtggccctttctcacctgtcctactctgcctctcctcaggcaggccagactccgctggagactgcccgctaccacaataacccggaagttgctcttctccttactaaagctccccaggtaggatttactgccctttccatggtactgattatgcgggactacaaagttgttgggactcctggttgcaatctactgaagcctcttcaaactaacttaaatatggaatgtaaccaggcagtggaggtataggcatgcatgggggcccaggatgacgggagtcaaaggcatcaagtccagctcttcgtgttcatgcctgggccgcctcatcttctccctgtggctggatctttgtcacggccagctgcctaggtcatagtttcccagctactcagccaaggaagaagttccagtttaagacatcgcaggacagggccatgattgcagagtttaggccaaatgcccatccctgaagaagtgggacagggactttaagaagagaagtggcattccccagagaaaggcaggagggaggggacgattctgggcagatagtcgcctgccggagatagttaagtacagtctagttttctttcctcttttactgactaatggtattttgaccatcatttaattttttttaaaatggtggctgatactttagttgaggttgacattatctaagtaacaataaagaaatgtcataataatttataagctatttataattctagccccctgaaacaactgtttttgtttcatccacaaaatagatgaaacagacacataatttttacataattgtgcttacaatgtatatacccttttgtatttcttccttttatcctattataaaacaatgttctgcagtcttcataattattcattataatggaggcataatattatttttgttgctattaatagtttattaagccatttccttaatgttggacatttaggttatttccagattggcactattctgtattacattacagcaaacactgattggctttccatcttattctgcaagaagaagataaagtctcagggagtcaaaggaagattttgaacacaaccctgctgcaaaataacccgacaacagcccagggtttgggatggcctttattttgtttaagtttttaaaacgtgcctaatataactagtagtttctggaaatggttaagatttttgtcttttgcaaaattgatcaccttcttgtgcatggagctggtccttctcagtggtctctggaaggccacagagctcccgacaaaagaaagtcagtaggaaaagctgcggggtttccacctctagcagcttttatcgtaagtggaatcacatccatgaatcctgatagaaaaatgctagtctctcatggatctaaaagtatgaagtgctgtataaacgtcagaacccatcacatttctctggcaatttcagtatgtggtaatttaatggacagccagccccaccctcagccatacaaagatcaagtcttacagggttggagggttccccaggcatagaaagattgacggatctttaatccacctgtcatttgtcttccagagcccaaggatcttcacttaaagggcaaagagccttactgtggaccatttccctgtgcagttcttttttgtttccacttaaaacaaaaaaagacttaagcaggtttctccatgcttacatcgaataacaaataagttggatggcatgctatgaaagtttattttatgcataattgtatatgctgaggctttttctcaacacaaacaaggaactttaggcataagatgttacgcatactgttctcttgatctgtggttacagaaatagcattagtatttgctttgcctgaaaagagaaaatccccttgccttaggcccgtagttggacgtggattttaaatgggccacagcagtactaagaggatactgtttatttatttatttgagacagagtctcgctatgtcactcaggttggagtacagtggtgcaatctcagctcactgcaacctccatctctggggttcaagcgattctcctgcctcagcctcctgagtagctgggattacaggtgcctgccaccacacccagctgatttttgtatttttagtagagacgaggtttcaccatgttggccaggctggtctcgaactcctgacctcagatgatccacccaccttggcctcccaaagtgctgggattacagacgtgagccaccatgcccagccataggatactacttttggaggcctcaaggtcaatattccctcacttctgtggactggaaaagattaatgacatcccatttcgtagatggtctggtttgctgagaaaggctggaagccatgcaaagttattttcactgactaatgatatggtgaatggagggaattttgctgattcttattttgggtttgggtgacctctgagtgtcacttgtcattttgattggtgtggttcacgaacgctctgaaagtacattttaggctgatcctggtgctgtattaagagtccatacatcaggtgagcaatgggtatagtcactgtctttcaccatacttgatttcctggtgaatctgaatttagctttagaaatgactcggggaagtggttctcagacttcttggtctaaggactcttttacatttttaactattacggaccagagattgaaggtttccatcaactcaaagatctgtattctgttaaacaccccctgccaattaagccacctgaaggcaggtagggaagcacctgacagtgactgacagtccactgcatgccagccacctattttttcttggtgaatcccaacgactccccgtttttctttctttttcttttttaaaaataaagacgaggccgggtgcggtggctcatgcctgtaatcccagcactttgggagcccaagatgggcagatcatgaggtcaggagatcaaaaccatcctggctagcacggtgaaaccccgtctctactaaaaatacaaaaacaaaattagccaggcatggtggcgggcgcctgtagtcccagttactcgggaagctgaggcaggagaatggcgtgaacccgggaggcggagcttgcagtgagccgagatcacgccactgcacttcagcctggggcacagagtgagactctgtctcaaaaaaaaataataataaaaaaataaagacaaggtcttgctttgtctgccaggctgctcttaaactcctgccctcaagcagtcctcccactttggcttcccggagtgttgggattataggcatgagccactgcgcctgacccgtttttacatttgagaagacagagcgcagagaggtcaaatcacttgcccagagaccctatagccagtagctactgggttcaaactgagatctgttctgacccacctatgtttttctgtgtccattctgtcactctgcactgtaagaggcagagtaaatgcttccttttggggaagagataactgtcccgtggttggtactatggctcatagatacactttaataatattttgaatcaaattgatgtgacttggacacagtttggccaagggaacatctgctgggctagctcaagtccagtgtaccaagatggagagtgagactgtgcctcacacggggctgctgcgttgcacaactccaggagacgccattcatatcctagtttatgtgaatggcactccctggagcacagtctctgtgcatgtagttggcagtcccggcccagcatcagtgtctgtagttattatcatcatagactttaagcttcttgaggtcagggataatatcctacctgtctccgagtccccgtggtgcccaggacaagacctaggaggatggtaggtggtccagaggtgcttgcttgatgtgaacacctgctctcaccctctaagctgtaaattccattaggtcagagccccaggtccaaggagaattctctcacacagatgctgcgcacaccagtggttgtaacaatgccgtttgcctccttcaggtcttgcgcttcagtcgtgggcgaagcctgaggaaaaagagagagaggctcaaggaagagaggagagcccagtctgtgccaagagatgaggtggcccaaagcaaggtggggggcagtcctcccgccgtccccacatccacccatgctcagagggtgggaaactatctccctgcttcggccaggttcacctggtggctgcccggccctctctgcctctcctccttgctggagctcttcaaactgttgccagtctttttctctttggtttcacatcctccattccccaaggtttcaggccatgtgcctccgtgtgcgctgcccattacccgtccagtacacgtggggggcacacttaccagcccaggtatctgtggcctttgcccatgtcctgcgggtagcactgcctctctaacaccatgcccagattgtgtagggcagtggctctcaaaatgtggtgtccagtgtgtcacctgggaccttattagaaatgataattcttgggcctcacctcaaacccacaggatcagaaactcgggtggggcccagcaatctgtgttggaacaagccctccaggggattctcatggggactaaaatttgagagccactggcacaggccacttccattgagggaggggagcaaggctatgctagcctgtatggctcccttatatgaattagaaaaagatgtcccctgggcagacccactgtgcacagggcacgcatggtgagcagagcccgagctgatttcagctcctcttgccccacacctccacctcagctaggtgctcttgtgccgtgtagccctggaataaaccatgcctttgagttcactcaggagggagaagtctgggatatagagacagcttttggcacagaaaatgttatcaccaagtacttgctcttctatctgctatttcacaatcctctcatcaatttccagggttaaggcattacaactctgattaacttcctagatgtgaattgtacatattcagttgtgaacgttctcacaaggaccagaaatatgatattttttcatttcaaaggattcttactctttgccatgagtgttgtgggttggggtgggggagtggggggtggggggggcgggaggggggctgcatccgaggtcaaagaatgagtgagttatgttttgttgaaatctaaacgatcaaaaatctctaatgctgaggtgttttgtgtcgggtaggttcctggtgttctacaacatcgaattggacccaggaatatatttagcttaggacctaataaatacaataaaagccaaatgttcaaccaaccaggaaaacgttctatgttagttaagaccaccaagcagtgtttcctatgtctgaaatttatgttatttgcaaaggttctcgtgggtcccttaccatatggaatcttgcaaagaatatttgaccatattagtgaaaaaggccaaggaagcaaacacaatgggtctctgggctttttccttctgtagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtcaggagacacagaaagcagcccagaggggtggctgggaggcagggtggcgagggtcctggcagagcgtcatgcccatcagctaaaaagccactcacttggctggctggtttggagccagagcacagaaattaaatctggctaacatcagacataaggtgaatgtgctgatatatttcttttgacatgtgtggcttggagtaggacaccatgaggtgaaacaaagtggggctctttgcccaaatggggtgacatgggcgccaccgactggtgtcagtcttgcagaggtcaaagcgttcaggggtgttgtctcttcctctcttacaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggtacctgcaaagcagtgtcaggagaagggaacataggccttcagcaagggtttttgtttaacggcattcctgggggctgataggcactttaggcattgacttagttgagcacaagctttgaaggtaagccagatggcctccccacctgcacggtgcagatccactcctgctgctaaggccaaggcagacagggtgtgtagctgcagagcttgctgcacaatcctcaggtgactaggtatcttgaggccccagggtatataaaagcaccttgaggagagggaccatatcttaccctctgaattttagtgtctgctacacccaaaatttggcctataagatgttccaaagttatgacaaggatgagcctatctcttccatcatctctatcccctggtatactgcctggcacgtggatggtgctcaaaacatacctgatgaaggaatgaacaagggattgattccttttttgtttctctcttaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaagtatgtcataaggcccagcttcctaattgcaaggtgttctggcagaacatgaactcaggaaccaacttcgactttagcacacccttccaccctgggagtgtccagtgggctgtcagggaagaggcctgcttctgcttatgtgattttgttaaagtacatttatttcagctttttaaagaacatgtttaaattgcttattatagaaataagatatccccattacagagcatttttagaaatatgaaaattaggaaaataaatcacctataagcccactgtgctgaaaagcactgttaatatttgggtttaggctgggaatggtggctcacacctgtaatcccagcactttgggaagccaaggcaggcagatcacttgaggtcaggagttcgagaccagcctggccaacatggtgaaaccccgcctcttctaaaaatacaaaaattagcctggtgtggtggcacacacctataatcccagctactcgggaggctgaggcataagaattgcttgaacctgggaggtggaggttgtagtgagcagagatcattccagtgcactccagcctgggtgacagagcaagactctgtctagaaaaaaaaaaaaattagagtttatcttttttgagtttttttatatgtcaatctttttatatgtcaatttttgctacactcctttcccattgcatacaaaattagaataattatgtatttttttcttttcccaactttttattttaaaagttttcaaacatacagaaaagttcacagaataatggagtgaatgcttgtatataatccctgtagtcagccagttaatatgttgctgcatttgccttgtctctctgacacacatgtttttttaactcttgaactatttcagatttagttgcagactgtcctgacagggcatctctaaatatttcagaatgtttagaataagaataacactttcaacttcataacaatattgctttcacacctgagaaaacgttatccagcccatattcagattttctcggttttcgtaaaatagtatttgttacaacttttttttttttttttttttagatggggtctgactctgtcacctagagtgcagtgtggcaatctcagctcactacagcctctgcctcctgggttcaagcgattctcccacctcagtctgctgagtagctgggactaaggcggacgccaccatgcccacctaatttttgtatttttttggtagagacggggtttcaccacgttggctaggctggtgtcaaactcctgggctcaagcgcctcgcctgccttggcctcccaaggtgctgggattttaggtgtgatccaccatgccctgccctttttttaaaaaagtttttgccaaattgattaaggacattttactgtttaagttttatttccttgtttactggtaagatgaaacatttttaaggcttatttgctatctgtattttatagaaaggccattttaaaaatattttcttaggtcaataatagattagtgaagactgttttgtatataaaaaccccacttcgcctagcctaagctgaaagaggaatgagagatgaatgttgggatacctcaagggcctcacttcagttcaagggagtgacagattggggtgtagaatcttagtcctccttccaaatcaccaagaaaggaccgtggcacccttgagtcagatgctcatacccgagccagttagtgtgacctgtgaacaaagcaatgtatacctatggctgctcttgaaaacagccacctggaggaagaggttaagggagtggggagagtaggccaatcctagaaaacaggaggagcacaggtcacaggaaaacatggactgaagagaaaaacagaaggtgctcaccacgtctccagaacggatgtttcttttttcttaatgttttgaacatctgggtgtggaatgccacgtgtgtccctgacaggaggggagctcaccagtgagccttcgcggattggctcttcctaacaatagttcctttcattctttggtccttgtcaaagcagtgaaagtttggccctcctaggtgtaggggtcccacaggaaatgccaagatgaagggtactccagaagggcatgtgattaaaaagtgacaactgcttgttctctgaagcaatcctttaagttccttctacactcttcttacgtactttagctacttccaatgaagcaccaaaaatatttgctcactgcaagagccggataaaagctcattttactgccttgtaggcaaccactaacattttttaaagtggggttggggaagagaaaaatctccatactttgagatgtagttttttcttacagtagtctgggaaataatgttttaaggcctacaaggcctgcatgggctcaggttgtgtatttactggatattcagagtctctctctcttttttttttttttggctcactgcaacctctgccttccaggttcaaatgattctcctgcctcagcctcccaagtagctgggactacaggcatgtgccaccacacccggctaatttttgtatttttagtagagatggggtttcgccatgttggccaggctggtttcaaactcctgacctcaggtggtgggagtatggcgcaccacgcctggcctgtatattcatagtccttatacctcttaaactttaacaaataagattttttaaaaaacgaaacgttggcctcatagaaacatgctcaagaattctgaaagagttccatgagtcctacatgcaaatggaatcagataaggggttgaagtttgcatgcaggggctcctacttggttccccaagcccctctgcaggagctgagaagccagggctcaccctgagatcatctcagtcttacactctgctccacttcactcctagatgcgtgttttggacaagctgatggttgagcgactttctgcagagaggacggagtgcctgaaccgcctgcaacagcactcagacacagagaagcatgagggggagaaacgacaggtaggaaccagcatctgctagtccttaacttatgatttaccacacaggcccactgagctcaggcaggcctgccactgaaaactcagaggctgagactccctaagagcttttacattatatagtgtatcatttttatgatactgaaatgaggttaatagaaaagaacctgtagttctgtttatgtccgtggctgaatatgctggcaacagatgaagaccgaacatgctggggaagatgccatttctgtcctgaactcattccatgtattgtgcattgttaggccattacagttttagaacaagacatagtttctaccctcagggagtttactgtctcaccaagataagagacatggaatgagtacagtgagtgtgtgagaactcaggctttctaagcaaccagaagtacttggtttggaagatttgggtggttttgggggttgagtttaaggtggctctagtcacttaatgaagattgtagatagctctctgcttgggtgcctgctgtggcctataggaaggtggcttaatctgtctgtgttgctataaaggaatacctgaggctgggtaatttgtaaagaagagagttctttggcttatggttctgcaggctgtacaagaagcatgctgccaacatctgcatctggtgagggcctcaggaaattccactcatggtagaaggtaaaggggagctggtatgcacagatcacctagcgagacaagaggcaagagagacaggagggaggtgccaggctgttttaagcaaccaactccttcaaaaactaatagagcggatgggcgcagtggctcacgcctgtaatcccagcactttgggaggcctaggtgggcggatcacgaggtcaggagatcgagaccatccttgctaacatggtgaaaccccacctctactaaggatacaaaaaacttagtcaggcgtggtggtggacacctgtagtcccagctactcgggaggctgaggcaggagaatggcgtgaacccaggaggcagagcttgcagtgagccgacatcgtgccactgcactccagcctgggcgacagagcgagacttccatctcaaaaaacaaacaaacaaacaaaaaaaaaaactaatagagcaagaacttactaaccgtgaggatggtaccaagccagtcatgaggcattcacccccttgacacaaacacctcccatgaggccccacctccaacactggggatcaaatttcaacatgagatttggaggggtcaaatatccaaaccatagcagtgggcaagccataacttttgggtttgttagatggtatcctcaactgttataattgaaaagtccatccttgatgctttaattcataaaccatgtatcaaattcacttgattcttctatgtacttatttgtggggtttgtttttttttttaagatatccttggtggatgaattaaaaacctggtgcatgttaaagattcagaatctggagcagaagctttctggagattctagggcctgcagagctaaatccacaccatctacttgtgagtcctctacaggtaacccacacacagagagcccttttgtccaaaaggaacacgaccagcagctcttgtactctcctgcactgaaaggcagtacgtatgctagggctgtgggaaacactggatggtaaagtgcactctgtaggggcaaggactgtattttgctcgtaaccatatactcagttgctatgtaataataaagcactcatttatgtgctcaaacttatttgaataaaggaattaaagaattgttgactggtgataacattgccttgagtacagtgttgatagtatcagagtggaccccaaagatgagaggtgatgaagatccatcggtctcctcagcagggctcttcctcccttgccttttgtgccttttacctcttccttctctttgatctgccttttacttttgtccaactatgcaaatcctcattaaacagcagttcttacatagaacttgcccccagtgctagataggaaatgctgcaagcaaaccatctttacattagccacagtgattatactcaataatgacaattttgaggacattcagagcctgggtaactaggcctcagtgggggattttgatataagtgctttgtgttaccacaggccatctctggaactgtggtttcatctttgtgtcaacaacatggggaaacatcccaggaaaatgtttcatgctaggactactcttagggcttgtcgtggagctctgggtgtggaaaatggggcctcctttccaaattggagcttgggtcaagcagttagtacactggtagggaataggcccagacattagagaatgggaatacatattctcatagataaatgtccaaatctgctttgagatacttggtgagcggcatcatccttaggcatcaggaaacaggaccagagccttctcaggtagattgaggcgggctgaaggaaaagccagcaacttttttggcttaaatgggaccagtgtggctaacacagaatccatgaaagctctgacaagccaaagtgatcatcagaggagacaaagtggaagggaggaacagaaaggtgagaaaaggctcagaggagacgttacacatggtgggtggtgatggagaaggctggtgatatacaggatccttaagactctaaaatactgacccgcagccatatgactgtgtgaatgtggatttgctctcacgtttgttttccttctgaaaccaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgcgatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagtttgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaacaaaaaaacttaggttttcttggagtctgtgctagttgaatcttgcaaatgcaaaccacatacgctctttaatgaaaacctttccatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatgcttctgtttgtcagatcattttgcaacaggttaactaatacttatctacataaaaacctgaaaattggcacaggcaggcattttgaattagtagattacccccatggaacagtattcagaattattttgtcttgtgggctctgaggctctgggaggtagaggtggaccctgacagtccaggtcattaacatccacattcagttgatgcctctcagacacagtccagtactggataccatttatcattctgcaaaatgttgtctacatctttcaggtgctggtcattcttagattagcttcttagctgttctgttgataaacagaagacttcaattttcaggatggatgattccaacatcttccacaagctttcactttcactaaattattttgttataaatttgatctccttcaaaagtgccttgaagtcaattttggttgtaatgtatttgtctctgacgtattcttcaaattctctttgttttttttcctgtcattggagaactgcacccagaatcttatttttactacttccatgtgaatgttaaggtactcacagaggtttcatccagaagtcttccctcttctttctggtaagtgcttcaatgtgctcattaagcttctctttctcttcccttttcaacaaagatctagattcccagtggtgatctttttgatgagttctctatcaaactatgacacatctgaagaacgtacctgaacaaccctcagggataatgcaggatttttcgagaaagttccagggtatctcctggtgtcagtatactttcagtcctacacctcaagagttttttaataacagctttattgagatacaattcataccttacatttaaaatgtacagttcagtggatttgaatatattcaagagttgtgcagcctacaccacaagctaactgtaggatattttcatcaccctgaaaaggaaccctacacccattagcagttactccattccatctacagccagcctaggcaaccactaatctttctgcctattctggacatttcgtatgaatggaatcatcatgtgatcttttgtgaccggcttctttcacttaacgttttcaaggtttatccatgtttagtatatataagtccttcgtttctttttagtgccaaataatggctatgggcatggggtagaagtgctaactcatacagcagctgtttcatcttttgaggaactgaccgtctgttttctgaagtggctacaccattttacattcccaccagcaatgtatgagggttctgtaatttctgtacatcttcaccaagacttattattatttctctttttaattacagccattctagtgaatgtgaatctcagggttgttttttttttttttttttagagactgtctcactctgtcacccaggctgaagtgcagtggcacgacctcagctcactgcaacctccacttcctgggttcaagtgattctcctgcctcagcctcccaagtagctgggactacaggcaatgcaccaccacaccaagctaatttttgtatttttagtagagatgaggtttcaccatgctggccaggctggtcttgaactcctgacctcaagtgatccacctaccacagcctcctaaagtactgggattacaagcatgagccactacacccgacctcatagtagttttgatttacacttccctaatgattgtgtccagcatctactggccatttgttagtggtttttttcttcttttaagaactgctgagacatccataaacattttcaaaatgcagggtatgtttttcagtgttaaggcaactgttctgatgtgtttttcctttgctctctatcaccaaatactgtacatataaatagtaagactgggctttgtgttgtccattgttaatcctaaatgcaacaaaacacatggagactttgaaaatccttcagaataatgctatagttaagattttgctaaagcaagtgttttttctaactccttgagctgcatattgccttgagtaatcatcatccggattgtatcctgtagaataaagtgaaatctggttatagttttacctggttaaacaaggtatagctataccattttatctgttaaaatcaagaaccaatactacctattggaactgctgccttttagaaaagctaaaagagttccacatacatacatataaaatgtacaacataaaagtcaagtgatgatgctgaagagtgtagatactcttttatctacatattttaaaatactaaattttaaaataataatttaaaatcggtaacattacaagcaatgatcaagatataccagctcagtggcactatattccaagatgtctgctaaacttaaaaaaaaaaattcactgatcaataaaaagggttaggatctgtcctcaccatgattttgttctcacctcttcggtggcacttttgtttcttctgaattcttctcttgcccaatctttcaggtatttgcgatcagaatcatttggaacttgccgaattgtttgcaaaatccttctgtagaggagaagaacttgttgccttcttacgaactgtaaaagggaggagtaaatagcaattactactgcacaatcgccagcctggaaagttctacttcagcaaaccaagctgtaaccagagtacttctcgttggtcaattttgaaaaaggcaaagaaaaacttttttttttctttttttggccagatgcagtggctcaggcctgtaatcccagcactttgggaggccaagatgggaggatcacttgagcccaggaggtctaagctgaggtaagccttcattgcgctactgcactcagcctgggcgagagtgaggccctgtctcaaaaagatgttttaaagaaagcatcacgaggttcatctgatctttttgcttactgctctgtcaaacctaagaaccattaaaaaatcaggagctgcctaccgggctgaaaagggctgccggtctcctagaagttgttattacaacgacagcactttttctaaattaacagttgttcaaatctttggtaatctcatttgctgtttgccacagctcagtgcaatagacttttaccgtgggcactgggcagctgaggcaccgggactcagggaaatcaagcgcctgacgctgtctcacgcgatcgcaccaaaccaaggaagcagccagtgcctcccgtcaggccccgcggagcgaagcaccgccccgcaggcatcgggccaatctcagagggcgcgcacgccgcatcaggaccccggaacccgccccgttggggatagggacagatggagaatccagctcagacccaggtaagctgctttggaaggcagagaaccgccggtacctgctttaacgttagcgtcgctgggggtaagcgggaagcagccatgtccaccagaggtccgccggagcctcagcgcgcaggagcggaagtggggttcgaccaaggggtgtggcgagcccggtttcctaggagacggcccgcgggttgctctcggactgagagcgcgaggcttcgggactgagccctagctgctgcgctggccgaagttttctcgtcggtaaaataggataacagtgcaccatagggtcgttttgataaagaagaaaggtagggcacttaacacagttcctggtaaagagagttcaaatgaaagtgaaggaggccgggcgcggtggctctcacctgcagtcccaagcactctgggaggcctgtaaggtgcctgtaatcccagctcctcgggatgctgaggcaggagaatcgcttgaacccgagaagtgaaggttgcagtgatccgagatcgcaccactgcactccatcctgggcgacagagcgagaccctgtctcgaaaaaaaagttaaggtttttttgggggaaagaggtgaaaacgtatttaaatgttctttcgagcctttaaaaatgtgtatagttgaaaatactaaaattgaaagtgttaatttcttttacagtttgtgttggttttttctctttctcgtttttgtcctgttcttttgtagcgcaaaggttttccgggagcggtggccttcatgatcatttgaaacaaagctttgaatggctcacccacttcagtcttaagcacttttcatcactaataacgaggagcctaacatccctaagcctcaggcttttgcttttatttccttatagttgttttatctttcccacaatacacatgcctttgggttaaatcactagaagtggagttagcgaatctttgccatattaattttccaagtggtgttgtatcgaattaaaatagaacgaaaaatgttcaattactagtttactggggacttgcttgcctcgcctgttagcatcctggggctccctattcctagctgtgttctggctatttcccctctcctggcctattacctcccctgtaaagtgaaatatagcatctacctcagttgtgtatctctaatgtactgagaacaggtcctggcacatgtaagaactctaatcattagctcttttgaactttaccaggcattgtatgaatgatgctaactgcatgatcatattatcaataatatatgccaaattttgtctaatacattagctgtaatagttaattgctaactttttaaaaggagtgaagttaaatacccctcgccatttttagttatactgtttttgtgaattgttcatgacttgggtccgtttatgatgaggacatttatatgggctctatattttttgtcatttctttatacatacagaaactttatacaatcatgtatttttgtgccttttgaggcttttcatttcccattcaggcctttgtaattcgttttttaaaaactttaatttttaaaatatttactccatctagaatttactttggtttacagcatcacgtggatctaagttcttttctagatgttaagctgtatcaataccattgattacataactcattcctttttcggggctttatgatggatgcctttttgactgtatgataaattcttttagggtctgagtaatctgtccagaattgtttcatttagggttaagtttttactttttgttttatatgtttttattatctggcaggactctagtttcttgtaaaaaatccattagtactgttctctataatctttagaaatgttttgtatcatttccctccaaatcatcttgtgatcttggttggaattttgaagtagtgttgaatctatacattaatatgtgagaaagacatttttacattatttcttcttcccatcaagaaacactcaggccaggtgcggtggctcatgcctataatcccaacactttgggataccgaggtggatcacctgaggtcaggagttcgagaccagcctggccaacatggtgaaacctcgtctctactaaaatacaaaaaattagccgggcctggtggcgcacgcctgtggtcccagctacttgggaggctcaggcaggagaatcgcttgaacctgggagacggaggttgcagtgagccgagattgcgccattgcactccagcctgggcaacaagagcaaagctctatttaaaaaaaaaaaaaaaaaaaaaaaagggctcactcttgctagacactggtaatgctgtcgtgagtcacatatgctccttgctcaaagactcatgctttgggcaggaaaacctctaagttcaatatagtgctaacaaagaatgctgcagttcatactgtgggaaattattcttcctggagggcttgtctgagctaggtatttgtcagaaacgcagaatcactaagaggattccagacaacacatggaaacactggcaggaatgctgggagaggagggacaggagagtcaagcaagagcctcacaggtcacatgaagaagcttgaatattaccctcttcacaagggagagctttgaagggattttcagctacagaacttttagaaagatcttggatgttgtgaataggatgaagtgaagcaagcaaagagaagttactggcctggccaggataccattgaagtagtccctgctagagattaaaagagtcccagtcacagtgcagtagggggagggggagggatgggacaggatatccagaagcctgactggacaagatgattaattaatttgattggggtatggatagagatggagaaggaagtaaagcagatgtataggttaagtccca

SEQ ID NO: 409 - DNA, 37380 bp, Homo sapiens
taagaagaaaaacacttgaaaaagggaatctacttatggcacaaaatagaccacataatcactaaatagaggggctgcaattgggcagtttctaccgatggactcctcaaatccaaattgcctcttccaattacaaaaatagcagatttttatttctgtgaaaatacgattaaatgagaggaatcaggactatcgtctaagctctaaagtctgctctgattatttttcagtgatccaaacctatccagccccctaaaatgccttccagtgaacaaaatggcacaaaacacaaccttcaacaaacttgccatatcccaggagcttctttgtagaataggctggggaagggaggagtgttggaaaagtgctaagggtttaaaacagaagtgctgaggtgtcaaagttaggcatgctgactatctggtgctatcaaaatgcagacctaattattgtgtatatgagtagtgcatgtgtacataaatatgtgtatgtatttcctagctctgtctgttgaagaagacctagaagcagtgatgcctctgtatcaatgagcactacacccagacacaatgcagaccttgatttctttttttttttttaagacggagtctcactctgtcacccaggttggagtgcagtggtgaaatctcggctcactgcaagctccgcctcccggttcacatcattcttctgcctcggcctccagagtagctgggactacaggcgcccgccaccgcgcccgccaccatgcccggctaattttttgtatttttagtagagacggggtttcatcgtgttagctaagatggtctcgatcttctgacctcgtgatctacccacctcagcctcccaaagtgctaggattacaagcgtgagccaccacgcccggcccagaccttcatttctaaacaccgttatcttcagttcattggggaaatggctgaggtttagaaagctgaggtttacaaattatgacaagcttggagtattgtgttttaaccaaaagcatggtggtgcacacctgttgtcccagctactggggaggctgaggcaggagaattgcttgaagccaggaggcagaggctgcagtgaaccgagatcgtgccactgcactccagcctggctacagagtgagactccgcctcaaaaaaaaaaaaaaaaaaaagaagtggtggagcaagatggccacatagagacctccagtgatcatccccctcacaggaacaccaaatagaacaaccatccatgcaaaaaagcaccgtcataaccaaaaatccctgtacctggctttaaaattatatcaaggaaaggggcattgaagaggctgggaaagacaatctcgagttgtcgacaccacccctcgctcttccccatcagtggccatgtggtgcagagggagaatctgtgtgcttgggggagggagtgtgaactgtttgttggactttgcattggaattcagtgctgtctgtcacagcagaaagccacacagggcagaattcacctagtaaccacgagggagcatttagaccagccctagctggaaaagaatcatccatcccagcagccagacagaacttgagttccaactagccccactaccatggggtaaagtgctctggggtcctaaataaacttgaaaggtggtctaggccacaaggactgaaattcctaggcaagtcctagtgctgtgctgagctggagccagtggtctttttgtgcacacaacctgtgagacaccagctggggtggccaagggtgtgcttgtgttacccctcccacgacctcaggcagcacagcttgcagctccaggagagactacttccttctgcctggggagaggagagaggagggtaaagagaactttgtcttgcaacttgcattccagctcagtcacagtagaatagggcaccaggctgaatcctgaggcccccgttccaggccctgtctgctggacaacgtttcttgacacactctagccactgtcttaaagagaagtaccggttcaggcaggattcattaccggatgatccaagagtcctcggacttgaattaacaccaccagttgccaggcagtactcaccacaagacttgagtgagatcccgcgccatgccgacttcaggtgtgacccagcacatttccagctgtggtggtcacagggagagactccttctacttgaggaaaggagaggaaagagtaaaggggctttgtcttgcagcttgggtaccaagtcggccatagtgggatagagcacaaagcaggatcctggggtccctgattccaggccttggcccctgagtggcatttctggacttgctctgagccagaggggagcacagtgcccagtgcatgaaggaagagactgaagcctggcagccttcaccacaagctgactgaagagctcttgggccttgagtgaacatcactggtagccaggcagtgatcactgcaggcctgggattgtggtgactagggggagagactccttctccttgagggaagaagatggaagagtaggaaggacttcatcttgcggtttaggtgccagctcaggcgcagtggaaagagcaccaggtagattcctaacgttcccaagtccaggccctgcccagacagcatttctggacctgccctgggcttagggagagctcaccaccctgaagggagggacacaagcctggctggattcgccacctgttgactaaagagcctttaggccttgagtgaacaacagacggtagccaggcaagacccagtgccgtgctggcttcaggtctgacctagtacagtcccagttgttgaggccacaaggctgcttgtgtcacccagctccaagcagttcagcatggagaaagagactctgtctgggtgaaaataagagaagagagcaagagtctttgcctggtaatccagggaattctcttggatcttacttaagaccaccaaagtgataccttaagagctctgcaagagtcatcattgctgggcttagggttctcctagtgcacatattgttgcagtgaccaaagacttagatcacaacactcgattgcctttgaatacttggaaagccttcccaacaaacaagcccagactgcaaagactgcaataaatacctaactctttaatgcccagacaacaattaatatccataagcatcaaaaccatgctggaaaacatgacctcaccaaatgaactaaataaggcaacagtgacctatcctaaagagagagatatgtgacctttcctacagagaattcaaaatagctgttttgagcttcctcaaaagtcaggataatacaaagaaggaatacaaaaggataatacaaaattcagaaaagtacaaagaaggaattcagagtcctgggccgggcacggtggctcacacctgtaatatcagcactttggaaggccgaggcgggcggatcacctgaggtcgggagttcaagaccagcctgaccaacatggagaaaccccatctctactgaaaatacaaaattcactgggtgtggtggcgcatgcctataatcccagctactcgggaggctgaggcaggagaattgcttgaacccgggaggcggaggttgtggtgagccaagatcgcaccattgcactctagcctgggcaacaagagagaaacgctgtctcaaaaaaaaaaatttgttttttaaataaaattaggaagtacccaaaggatatggagacatatcaaaaagacacatgagccacttgaagtggctcccactgatcaattctgtgacaactcaagcatcaaaataattaattatattagtgaatcataactcactgaataaggatccatgtgttcacactaatattaattaactaattaatttggggaaatgggaaagtactcccttacagcagaatgagaaataataaatgtagaaggagtgataaatttaaaaattacttgttggcaaccatcacaaaaacaattgatttaggtaaaaatctaaaattactggatgaaaatttgatgaaaaacaggatatccacatagttgtgaagtatctccccatgagatactgattaattaattacaaaggacaatatagtaagattacaatgtagaaatctggcagacatcagatttctagccaagtaatcatagttaacattaccaatagtaatggcataaattgatatcatgtacttcctgatatgatgcactaagaagattacaatctcacttctcttgtaatcccggcaacaatacaactgaaatcgcgtcataacataacttcagacaaacccaaatgattgtcctctactctttaaaaatattaagattgtgagggggcacagtgtctcacccctgtcatcccagcactttgagaggccaaggtgggcaaatctcttgaggtcatgagttcaagactagcctggccaacatggtgaaaccctgtctcaactaaaaaaaaaaaaaaaaattaaataggcatggtggtgggcacctgtaatcccagctacttgggaagctgaggcaggagaagttgcagtgagtgagatcacaccactgtactccagccaggacaacagagcaagactccatctcaaatatatatagattgtaagaaaggaggaagaaaaatggaagaactcttctagatctaagaagactaaaaagcagggccatctcatctacagtggagaattagatgccacttgagaaacaatttctaatatactagatgcttggcaccaagtgaccaggcagttacagctgcccatcaccagctatattctgtcatacccaccaagtcatgaggtcaagtgtgcctagcaacaactcatgataagatgataatggatataccctgaagctacgtgatcagaaggtcaaaactccacatcatccatcactgttgtactaatggcattcctaagtgcacatctatagccatatgaccccatatgatcccgtaggaccagcttagagcggaggaaaaagcctgagcttggttcatggatatgaaggtctgtacatgtgtgtaggtaaaaaaaaggatgacagctacaatacagcttattcaaagagcatcttgaaaaacagtggtgagaaaaagtcctccccatgggaagaattttggatggtcatcttccttgtgtggaaaaagaagtggcttatgattagaatatatatgaactcataggtagtggcttgacagagtctgagaggtgagaagaaagatgggtagatcaggtacaaagaggactaggagtagaggcatgtgaatgaataaatggggtgggcacaaagtgtgaagatctttgatgcacatgttaactcccactagcaaggtactacataaccagatagagaaaaagactcagccagttgacagcatctggcctctaacactggccaccccagtgctggcataatggccacatgactgaaatggctatggtaacaaggatggagataattcataggcccaacagcatggtctcctacttatatagattgatctggatgctgccttggttgaatgtccaacctggcaagcaacagagaccagaggccaatgttgagcctccaagatgacactatctcacaagcagatccactggcacataaggtatcaagttgactgcattggacctacttctactgaaggagtacagatccattatgctgggaatcaatacttatttggatatgcatttgtttttcctgcatcactatctgaggacttacggagttcgaatccactgatacaggatcccacataacattgtatcagaccagataacccattttatagtaaaggaggtatgacaataggcccctgaccacaggaccaactgatcacattacctaccaaaccatccagaagctgccagctgatagaaccttgaaatggcctgttgaaagcataatcaaagcaccagctttgagatatgatcctctatgatgaagtatatactttaaatcaaacatcttcattgtctccccagtaggaacaatacatgggtctgggaatcaaggatttgaagcagcagtggccaagttattatctctccccttgactcacttggggacacttatgcttttgttccacatctgaaatctataaatagtttaaaaggccttgtttccaaaagggaaacacttccactaggggcacagcaagtcctattgaactataaactacagatggtgcctggcaactttgggctccttttgccaaggaaccagcaagcaaagatctcaccatcttagaaagggtcattgactctgatcatcaggagcaaatagggctgctgcctcctcagtactccttgatacaattttgattataaaaatcatagaaacatcagaaaggcatagaggcctttcagacccctcaaggatgaaggtctttgtcacaccaccagaagagccactgagaccaacagaagagccagccaaggatgaggagaatacgaaatggatggtggtggaggaagaagatgagtatcagttgcagttcgaaggccaactgcagcatcaggtgttgtagtttatctcactaaccttactctactgagtttcacccaagaaaagaggtctatcagaatcctggaggagctattctcagaaagcatacaaagcagtggatcaagcaaaaaaaaaaaagagtgtattgtcatgggtactgtactgtgccatccaattttcctttaaggactgaagggcaatgaattgagggaagtcacaggtaaacagtaaaaaattgaggctctcttccaatagcccaaagggaattgaatcatgccaacaaccactgagtgagcttggaagtgaatcctcctccacttgacccttcagataagactgcagccctggccaacccctgacattctgtagaaaatcaattgactataatgtgtgagtttatttttgaactgcctattctcttacattggtctatgtgtctgtatttttaccagctgatttgattactatagctttgtagtatattttgaagttagataatgtgatgactgtagctttgttcttttcattcaagatcgctttggctcttcaggggcctttgtagtttcatacaaattgttttttctatttctgtgaaaaatgtcattggaattttgatagggattgcactaaatctgtagatcactttgggtaacatggacattttaacaatattaattcttccaatctatgaacattaatattattccatttatttgtgtctttttaaattcctttcatcaatattttatatttttcagcatacaagtctttcgcctccttggctaaatttcttcctaagtatatttatatatttttgtagctatgtgaatgggagttttcttaatttgtttttcagacggtttgctattagtgtatagaaatgctatgatttttgtatgttaatttcatatcctggaaatttactgaatttgtttattagttccaacatatattttaaatttaaaaacaataaaatgaattatgaagcatttgcaacaaaaggtgggataatacaaaaatattctctcccctttttcagagccaatgcagtgactatgtgtgggcaagagaagacattctaaatgcttactgccctccttccatgtctagagctgttaggtaggataagagaggtctatttttaaactgacatgcaacaaattaaagaaaacaatggttctaaagctttgtgctttgagaggaggaaaccagagcagatggttttttgtttggcaaaaatccctaaatagggcttttggtttacaaaggggaaataccacaacctctcaaactccaccttcaacacacacacacacacacacacacacacacaacacacacacacacacacgcacacacacacacatacacagagtctgaaggaaagaattgaggaagaaaaagtaaaattttgttgttgttgttatttgtttgtttgtttgttttgagacagagtttcgctcttgtcgcccaggctaaagtgcaatggcgccatctcgactcactgcaacctccacctgccaggttcaagcgattctcctgcctcagccacccaagtagctggggctacaggcacctgccaccatgcccagctaattttttgtatttttctagagacggggtttcaccatgttggccaggctggtctcgacctcctgacctcagatgatccacttgccttggcctccaaaagtgctgggattacaggtgtgagccaccacacctgcccataaaattgttttttaaggttaagtaaagggaatttggagcttttgaatgaaagcctagaagggaggggagccactctggtttctgtaaaaggaggaggagcagagaagcatcttggagaaaagatctggtccacatcacacggaatcgggttaagttctgagaaagaggcatgggtggggaaatcctatggagaatgcagattgtggagaagtgatgggtagtacctagtgcagatggcagaggaagtaactccaggacttttgtaaaaacagggactaaagagttggagcagtagctggaagaaagatgtgaagtaacagggcttctttttttaatgggtgatattactgtatatctgtatgctgattgaagtgttccaatagaaaggaaaaaataaacatggataagcattaattagaggagtaaaatccttaagtaggagagagaaaatgggacctagcacataaagagagggtttgtccttagatgttcatccattgtaacctgacagaaggcagattctgtggttgccgatgctggtagaatgatggattcgggagtggaaagattaaaaaaaaatgatcttttgatcttttccattttctcagtgaaataaggagccaagttatcagctaagggtgaggagaaggaaggtggcttgagaaaggttgagaagtgaaatagccactttagagagtaagggagtgaacaaactagagaaatataataggattgtcgggcagagctggaggcccatgtaaagtttgtgtttatgaatttaaaatgggacctattggcatggttgtgagtttctctttttttccagccacgttcagttccttaggtgcaggcataaggaaggcagatggtgccagggatgagtttggccagcaaacactaccaaaggagagaagagcaagggagttgaatatatgcaaaggaacgacgtcaatgatgggtcatggaattgtagtggatacagaaaaaattttttggcactatgtaaacccagcatcaaggatgcaaattcagtcctattgacctggaagtccatgcttacttctgtatggcaatgcttctcaaacttgaggatgcgcaagaactatctggaaactttgtcataaatgcagaactctgggccattcttaacaattctggggcacaacacttgttctttgaaataagcagataggtaatagtaacggaaggagggggtctgtggcccattctatgaaaaatattgtattgcaggtgttttacgtgaaagtgcttgaaagtaggatttgtttgtttgtttgtttgtttgtttatttatttatttattgagatgcagtctcactctatcgcccaggctggaatgcagtggcaccatctcagctcactgcaacctccacctcccagattcaagcaattttcttacctcagtctcccgagtagctgggattacaggcccacatcaccatgcccagctaatttttgtatttttagtacagacagggtttcaccatgttgcccaggctgctctcgaactcctgacctcaggtgatccacctgcttctgcctcccaaagtgctgggattacaggcgtgagccaccgcacccagccgagatcagggttacgcacaggaaaagtgggacacccagacaattgtttatactgccaacttcacagccatagaatgatgacgttccaaatatttgcatttcttaaccaaatgacataactaaaagtaagctaccatgaagctaacactgcaatgggtgcggcaataaattcagtagctttatttttaaatttcaattaggttccttggatgaacaagaaacaagtgtgacattttgtgtggaatctgaaaaccaccttagcatggctttacatcggatgcatcagttttccaaaaagccagagaactgtgttctgttgggggagaaaaagataaacattctaagagaaacaatcatttcttaaatgtggtaaatagctaagccaaaccaaatacattttacgagtatatagaatacatgtgattatgtgaatgaaaccatttagtgtgaggtttaagtgatgggagaaaacattagggaaatgataagaccctcattttctttttctttttctttttcctttttttaagacagagtctcgccctgttgcccaggttggagtgcagtggcacaatctcagctcactgcaacctctacctcccaggttcaagtgattctcctgtctcagcctcccgagtagctgggactacaggcacgtgccaccatgcctggctaatctttgtatttttagtagagactgggtttcaccatgttggccaggctggcctcctgacctcaagtgatccgcccgccttggcctcccaaagtgctgggattacaagtgtgagccactgcgcctggccaagatcctcattttcaagagataaaattaaaggttctatatacagtgaagactgttctataacagtcaagattaaaggggaaaaaacagtatcggccctttacagtactgcatctgtccaaagaccataagggagaagatcctgaagaaatatatcaacaaagctaagacttttttcaattattcttttctcacattttttctactgatttttatttaagcttattgtattttgtcatgttttgtatttaacatctcaccagggctctgctgtcttttgaataatggcaatttattcagtgcatttgtaactatttacaattaaaattatattcctccatgtcatgcatatttctaataatcaaaccaaccccatgaggtgggtatttttaatcagttatcattcccttctctcccactagctggacacttctcagactcctctcttcttagctttgtctgctccctactgtcctctcccacctgctaaaacaagattgtcaatgtttttgaaagatttctaaacctagagccaaggacagcttcagcctctggctggttcttactttctggcatcagagacatttcaaccctaaatctgaaaccttaaaaggttagcagctctaaacgctggccattacacacttctttatctcacacaaacctggtatcattctccttaaaatattttgctctaatggatactttgctctaatggatacttttcaaactctacgaattgcttgagaaaggggaaatgttagatctttagaccaattatcattgccatgagttgttttgtcacttggggtgagttctctataatgtgggaccaagatgaggtagatattttattattcaatatttggttcattattattcaagctcaacttggaattatacaagatggcatcattcacctcagcattcattgaatataaccacaaccctgagttttacagaaaagacttagaaaagaggctgggcgcgtagctcatgcctgtaatcctggcactttgggagactgagacaggtggattgcttgagtccaagggttcaaaaccagccttggcaacatggcataatctcttctctaataaaaatataaaaaatagctggacatggtggtgcgtgcatgtaatctcagctactcagaaggctgaggtgaaagggtcacttgagcccagaaagtagaggctgcaatgagatgtgatcgcaacactgcacttcagcctgggtgacagtgagaccttgtctcaaaaaaaaaaaaaattggaaaggaaaatgcaagtggggacgccatctgcagctcactgcttcatatcattgtttctccctctcacccctctttttaaaaacccagtggccaaattcatctgtgttttgtttgtttttgttttgagacggagtttcgctctgttgcccaggctggagtgcaatggcgcgatctcggctcactgcaacctccacctcccaggttcaagtgatgctcctgcctcagcctcccaagtagctgcgattacaggcacccggcaccacagcaattaatttttgtatttttagtagagacagactttcacctttttggccaggctgctctcaaactcgtgacctcaggtgatccacccgcctcagcctcccaaagtgctgggattacaggcgtgacccaccgcacctggcctcatctggtttttgacaatcattatagaacaaaggctctgattatgatgacgggcaagtgggagtcctagctaaacgttccaatgcagacttacccttgaagcatttggggacttcgatagtgccatctatacactgagcatcctctgtatagctacacttcttttccttatttttgcagaagaaagaaactttatcaccatgtagcattccattcttaaatttttcctgaatctttactctctctccttggtacaccacagtggcttttttcacaggtactttacaagatgctgaaagagagaatacttgtaatcaggacttaagagttcaggaagtctttctgaaagagagtatagcatttgaaacagtagatgagtacacctacacaaattggtcaaggcaagaaaaatccaagaatatatatagtaagtaatggtaatatgattgctaattgcagttctctgtcaatagaaccattattcatagcttccaagatggccttctcttcccctacagtagccacagaaggtcagaacagaagcatcagagcctccatttcagtgaaaaaaaaaaaaaaaagcaactaacagatattgacatttcatgtaagcctactctgccctctcagattgcattcattaagcaggtgcatctatccaccagccattgtgagtgttggctgataacagctcataaatactctgaaaaattgccttcagccatagggaagccacctctcccaggagtttatgcaaaccacccccagggtcagggaagggagcagctcaaagccaaagactgactgatgagggaatataaaaagcaggtccccttggctcttagtgggattaactcaagggtggaattcacactccagagctcccagtgggatcaaactgaacctcattttagcagagaccacatttctccctggctcggcagcattagcatcaccagggaacctggcataaatgcaaattgtcaggccccatcccagatctaccaaatcagaaactctaagagtggagctcaaaaatcctgtgttaaaacaagccttccaggtgttgctgatccacagcgaagtttgagaaccggtgccttaccctcgcaaatctgcctcactctttcttctcctgagacattcactaaatcaactgtactcgaatccccgtctcaggctctgcttctagggaactgtaacctaagatgctagttatttgtcatcttgcctgctgccccagagttcctctttctgcttaaactgtccagcccatagtgacctgagcagagttctaatgctaggctgttgttgttctttacttatgcatgacactgatgggatcaagggtagacacctaactcaaaaggaaccagtgtctccaggaaagatgccagttggtgatgaatcctgtaactgagagggtctggtgtatatcaagccatgttcaagatgaataagcagagagacggaaatgggagagaccattgagatacggaaaaagtaggaatagttcctgcctttcagttccaatcttcaggagtatcagttgtatttcatgtcttcatcttcaatgcccacatgatcgacttgcctgttgcctccttataatatccccaatttccttgaactcactcgaatgtgtggttggtttttgcaatgagaagagccttggctagacagagcacaaaaaggggtgggcatggtggctcacatctgtaatcactcgaacctgggaggtgaaggttgcagggaactgagattctaccattacactccagctaggcaacagagtgagactccatctcaaaaaaaaaaaaaaagactccatgtgtctacaataatactaaaaaatgatggatggaagaaaagctcttctctacagaggccgaggcgggcggatcacctgaggtcaggagttcgaaattagcctggccaacgtggcaaagccccatctctattaaaaatacaaaaattagccaggtgtggtggtggggtgcctgtaatcccagctactcgggaggctgaggtaggagaattgcttgaacccgggaggcagaggtggcagtgagccgagatcacgccattgcactccagcctgggcgacagagcaagactccatctcaaaaaaaaaaaaaaagagtgctcagaggcaaagacttaaaagcaaataaagaaagcccacatgatctcccaccatatcaccaatgcttacaaaggatctgtttatttcatactgtttaaggtcaaggatacttcctaagcatgaggcttccccatgcacctgtgagtcctgaagtcacatgccagcagtttcctagcaagtctgagcaacaagtggaaaagtgttggaacaagaaaatagcaagtaaaggtgatccactgtatcaattcagagatcttacaggacctcgcctatatttccatacctttacaacttggcatggcagaccagtttcccagtttggtacattctatttcttccgggccatccagagaatatccatcatggcagccaaatgtggctttatccttgtaataaagtgttggttttgcaggatagttcacaaatccattgtctggtcttgatgggaatgggcattttacttctaaaacatttattcaataagacatattagtaataaatagtgctatccaatagtcatgaaatagttacatccttgtctctgtcacaccactgaatcactgtgtgttcctgtaactggaatgcaatttatagttaccttgtgcttaattctgtccccactcctcttatatctgtggtaccctggatattaaaaaagaaacaaccacactttgaaagtaaattaatgagacttcactaagttctctgggttttcacatataatcataaggtattatttattgcaaacttcatctctacacagtctaagatggtgggtttgaaagaagaaaagcaaagtctatttctaacaaaccataaaattaaaatgcaaagactgaacccccccccccattcacacttagtacaccattatttggctttaaaatagtaaatcttactgttattcaattcagactatggaagaagccagcaggaaatacgtcaaagaaaaatggtgctgcttcctggcctccttaagatcctcaacagtagaggcccaaacccacgtccttatgagctgcagtgcgagaaagcaaggctggagccaggagcacaatattctcagaggtagtttaaggaggtaattaagggtacaaactccagagtcagactgcttggctcaattttggttctaccacacattaaataaaacagaattcatgtggccaggcacagtggctcacttcggtcatcctggcactttgggaggctgaggtggatgctgaggaggtcagaagttcaagaccagcctggccaacatgacaaaaccccatctctactaacaaaaattagccgggtgtggtggcatgcacctgtaatcccagccactcaggaggctaaggcaggagaatcactcaaacccaggaggtgaagcttgcagtgagctgagattgcaccattatgctccagcctgggcaacagagtgagactccaactcaaaaaaaaaataagaatccatgtgtctataataatactaaaaaatggtggatggagggaaagctcttctctatagagggaagccagtgaataaatgtagaaggaaaagatagaattagaaagtcaccatttttcagcctccaatgtcataattgacagattcaaggatcatcattggattctaccatgactgcccaacagtggatattcacatggtttcaaagtatcacccacaggttgcttactattccaaagaaaaagcagtgcctttaccaaaaggtgatctagcacccctcaactgactaagtatcaaactaagcatggccagtgatggaacagctgacactatgtgcttcctgatatgacagaatgtattttttttttttgacacagagtctcactctgttgcccaggctggagtgcagtggtgcaatcttggctcactgcaacctccccctcctggttcaagcgattctcctgcctcaacctcctgagcagctgagactacaggcgcacgccaccacacccagctaatttttgtatttttagtagagacggggtttcaccatattggccaggctggtcttgaactcctgaccccatgatccacctgcctcggcctcccaaagtgcagaatgtattcttaacagtaatatttaacatgaatctaatcatgagtaaataaccaatcaagttcagattatggaacattctacaagacaactagcctgtactcttcaaaaatgtcaatgaaagacaacaaaagaggcaaggacttattcttaattataggagactaggctcacgcctgtaatcccagcagtttgggaggctgaggcaggcggatcattttagttcgggagtttgagaccagcctggccaacacagtgaaatcccatctctactaaaattataaaaattagctgggcgtggtggcaggtgcctatattcccagctacttgggaggctgaggcaggagaattgctcaaacctgggaggtagatgttgcagtgagccaaaattgcaccactgcactccagcctgggtgacagagtgagacaccatttcaaaataataataataattattattataggagactagagagacatgacaactaaattaaaggtgtgattcttgattagatcctgcataaaacaaaactcatgtataagagatacttctgggtcaattgggaaaatttgcatctgagataaatgttgcatgatatcgttgttgttatgttattagaatggtttggattattattgttaataatccaaaacatatgaagtgatgatataaaatgtccttgttcttagtatattcaggctgaaggctttatgggcaagtatcgtaatatatacaacttattttcagatgatgcaggaaataaaagggatctttctatggagaaacagagagaaaaatgttacaacatattaacagttgatacgtctaggtgaaattgaaaaaaaaaggaacctactttttaggacttgggagaatgaggtcagatgacacatatgtagcaggagaccagtgcctggcccatagttgagtgcccagaaaggtacaagttactactgttattggtagctcctccatgctgaaaatcacttatgttttgaatcgttcactggatatctgtaatatctaccactggagaagttaatagtcacgagaataactcttggccaggagcagtggcttacacctgtaagcccagcactttgagagactgaggcaggcagattacttgaggtcaggcatttcagaccagccagatgatcatggtgaaactccgtctctactaaaaatacaaaaattagccaagtatggtgacgggcacctgtaatcccggctacttgggaggccaaggcatgagaatcgcttgaacccaggtggcagtaagccaaaatcaccccactgcactccagcctgagtgacagagtgagactatctcaaaaaaaagaaaaaaacaaactatttgtgcacatgataaactttataatttgtctgtttgttatgcagctgacaaacttgaagatagtaatgacaggtcaagttagagacgaaataattttcataatttcttaaaaatcaaatatttctgtgattcttaaacttgggtaaagatttttaaaatgtgtaacaatcagacagcaacccagtcttaaccttcatctcctaggactctccaatttaacccaggaacttcacccagaagagaacttcaccagcctcgctgaaatgtccagctgtccatggatacatcctgcctttcatgtctcccccatgtgtggtatgccttctcctcattctctactgctcctccaagacccatttcaaaggtcaccacctatgggaagctgtcccaggcagctccagacagttaattgcattatttataattcccttgggtcagaagccaggtctcattcatcgggaatccacagtgcccagcacactgcctggcacatggtagatgctcaataaacagctgttgaatgagttcattggaaacactccatgatagtcagaattttcaatacctttcacaaatgggatcttgccctaccatgcgtattttgtctgatcattgcacttacccctgcattctggtaatttagtccaatttccatgtgtcgtgcaggtaattgtatcatttccaaacatcgcatgttgtggcaaacattcaaaaactgctgtgtcccgatagagggaattgtttccagctgatggcttataaacacgaagtgttgcaaacgtaggtatggatggtggagggcagatgatggctgggaaaataaagaactatcatttctatgaaaatagttaaggcttttaaatatactctttccagaaagaaaaaaaaaaccctaaggataaacttgagaaaatgcaaactgatcaaattagcagggtaaaaattgtcaattgtggatgcctaataggaaaatatgacctgccgggcacggtggctcacgcctgtaatcccaacactttgggaggctgaggtgggcagatcactagaagtcaggaatttcagaccagcctggtcaacatggtgaaaccccgtctctaccaaaaatacaaaaatgagccaggcatggaggtgtgtgtctgtggtcccagctactccagaggctgaggcaggagaatcgcttgaacctgggaggcggaggttgcagtgagccaaaatcgcaccactgcactccagcctgggcaacagagtgagtctgtctcagaaaagagaaagaaagaaggaaggaaataaataaataaataaataaagacagaaagaaagagagagagagaaagaaaggaaggaaggaaggaaggaaggaagtcagaagggagggagggagggaagaaaggaaggaaagaaagaaagaaaggaaagaaagaaagaggaggggaggggaggggagggagggaggaaggaaggaaggaaggaaggaaggaaggaaggaaggaaggaaggaagccctcaagtcagatgtccaaaccagtcaaaacaccaaaaaaatgaaggaaatttaagtcttgccactgccttttgcaacaacacaatggttaggttttataaaatcttttattcatatactaccttggaagatgcttctggaaggcagaatttgtccctcagtgctgagggaccatcctgaaataatggctggtgacagcaacttggtacatagtagtttgggaatgagttccattaccagttcagtctgtttctgctgaatacctccctgcttttggattcttggtatggatggagcttacccaagtagcttcaggaacccagagagatagtagtggcttgtcaccctgacctgagtactatggagcttcaacaagttatactagcataaaagaagatagtgctgaccaaaatgcgatttaccttgacttccctagatccctgctgctcaaaatgtggtccaggggctagcagcacgggcatagcctgggaaaatagcttgttggaaatgcagaagctcagaccccactgcaggtgcctgaatcagaatctacattttaacaaggtgcccaggagactcatatgtgcattcaagtatgagaaatactcatttaaattagattaaagctcaagcagtctttctatttacaacccttttggaaagtgagtttatggctaggcaccgtggttcacgcctgtaatcccagagccctgagaggctgaggcaggtaaggttgcttgaaaccaagagttcaagaccagtctgggcaacagagcaagaccctgtctccaccaaaatttttaaaaactagccagatctggtggcgctcatctatagtctcagctgctcaggagactgagaggatcacttggccccaggagatcgaagttacagtgagctgtgatcacgccactgcactccggcctgggcaacagagcaagaccctacctctaaataaagaagcaaatttacataatcggtataaatctgttttaagtgaaaactgtaggaaccatcgtgattcctactgctgagtgaaaattttacttaatttgtcctttaaaaactttcgtttttgcttgttcaggtcttcttaaacaattatttatttgaaattgctttactttccacttgctttttttttttttttttttttgagatggagtttcactcttgttgcccaggctggagtgcaatggtgcgatctcagctcactgcaacctccgcctcccgggttcaagtgattctcttgcctcagcctcccaattggctgggattagaggcatgcgccaccatgcccagctgattttatatttttagtagagacggagtttctccatgttggtcaggctggtctcgaactcctgacctcaggtgagccaccctcctcggactcccaaagtgctggcattacaggcgtgaaccactgcacctgccctcctcttgcttttgctaaagacagacttcactgacatgttgaagaactataattagtattgaaatgcctgggcctcctggtcaaagatgtataaatcacaagttggggaacataagaacgtccttccctacataagcaaagcccagagatgactctgacagcttggctgaggatcctctgaaaaaacaacagtgctttttggaggaatgccaatcagctcctaggatgcaagcccctttgatgggctgttggcttactgtgagggtgactttcctcctcgtctgtcccgtaagtcactaggcttactctctgaaggcaaagctgcctcctttggccttgcagcctcagtgctaacaagaggatccagcatacagtagatcctcaattcatgtttattgaataagttaataaatgaatgaatgaattccagagtgggaggaagatgtttgtttgatctcactgtttgcagaagttcctctagttaagtggtgacagtccctgatataccaatgccacacatatccaagccacttccaaagcactatgagagcattggagtcaacacacccagaaatgactggcttagatagagtaatgaccgcgaggtggagaatacagaatgtgtccgtgagtaaaatgcttcccttctgtcattccaaagtggttgtttcatcttctagagcaagataccaggatgaatatcccccacaagggtgaccattcatctcattgagctgtgactgaagagattccagatgtgagactttgagtgctaaaaccagaaaggttctgggcaaaccagctgatcaccttgcccacagacttacgagcacagacaggaagctccgggctccattttccttcctcagtgcacttggcagaatcagcgccattcagataaaacctgcaaaaggaaaattcattctatcaaggagtaaaataatccatcactgacatctcaaatatcttctccattgagcattgcttcatgttaatgctattgacttcttttccatcgtataatgctgtcttcctgacaaacttagtactcatctatggctcatggagcctcccaaccaatgatgcaggtgaatcactgcagggttccacagctggtgagtggagaatccaaacccttaaatccctcatctttaaagagttggccaagatgactgtttctaatataaagcaaagaaccatctctttttcaggatgacaaaagtgaaccaaactgagtaatcttcattattcattttcttacagcctactgacaccaatgaataaaagcaatgcagtctatttccaatgaaaatatagcattctgactgggtactttggctcatgcctgtaatcccagcactttgggaggccgagatgggcggatcacttgagcccaagagtttgagcctgggcaatgtggcaaaggcccaatttctacaaaaagtcaccaggccgtggtagtgtgtgcctatagtccaagctactcgagaggtagaggtggaaggaaggattcaaaaggatttaacctgggaggtcgaggctgcagtgagccatgattgtgccactgcactctagactgagcaacagaggaagatcctgtaaaaaaaaaaaaaaaaaaaaagaaaagaaaagaaggaaaggaaggaaaaagtaaggaaggagagagacagacaaagaaagaaagaaaagaaaagaaagacggaaggaagggagggagggaaagagaaagaaagaaagaaaaagaaagaaagaaagaagaaaggaagagaagggaagggaagggaagggaagggaagggaagggaagggaagggaagggaagggaaaggaaaggaaaggaaaggaaaggaaaggaaaggaaaggaaaggaaaggaaaggaaaggaaaggaaaggaaaggaaaggaaaggaaaggagcaggatgccatggtggctcacacctgtaatcccagcactttgggaggccaaggagggtggatcacaaggtcaggagtccaagaccagcctggccaagatggtgaaaccccatctctactaaaaatacaaaaattatctgggtgtggtggtaggcgcctgtaatcccagctacttgggaagctgaggcaggagaattgcttgaacccaggaggtggaggttgcagtgagccaagatcgcaccactgcactctagcctgggtgacagagcaaaaagaaaggaaaaaaaaaaaaagaaagaaaaatgtaacattatgtcttcgaagccaattttcttaaggtcatttgttaccagacccattggtagattggtgtttcagatgaaaggtgtgtatttctctctcacatgtagtattccttaacctccaatcccagtagaaacttaccctagtggatagccaatgtgctctcaataatgtcacaggggtgcctttgctccttatgagtctatgcccaccgttaagtgactgcctccctttgctcccagatgagcctgtgcccaccacaagtgattgcttcctggggatgtggaactgcattgcattctccactgtcacactcccaaccttctccatagaattctcttctagagactaccaggttggtcaatcaaattagcctaataactaaagcccaagtcttattcctaaagtattttaaccctatccaagatttggcccagagatcatatggaattatcatccaggttcaatcattttaatgtacctcctctgagataattaatcaggagcagaaaaattagatacagtggtgactacgtattgcactagttgttatattctccaatccttaccccaccctcaatgctacaagaccatcctggctaacacagtgaaaccccgtctctactaaaaacacaaaaaattagccgggcgtggtggcgggcgccagtagtcccagctactcaggaggctgaggcaggagaatggtgtgaacccaggaggtggagcttgcagtgagccgagactgcaccactgcgctccagcctgggcgacagagcgagactccgtctcaaaaaaaaaaaaaagcaggactaaaatcgatttgcatttgaaagtccaacctaaaggctgaaaacaaaatatagaccagtcttgatgtttagcttaaggatacaaaaatgtgctcagtctgttaactgcttagttccatgaaagttcttacccagtgttacaagaaaaactgatcgtgttgggatattcaaaagtcgtatagcgtacggctccattttctaagattccagcaaaaggacatactctggctgtgatacaaagataaaaaatgttacttttctttgggctaaaaaaaaacataaacaggtaaatttctatttatagaatttttcattaaatgaaacatataaattcattttcatcctttggttcaataactttactggtaactattctaagaaagcaattcaaaataagacaagtgatatatgtacaaaagcgttcattatactgtttctcctaataacagaatttggacaggcggggagcagtggctcacgcctgtaatcccagcactttgggaggcagaggagggtggatcacttgaggtcaggaatttgagaccagcctgaacatggtgaaaccccatctctactaaaaatacaaaaattagctgggcatgatggtgggtgcctgtagtcccagctactctggatgctgaggcaggagaatagcttgaacccaggaggcagagggtgccaagatggcaccactgcactgggcaatagagtgagactccgtctccaaaaaaaaaaaaaaaattggatagtctaagggttcatcaggggactgttttaattaatcatggtaaatcaaaagttgaactattatgtagccaataaaatatgaattgtgaaatatgtggagatacaatttttatgatatgctgatgaaaacagaaaaatacaaaattatacctgctctctgcagtaatgcaaaaagatatgcatggaaaataaaaaaatgaaatttttagtgttccagagttatagctgatttttattttatttatttatttatttttttttttgagacagagtctcactctgctgcccaggctggagtgcagtggcacaatctcagctcactacaacctctgcctcccaggtgattctcctgcctcagcctcctgagtagctgggactacaggcgcatgccagcatgcccggctaattttttttatttttagtagagacgaggtttcaccatgctggccaggctggtcttgaactcctgacctcaggcgatccacccaccttaggttcccaaagcgctgggattacaggtgtgagccaccgcacctggccctgatttaaagaaaaattttccctaatgatgttacattggctttttactaaaaattatgtttaggctctttaagcaaaaaagcatagtaaaatcaacttgcatgaacatgcataactttgacaaaggtcctgttcatataaccaaaatcaccagatccatacatctatttttactgcttaacttctacatataattaaatgtaccataaattcaatctggttgattgcataatacttgactgtaaagaataatgctagcatgatatcatagaaccatgttctaagaaataaataaaagcaaccatttacagtaaagccatagtgagattgatatattttacgttatattattattttaatttgacctcttttcttgtatttcattataatataatatatacataatgtagatgaaatttgtattcatttcagtaactattaagtccgctttcattttcaggtgaagtccaaagatatgatgattccccaaattttgtttttccaaatgtctctttggcatcagttgacatttcaaagcctctccactgttcttttaacttctgtagtgtttctttctccttttgccacaccagatctcatttttaaacctaccctagtttcaggctatgatcttctcctcttctatcaatagcacctattacccttactctctttgcacagagagaactccccaagaccttctcatttctctccaacctggctttctgcagcatctactggccctctgcactctgagcatgacgaggtagcttattcctccaaaatacccagaatccaaatgagggaagagaatgtgagagaaggtactgacttacgtgtacatttcagagtgttgatgggccacagtcctgtgagagggcagataaactttctcatccctcctcgggacacatagcccggcttgcaggaatacgtaatctcttctcctggctcatagaatgtttttaacgggaccactgtggaaaatggtaaatcatctggcttgggacaggctgaaagagggcacaaagcagatggttaacaaatctctatttgcattttaaagttcagctaagcccacaaatgaaaaatgtgtgtactgttaccaattataagcataccaagttgcatgccaaatacctcatatacactatctcatctaatcccctcaacaaccatttgaaggaggtattataattatccccattttacaggtcagtatgctgaggcttaaattggctacgtatcttacagaggagctttacacatggcaatattaaagaatcagtatcaatccagtccctccagcatccactctaaagagaatttagttatcagctgggcgcagttgctcacacctgtaatcccagcactttgggaggctgaggcgggtggatcacgaggtcaggagatagagaccaacctggctaacacggtgaaaccccgtctctactaaaaatacaaaaaattagccgggtgtggtggcgggcgcctgtggtcccagctactcgggaagctgaagcaggagaatggagtgaacccaggaggcggagcttgcagtgagccgagatcgcaccactgcacttcagcctggcgacagagcgagactctgtctcaaaaaaaaaaaaaaagaatttaattattcttcttcttattattattattgttgactgagttttgctcttgttgcccagactggagtgcaatggggggacctcggctcactgcaacctctgcctcccaggttcaagcaattctcctgcctcagcctcccgagtggctgggattacaggcgcctgccatcacgcccggctaatttttgtgtttttagtaaagacagggtttcactatgttgcccaggctgggctcgaattcctgacctcaactgattcgcccacctcggccatgatgcccagctaatttttgtatttttcataaagacggggtttcaccatgttggccagactggtctcgaactcctgacctcaggtgatccacctgccttggcctcccaaagtgctgagattacagatgtgagcaagcacgcccggcctacttatcattattgatccctgacatatacgaaggggttggatatattaattattttttcaaaagcaaaaagtacttactccgtcctgcaatagcaacatggcagagaaaactcgagaacaagatgagcactggagaaatcattgtggatgagtcacactggcactaccaaagtggttttcgtctgctaaaaagacagagccaaatatgaaagcgcttaaacattaaccattttctggtgtacttttatctttgtaaatagaagataaagtatcatgatttgaatggaactctgagacccacattctttaatcatttactttccacttatgtggctctgttatgaaatctttgggagatggtttctgtcttcataacgtttttgttaatggcacaaaacagttcattattgcttttgacagaaacttgttgtttccggggttgcctggacttctcattctccatcttttgttttgtgtatgttgtagatggaacaccaaaagatcgaagctcctgtttcactcacagccttggcatataaactttggacaaacacctactctctgttctcagtctccacctctctaaaatgatgttccagttttcagatgtataattacaaagaatgtcttccaggaggcacttacaactttaattccctacaaactgagctcaacatcctctcttgcaagctcctatagctccagttaggaccttagagctatccttgaattctctatcttctcttacgtcagatcaatacaaagtcctcctcatccattcttaatatgtcttggatctgtctagacaggtttctagatctgtttcaggaatttgaaaattgatttgaaattaacaacttgggactcgaagaagaaaaaaaaacttgagtaggataagataatgggccagtgctgatgttgttgcttgagagggttcggaaggggggttgtctttgattccctagttctcttctacatcatttgctctaaaaaaaaaaaaaaggatatataaatggacaatagccaggccatatgtgaaaacagaactctgacccacacatctgtagcaacaggtctagaaagccaaacctacaacctctatagcagttggcccaacttaaggccaaccagagaaatccaaacatatttctctaaccaatcacatggacacctcacttctagttagtttccttccatcctccccataccaacaatccgttggagcacacctgaagcctttccttttttctattataaagctttcccactcctctgtctgactttgactttgagtctctgccaaacacaactgttaatggctgcctcccttcctatagcaagctctgaataaataacctccgcttgctctcatttgggtgatcttggtttatatccagaggtctaaaattccctgagacacatcagcttgagaaatctccatctgtcaggcagatgattcttaaattacgatcctaatgaacattgtgttccatgataagaagagtgtgctgccactaatgtgaaataacagtggtccttccctatttgtccttctaaggggaaggagattcttgttctctggataattcccaggttccgctttattgtggagaatctccttgatgaatgaagaagaaagaaaactaatgaagtcaggaggagccaagtcgttctgtatagtaagatctgaagtagaaggggaaaaggagagagaaaccaaagaggtcgggcatcagttaaagaaaatttgagaaaaggttaaaattgagacgagaatattttcagcaacagctacaaactgagtgcctgatattgagagaggacaaggagaagggtttttaatgatgtttcctggtggctgggctcccttgcattaggaaacttggggtaggggtgtcgaaatagtttatattctattttaggtggttgttacttggctacatgcaattttcaaaagccatcaagccaaatatttaagatctgtgtgtttacttgattatacttcaattggaaaactatgcactcctttcctccttcttccctccctcccttcttccttccctccctcccttctccttccttccctcccttctcccctccctttttccctcccttcctccctccctcctttcttcccttccttccttccttcctccctcccttcctctctttctcctttcctcccttcctctcttcctcccttcctccttcttttcatcctaactcagtctaaaagtcacaaggaaggcctcaaggggaaagtcatgcttatctgtgtaaggatggcagcgtgatggtgtcacaagcttagctacatataggagattgagcaaacaagcaaatatattgaggataatgggggtcaggtttctcactaacaagagaagtaacaatgcggaaagaaggaaagttagcatgaaccttgaggtgttggattgaaaatggagacagtacaaattgtgcgtatatataaacagatacagaaatcaatatagatataatggtatgtacatgtgtgtgaatgtatgcctgaatatacatataattcttagttctgtccactaggataatagcagtagtacatccagtagcaatgagcacacacagtgcctaaatattggttgttaaatgcaattcttggccaggccgtggtggctaatgcctgtaatcccagcacttcaggaagaaagaaagatcgcttgaggtcaggagttcaagaccagcctagccaacagggtgaaaccctgtctttacaaaaactacaaaacctagccaggcatgatggcaggtgcctgtaatcccagctacttgggaggctgaggcaagataatcatttgaacccagaaggcaggggttgcagtgagccaatgagattgcaacactgcactccagcctaggcaacagagcgagacactatctaaataaataaataaatgcaatccaccatcgaaaggcaccaaagctccttagaaaattggctgattcttgaactgggtcaaggaaaagtacaagatgagcctggaacaccatcttgaacaacttaggtaatgctcagagaatgatagggacatgtccaaaggacagagaagccatttgaaagtggctttcttgactgggtgcggtggctcacgcctgtaatcccagcagttcaggaggccgaggtgggtggatcacttgaggtcaggagtttgagaccagcctggccaacatggtgaaatcccgtctctactaaaaatacaaaaattagcagggcatggtggcgtgtacctgttatgccagctaggaggctgaggcaggggaatcacctgaacccgggaggcagaggttgcagtgagccaagatcgtgacactgcactccagcctgggcgacagagtgagattccatctcaaaaaaaaaaaaaaaaaaaaaaaaaaaaaaaaagcggggggcggggggtgctttctctggtcaaatatgtgacagtttgtccaaataagtaataatagtaatggattatactccactgaataaaataggaatcagtgagtccacagtgatagtaataaacacattaacaattatgtgaagagataagaaagttattccttagagtataatgccaagcaattaatatagaggaatactggacttagagaattgtaatttggaaataattatgaaacgatttaattctggcaaagaagtatcaattgatgctagaatcaggggatacaagtaggatgagaaatgttcatacagccttaaacatgtctccacataaaataactatttattataaaggagacaaagagaaacttagaggggaagaacctggcagacaccatcttaattaagtaatcaaaattaatgtcaccactaatgggataaattggcatgtatgtcctccaccaagaggatgcaatgagaaggacacagcgtcacttctgtgatattcctgccaaaagcttagtaacctggattgtgtcatgagaaggcactgtacacacacaaattgaaggacgttatgcaaaatgactgccctgtcatcttcaaaagggcaaaagccatgaaaggcaaagaaagacttagggaacccaggtggacatgagaactgggtgcacagtgtgggcccgaaggggcatttggtgacacttgaatggaagggtctagggtctctgggtaaagagaacaaggaagtttttgttctattcttacaacttttctgtatgtttgtaatttgaaatcatttaaaaaataacgaaaaagaaaaagaagaaagaaagagagagaaagaaagaaggaaagaaggagagagagagcacaagaaagaaaaagaaagaaggaaggaaggggaaggaaggaaggaaggaagaaaagaaggaaggaaggaaggacgctttttgtggtttccttgaaagtccttctattgagatgtgatttttaaactggatcatacgaggcctcaaattttatttgcatcgccccctaaagaggaatacaagcttggcccccaccccaccgccatcattgacactcagctcctatttgccagctactgagctttgaaaaattatgcaaaataacagtgacaggaaaatggagaaaccactaaatcaaacttagtttgacggcttttgtgggctgttacatgcatttgtaattacaactttcatgtttactcttcggctggtaaaaatttcccttgtttgaacaattaaatacaaagataataaatggtaatctgcataattaataaattatgagtataattatgattaatttattcataatcataattttgggattatgatgattatcagctggccaccatgctcagctaatttttgtatttttagtagagccagagtttcgccatgttggccaggctggtctcgaactcttggactgaagtgatccgcctgcctcagcttcccaaagtgctgagattacaggtgtgagccattacctccggctgaacttgaacatgtctgagaactacagggtattcctggccgggcgcggtggctcacgcctgtaatcccagcactttgggaggccgaggcgggcggatcacgaggtcaggagatcgagaccacggtgaaaccccgtctctactaaaaatacaaaaaaaaagttagccgggcgtagtggcgggcgcctgtagtcccagccactcaggaggctgaggcaggagaacggcgtgaacccgggaggcggagcttgcagtgagccaagattgcgccactacactctagcctgggtgacagagcgagactccatctccaaaaaaaaaaaaaaaaaaaaagagagagaactacaaggtattcctaaaactcttccagaaacacacatggccctaatgaagaagtctttggagagataagatgcaattgcacctttcaattattttcaccttccagtttgtgacacattgggccacataactttagcaccatctggttgatcagttaactgatctatcttccctccacgcacttcgattcacattcccaaaactaacctatgataataactgaggagctggctgcttaccaatgttaaatgacagttttaaagacacatttaaacttaccattgaagttttatttggcagagcaagtggaaaaactgttaaaaaatatggaattttggcaaatcaagtggctgtcttgtattttcagggtttatactcatcagtaaagattggcaactcttgggtttaatgttacacttaacatgctattaatatattttaacaggccgggtatggtggctcacacctgtaatcccagcactttgggaggatgaggcaggtggatcacttgaggccaggagttcgagaccagcctggccaacatggtgaaaccccatctctactaaaaatacaaaaaagtagccgggtgtagtggcgggcgcctgtaatcccagctacttgggaagctaagacaggagaatcatttgaacccaggaggcagaggttgcagtgagctgagatcactcattgcactccagcctgggcaacaagagtgaaactccatctgaaaatatatatataatatatatgtatatataatatatataatatataaaatatacgtatatatatatacaagcatgatcaagaatacctgagaatttaagaatatataaaataacaacatttttatcacaagtaacatgggacctcgtcttttgaaactgttaatgactttatagcgtttcttacgctaatttgtaaattaaactatagagacctggattcagagtccaaggtttttgtattcctgaaaccacattgcatcacatgttcaaaaactttcttatttacttcccaagcagagactttgaccatgatattaaacatttagcaacagtttagattatttgtttaaaaacctactttcaatgttgtctccttctgagttggaattctagtcaatatctaccaaccacatttcagagaaaagattcaaatgccttctctttatgataaaatatgtcaggaactagatatgcatttataaggggtataaacatgtcacagggcttaatgggcatgattaaatatgtctagaaatcaataatgggcctaagtcagcactgggacatttttgtgtggacactgggatcctctgaatacaggtagcttttaccttgaaaaaactaatatccatatgttgcaatttctatttttatctagagtagttagtcttatccttggctgcatagtagatgttcccaattgtttgttaaaaataccaatactcataatttctgggtatagtgctttttttttttttttttttttttgagacggagtctcgctctgtcacccaggctggagtgcagtggcgcgatctctgctcactgcaggctccgcccctgggtttacgccattctccagcctcagcctcccgagtagctgagactacaggcgcccgccaccgcgcccggctaattttttgtatttttagtagagacggggtttcaccgtgttagccaagatggtctcgatctcctgacctcatgatccacccgccttggcctcccaaagtgctgggattacaggcgtgagccaccgcggccggccggtatagtgatttttaaaacaattgtccaggtaagtatgattgaagtaaggataaagatccactgatctagcacgtcaatgttcacctaagacaagttcagctaatacggttctaccacatacattttctcccttgccaagtgagactattttctgtactttgaatatgacacagctctgagtctcttgtgcattttctcctaagtgccattaatgcttttatttatttatttatttgggtgttttttgtttgtttgtttgtttttgacagtgtctcactctgtcacccaggttggagtgcagtggcgtgatcacaagtcattgcaccaccatgtctggctaattttttgtatttttggtagagacagcgttttgccatattgtccaggctggtctcgaactcctggcctcaagtcatctgcccacctctgcctcccgaagtgctgggattacaagcgtgagccaccacgcccagccttatttcttatttctttattttttgtagagatgggggtctccctatgttgcccaggctggtcataaactcctgatctcaagtgatctgcctgcctcagcctcccaaagtgctgggattacaagcatgagccaccgtgcccaggctttcttttttattttattttatttttttacaaactgctactaagcccttactaagctgtaatttgtggttgatagcagaatttcagaaataaacaagagttgactactggctataaggagttcgcagtttactaagactgaggtacaatgctacaattacaatcatagaagaaagtgtcagatgcatgtgtatccccgcacataaggatgtagtggcaatgatgaggatgttccaggttgttgccaaagagcaaaggcataaaacagcatcatgcacccaacagttgcaaattgttgagtgttgctggtgcagaatatttcaggtaaggaatagcagcaaacaaaggtggagagtgggtaggaactagatgataaaggctcttttgttttttttgtttgttttttgttttgttttgttttgttttgagacagtgtctcactctgttgcccaggctagaatgcagtggtgtgatcttggctcactgcaacctctgccttctgggttcaagcaattctcctgccttagcctcctgagtagctgggactacaggcatgccagcacacctggctaatttttgtatttttgtagagacagggtttcaccatgttggccaagctggtctcaaacttctgacctcaagtgatctgcctgccttggcctcccaaagtgctgggattacaggcatgagccaccatacccagccccaaaagtcacacagatattaaccagaaagtactcattctctaagccaggaatcgaacacgggccaccactgtgaaaggagagaaccttagctacggagctacaacactgggcctaatttttgtatttttagtagagacggggttttgccatcttggccaggctggtctcgaactcctggcctcaagtgatccacctgccttggcctcccaaagagctgggattacaagcatgagccaccgcacccagctggcaaaggctcttgtaagccacgtttaggaattagaacttatcttgaaggcggtgaaggggaggaaccggatcaggtttgtattttcgaaagtatatcgatagcagtgtagaagacacactgggatcagagagtagtgcagggagaaagagagactggaagaagaaaaaccgtagtatgttgccacataaactcatcttccattcattccactctccaaaccaatggcatcttctgtggtgttcatctgtgagatgaacaatatgaaactggccattctgatgaaccagaacatgtgctgctcttgtgaagcatacattagaaggaaggaatttccttccccttttccccgaaatcaaggcctgaaatgccagaggaacggagtcctagctaggggccaaagtctttacttagaaactggcaggaattttgctaggcaaattcaccaacccatatgttacgtgttagattggatttggagaaaggtgcttagatataattgtgatattgagtctgtggaggatggtgtgcaccaaatagaaaaaggagcatagtctctggctcttcatagagtgaccccatcagagaatgggggcaagttcatcactgtggcaagaccatggtgtcatggctaaggacagaggttttaatcaccgtatacttgagttggagtcctggctctgcctcttagtagctgtgtcatcttgggcaagtaacattctctagtcaagttttcatgtctaaaatggagataataaataaaacccccagccaggtgcaggtggctcatgcctgtcatcttggcactttgggagaccaacaggggtggctcacgaggtcaagagatggagaccatcctggccaacatggtgaaaccccatctctactaaaaatacaaaaattagttggacatggtggcacacacctgtagtttcagctactcaggaggttgaggcaggagaatcgtttgaacccaggaggcggaggttgcagtgagctgagattgcgccactgcactccagcctgacaacagagcaagactctgtctcaaaaaataaataataaataaataaacaaatcccccttcaaatgggtgtagtcaggattcaattagaatgcaggcaggatacttaactgtagctttattcataatggtgaaagtaagcaccaaaatatcccaaagcaaagaaatggttaaaatagagagcatctccaagatgtaagattatgtagtcattaaagaaaaaaaagcaatctttgaaaacacaaataatgatctgggaaattgcttatggcatgaaaataaaatacataattatatactgaatatggttccaattttgattatgacatatacaaatgctgaaagaaataaccctaagtggtgatattataatgagtgtttaatgaaagttagttctcattaacattcttcttgtcattaatatacatgcctctgatgtcttactccaaagaatttgaaattcctacacaaaatcacacaaaggtaggcatgtggttcatgcaggtt

SEQ ID NO: 410 - DNA, 48589 bp, Homo sapiens
aagtatatgaccattattgaaactggtctcaagaccaatctctgccatttccctcccttttaccagctttttcttatttccattaggaaaatgaatctataagagaaatttaggaagagggaatttaatatataaaagtaaatttttcaatagccacaaaattgcataacaccattaacctcaaatatttatttttgaaggttgatattttaatctcttccattttcctcaactatcttctcattaggcagcaatctggttaatatgaaaataacacatttcatatgtatattacagtttataaattactttcatattaacttatttgatcttcacaaaaaatgctttaaggtaatctaaacagaaagtattattttgattttatggatgagaaaataactatccaaaaagattacataacacacagctcataagtgcttaagccaggactggaataaagactgaaattttagatttctagctctacatcagtttgtttgtacttcaacaagctacatcttgaaaataagtacacaagagaggactggaaaatctgtctacaaataatagttaaaaaaaggccaacttaatattcttcactacagtcagacaataaaccttgaattttaacaatttataatagatgtaaaacaataattacaaagaaatattgtaggtaagtattaacagtgcctttcatctatagaacatacagtaatttatatttctctcaatattctgagcaaagcaggtgacagttttattaaaagttcaaatctattgttagacatatgtatgtaatgtatagaaataccagtttagagtttagaagaaacaggcaccatggtatactgctagcagagtattcactggcaaaactattttgggagtagtctggcaatgtatattgaaagcctaaaaatgcacatgacctctcgcacctagttatttcctttttaatttattgtaaggaaataattatggatgtctataaaaatgtgttcgcaaaaatatgttagtattgtgttaacagaacaaattaataaatggattggttaaatcagagtaaatgaaagaataaaacgtagagctgtccctcagtatttgcaggggattggttccaggactcctacagataccagaatccttagacgctcaagtcccttacatacaatgatatagcatttgcatataacctatgcatatcctccagtatattttaattcatctctaaattacttacaacacgtaatacaatgcaaatgctatgtaaatacttgttatagtgctttgtttttatttgtattttttatcattgtattgttatttttttttttcaaatattttcaatcctcaattggttgaatctggatgcagaacccatggctacccagggctggctgtagttcttaaaactgatctggaaaaatgcaaaagatatattaagtgggataaaacagatttctaaacaatgaatataatagaatcatattttaaaggatatgtatctctgtgtgtgtgtgtatatatgtatgagtatatatgtgaccaggatattacacaaaaatattaatagcgattgtatacaggcagtgttattatagataaatgtaattttattacttttacttttatattttctcatttctaaaaatgactaagtaattttcctatatttctacaacagaataagttaaatatctttataaacatatataaaacatatatagcatatatatgtatcatgtaaatattgaaactatggaaaacaaaggataaaagttgaatttacatctatcagagagctctagagccattatgtgtgcatatgaagatacattttaaagagtatagaaatatgaagaaggcacagcacataagatgagtcaggagagagaacaacagcaacttattaaggcaaagtgtccagtatcagaaaataaatgtgaattaagcagtacattttaatagctacagtttctcacatctaattaacagaaagttttaaatattgacaactttggaagtgaagaagtttaggcagtttttgaaaaaaatgtgaatacaaagttcattgggaatgctggagatacttctggaaagtaagatacttcaatcatatgctatagcagcatcaagaaaggtactaggtgaagatcacagcagcaaacataactcccatgttgaaactataatgcatacccatctggaatatgtagctctgctcgccacaccttagagtagatattatagaaacaaaaaataagtccagaaatgggaaaataaattatgaaatggcaactataagggatgaaattaggagtctctgaagttcaaagacaaaagaagctcagaaaaatatttcccaaagcttataagatcataaattttacagataagataaaaataagcaccaagagaccaaattaatatggcaaaagtttaaggcaaatccaaggaaaataaaatattttgatggaataggtaaaatatataagatgtataatactactgcatttagaataaaatccaaaatccctcccaagttccataagtctcagtattcctggctccttcctgcctctcagatctcttctcctccagctgtcctctcattccctaggccccagccacactatctccctcctgttcctctaatgcacctctgtgctcactattgactctgcctggaatgctcttctcctaggtttcacctggcaagctgctttctatcattgacatctcagcttaaaagtcacatcctcatgaggaccgtccctgattgtcctactcaaggctacttgctcttggaaccaaccaatattgcattacttagtttaattttcctcatagtacttatcatcatatgaggtcatcattcgtttatttattcatgtaaactgtttttctctcaaactaaggaaaaaaacaattaaagagttttatcatcaaagagactttccctcaccaccccaggctagttcagatcactctattttattactaacttccacctcaccttgtcatttttcttttgtaatccaacttatacttgtaatttattttccaatatctgtttttctccataaattccatgagttaggggccactgtgtgctatcttattaatcaatgtatacccaccagttaccagtatatggaaagtactcaataaatactttctcgaatagaagaataactggtgaatgagaaagaattgggaataaaaaggcagaaaaaggaaagcaaaaataaataaaaagctacatgaaaaaaattatggcattatattaaccacttactattccgttctccaaataccactgtttcctactaaacaagaatataacaggctctaaactgcatttgtaatacaatatataggaaaataaacttttaagagtttcatatctgcaatttatgccctgtgctttctgattcactttttgtaaataaaatcctgtggatctttggaactgcaattcttccaaatcagcaattcaagtaacaaaaggaattctggatgactaaaaagcagatgctgtctgggtgccaagcttcatgcctataatcccagcagtttggaaggccgaggcaggcggatgacctgagatcaggagtttgagactagcctggccaaaatggcgaaaccccgtctctactaaaaatacaaaagttagccaggcgtggtggcatgcgccagtagtcccagctactcgggaggctggggcacaagaattgcttgaacccaggaggcagaggttgcagtgagtggaaatcgcgccactgcactccacagccgggtcgacagaacaaaactctgtctaaaaaaaaaaaaaggcaggtgctaaaaacaaaaccagaaaagctattaggagaaacgtcataaagttggaaactgaaaagcatttcatttcatggaataaaattttgttcttcagtaattatgaaactgtctttgaaaactctgttaaaaacaactttgactcatgcctgtaatcccagcacttggggaagccgaggcaagtggatcacttgaggtcaggagctcgagaccagcctggccaacatggtgaaaccctgtctccactaaaaacacaaaaattagccaggcatggtggcacatgcctgtaatccaagttactcacaaggtggaggcaggagaatcgcttgaacccaggaggcagaggttgcagtgacccgagatcacaccactgcactccagccagggtgatagagtgagactgtgtctcaaaaataaataaatacataaacaaacaaacaactttgagacattttacttcaaaggtttagattagttcttatggaacatagctaataatctttaaagtcctttattacactaacagttcatctggagtaatgatattctaataaatgctatattttagaagatacataatattaatatctttgtcaaatatatcttagaattaccttctctgtcctctttataatatgtaaaagaaattgatgagtccagcatacgcttcatcttaaatgaggtgtatgagaaacatgctaaactatggttccctatctctgcttcacaatataaaggtgattccagaatttggaagcctcaactataacaaactagatgaagacagaagctgattagataaactgcagtggtcaggaagcctcaccaacagagcaaacaacctccatcttcagctgcttattgagaggccataatcctttgctgcaatacatacaacagtggctagactgaacacagagaagggacatctgtttcttaggcctgttctttctcataaatgattgatggcaaatatggaggagagtgatctggatgcacaaagaaacttgaaaattttactctagccaattttaggctttcgttaattcaaagctgtatctgccatacaacaagaacattttcactagatcaaaagaggaataagaatatctgcaggccttgagatttcaactattttgccttttaaactatatattagctgaacgtggtggctaacataaacataatcccaacactttgagaggccaaggtgggaggatcacttgagcccaggggtccaagaccaggctgggcagcatagtgagaccctgtctctgaaaaaaaaaaaaaattagctgggcatcatggcacacacctattatcctagctgctcggaaggctgaggctggaggatcacttgaacttgggaggttgaggctgcagtgagccatgatctcaccactacattcctgctgggtgacagggcaatatcctgtctcaaaaaaaataaataaataaaaataaaataataagataaaacaaataaagtatatattattcaaagtaccctgtgtcttgaactttgtggatcaggactcacagtaagaaatatattttacatcagaatccagtacacatccaatacatatacaattaaacaaaagttcatgaacgttacccttacaacatgtagtgaatatgttaagttgctattttatgtcatctttttaatgctggctacataccacaaatttgagtaatgagtcatcaggtacagtttgagaaacactgctgtacgtatacgtgtggtctggcctctgcctacctccctaaccacatttcatggtattttgcaccatattttccctactgcagccacccctgcaccatcccaccacccagtttctattattttattacattgaaccataagttcctaaaatataccaatctcttttctgcctcagggtatttgatcttgttgttagcgtggcctggactcctccagatcactgcactttgtattatattatgcaggtctcaatataaaagttctttccacagagaggccttcattgaccacctaatttgaaagagccccagcctgcaatcccggcaggaggagtgggaacaggagttcattcattgcccttagcattcctgggaagtttgataacataatgtaagacaggcaaaaaccaaaaacagtattgagcaaatgtcactttctacctccctatgccattgcacaggtcatagaattctaactattgaaattctattccattttcttcatgacaacttttctgactctgactgagaagcagggactcaattgtacaatttgccccctattactttgtattctctcagaccacttagcgcattctttcttattttgtattcattccgcaaacatttgagtgcctaatatgatctaggcaatactgtgaacaacataagcatgaattcctccaacagttcacattttagtaagagtgacagatctataaacaaataatttcaaccgaatgaggcaagtacaataggagagatgtatactacataaaatggtgacaaaaagaatgaacaatcaacctctttttctttttttcttgatttcacagtgtggaggggaaagctctgaatatctgcatagattttaaatttgtatttatttatacttttttagagacaaggtctcgctatgttgctcaggctggccttgaactcttggcctcaagcaatcctctgacctcagcctcttcaatagctgggactacacacatatgccaccgcacctgactcgactcaaccctctttgagtagggaaggaaggcatcacagaaaagacacctacactgggtctggaagtgaatccacctttgcaaaaattataacagtgagagaaatctaacctaactgactccatattgcttctaacctcacaaagctaactgcccttgctcatacctgggcataggcaagctaactatgggagaaatttatagtttaactttgaagcaaggatggtaatagtcccttccaaaactgaccccctctagggactaaaacagccttgtaagactaatagaaggccgcaaggttaggactatgggagggacctaaaatctgctaaaatataggcataggtaagcaataaccagctactgttccttgcttttctataatttcttactattcagaagtcatgtagccagaggtcacaagatttgtaacttcaccaattgctcctttagataacatcactattgtaaaacctaagattggtcttgagatattttccaggcttctgcattctggcaaacctcctgatgccacccagatacatgcctcataccaagaaactgactctactagtcctatgactctcacctagacaactgactcagcacaggaagacagtttggaaacacctataaattcatccccaaccaatcagcagcgcccattccctaccaacctgcccacaaaattatccttgaaaaccacaacttccaagctgtcagggaggcggattttagaaatatttcccatccttccactcaactgccttgcctccattaaactctttctctgctgcaactcctgcattctcaatgtttggcctttctgggaagtgggcaagaagaacacgttggcctgtaataggagaataaataagtttggcaagcaacaagagggtgcaagtattctgtgtagaaggaattgcaagtgcaaagtagaaagaggaggcatactaccagtttgaagttgcttggtatgttcaatgaaaagcaagtagctaaaaggcaagagaattttttttttttaagtatggaaagggaaaggcaaaagctagacagaaaagtgcttgttcatggaggaacttgtgtgccattctagacattttactgtaggaaatagggaatctagagttttaaggaggtgagtaaatcaacaggttgggtttttaaaaattccttcttgtggcagagaaaataatggattggagaatttccagaccagactgtaaaagtcactattaaaataatcacgaaatgaggagatgacaaactaaaatttgatctagtgaacaactgaatatgggagaaatagaagagggaggaatgtaggataactctgatttctagtttaggttataatatagtagtagcattatttaacttggtgaaaataggagaaaccaggaggaaagatagcaagttcagttttggtcatattaagtttgaaggacatttgagacagatgtgtccgggaagcaactgagttaggcattagtagatctgagaggaaaattgaaatttagaagcaaaatcaaaggtgttagtagaatccatgtgagtggacaaaatcacccaaggaaaatgtctagactaagaaatgaaagtaatcaaggagttaattccaaagaatgacattcaaaaaccaggcacagccagtaaaaggaattaatgactatgaacctcagttgtcacaaagagactaagtaatgtaaattttgagaagtaattactgtatttggtatttaaaaggccattagaaacttaagcaagaacaactttcttgaagccattaaagaagccagacagaagacttttgtctgtttgatataagtaaaaataatatcctttcaagaagtttactgatagataggaggactaggaaataactggataaacacaggatggaggacatggttttgctttatttaattttcataagatgtgtgacttgagcactgaagagaagaaactggagaggaaaaggctgaacgcacaggaaagaaaaaaacaactggaagcgaaatgtaacagatggaagcaaatgagatcaagagcaaagatggatggattatcctttaatatccctttctctacactagaaatacaagactaaaggctcggcaaaaatatagagcaatgtgtaggttgggggcatgaggttgaagaaatggcctgttatactccatcatgtttagaaaggagaaatgaagagggcaaaagacagggtttgtaaagggaaggtttgaaaatgtcttcacagagaatgggtcaggggaaaactggggtaaccaaaaggattgctgagtagtatgaagaaacaaggggtggtgggtgagggctctgtttctaaattcatagctataactatctaaagatctttctatcctccagtccgttatccataagtgcttaaaagatatggtagttaagtgaattaactagaaccctctcaaacataggggtgaattaaaataacctataggcttatttaaaatgcaaataccgagctccattcctttcattcagaatttccaggggtgaagcccaaacagtgaattccagaagctctccaagcaatcccaggagaaatttctgtttaaaaaaaaaagaagaagaaagaaaagaaaagagaaaagaaaagcaagcacagacctagaaggtaaccaactggatagaagagcgctgatccaacatacacctgttaatggccctcgtgggggcgtggggcagtgctctgccactcagaaaagcaaaaagactccaagatctagggagattcagatcagtgttgagacagtcacatacacaccaccccatactcttaataaagcgcgttaatgtgaatctgtgaacatgaaaaatgccatgatgaacaatgcaaacacataatgtttgttcaaaacaggttattagactcgatgccttaccctaaattttctgtttcattactctagagacttagtaacattagtggaattcagggtgctgtaagaaatacggagagcgaggagactgcaggaacagcccgtgggaagggggaaagagataacggggagaaggtcgggaggaccggacaactttaagtgcccatccgcccgaagacttggaaagctaagtaagtaggaccccagagccgttcttctggcatcccctggcactcaccattgtctcaggatctcagcactagaaaataggtatcgttgagacaggaagacaccaccaccaccaccatcatacggttactcaggcaacaaagccccgcccactgtcgcacgaggcgtgggacgccaccgccccacctcttcgtccttagtggctgggagtaatctcagctgcgttcatccaatcgacagacccgcccctccacgctgtcgcctggggctacgagacgccattattctgtttccggcagttttacttccgtttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggtaaatccgaggacaagcaggtataactaaggatgttggaaagggacggaggtctggctggagctcggtggccagtagctttggatttagggaaagattgttccgggaagactttttcagacagggatgaaacttaggtttcgacttccccggacagcaaagttgacaggcttgtcgcttcccggcctatcgctttcatacctgctcactccccctacttacttcttcaccccctccgcttcatttggcatttgccagcaggcactcgctgtgcctgtacgtttcgcagagcagctatcaagggcagtttcagggatcgttactcttacgaagggttttttggatacctcttttcggagcagtagagtgtaagtgtagaaaagtttgtgactgttaagaaagttagtcgtcgggttcactaattgaactgagttgtatctagtactgagaacgatctttttttgtagtgaaaccagttgtcatctagtgtacagtttgtcatatttatatcattgcagtagcatcaccttcttatatgttctctggtaaatctgagtctgtactgtaagacaatgtatacatttctgaaagcatgggctcgatatgtttctctttttacttttggagctacactattttaattttaactttttattaccaaaaaagtataaattatgttatcttgagtaatattttttgtcgtttgttaaacatctaaacagaagctcctttttgatatgtgtgtgtgtgtatacaaattgtgtcggtatgtctcctaagaaagtaattactttaaaattcctcttgtcatatggatgacaaaaccaccacagtaacttcattccctttgcttggctaaaattcaggacatacttctgacaatttagagtgtattggtgaggatggtgaaacggagtatttagaagtaaaccacccctaatttttttttttgagacttttagtagacataacaatgccttctgtgagaatgggatataagggacatttctctttctaaatgcatgcgtactaaatacagaagcaattaaaatatcataacttttaaattggaggtactctatgtgtttatatgatatttttaaaattatttcatatgcatacatttctaggttgttcagcagaagtcttggagtgcattttcagtggttaaggtgaaaaaatgactactaaaaatttagaaaccaaaggtaagtggcttttttataattgtttttaaaacatgacatttatgacgatgtgaaggaacgtttgagccagataactagatctcatggacccccttgggaatcatttgttatttcagatccctttatgtttattttttagtgcagtgtttatatttcagtactttagatgtacaagtgaaatttaacatcattagttagaatttattaggtgactactcttaaacatttaatgttaatgcaaagtttttaacagctatattccctatacactagaagattacgatttaaataagaatacacattttaaagatttaagtagatagacaaagcaactagggtgtatcaaagatctctttcatgttgtattagtttgctggggttgctgtaacaaagtaccacaaactgcatggcttgaacaacaaaatgtattctctcagttctggaggctagaagtccaagatgaaaatgtcaacaaggctgtgctccttcggaaggcattagagacactctcctagcttccagtggcttgctggcagtctttggtgctccttgtcttgtagacgtaccacccttatctccgccttcatattcacatggcattctccctatgtgcatgtttctgtgtctaaatttaccctttttataaagacagcagtcatattgaaaaaaggaacccagtctactcctgtatgatttcatcttaactaattacatctgcagtgatcctgtttccaaatgaagtctcattctgaggtagtggggggttagtacttcaacaaataaagatttgggggacacaattcaacccctaaattgctaaatacagtagtcactttttagtcctagctgatttgtcctctctaatatttaatactgttgaccattccctgccttttgagatacgttcttttgatgacttccatgacatcacttttattttcagtctactctgtagcctttcactgtccaatgcggtaattacatgtggctatttgaatttaaattaatattttttaaaaattaaaaattcagtttctcaatgacgcttgccaaacttcaagtggtcggtaggcaaatatggcgagtagctatttcaatcattgaagaaaattctgttggacagccctgctgtagctgtatcttctctctttctttttcagcctcttctccttcttatttatcttttaaatatcaacactttccaccactgtttcttttctactctcatgacttcagtaattatctatataaatgacttccaaatctatctatatccctaatctccttctttatgattcatacccttatagactactgcctactggccatcttcacatagctgtaggcaacaattttaacatgtcccatagtgaacttctcctgacccagcttattctttggatgggttgagttctgcatgctagaaccatcagttaaagatggaaaactgttttctagatgccaatttttcagcaaactgacctccagccacaaaccctctctaaaagcaggttgaaataagtttaagaaacaaggaagaaagatcatgctaataaatatttaattgaatttaattcagctttgcaacagcatttcataagtcaccagaaggcttttataccattagataagcaagtcagagactgtaatgaaagtaataaactggggattaatgggaaataagagcagttaaataattaatgtgaaagcaaccaacatggtgcttgtcaaaaagcaaaaactaaatacaatattatgattagtcattagaagtactggcaagttctctgtgaaattaaattactttttaatatttattattacttgtttttaatgaggattagagttataaggcactttaacaaacattattttgtgtgatcttaattatccagtaaggaaaataattctattagccatatttctatttaatctgtcatctgatgttagtgaacaaaagttacttgtattgcatggcctgtgaaaaggtgtacttggttgacatttgtcagttgtctgtgcttcctgtaactgcctcaggagataagtacggttgtttggtatagcaacagaacttcctctcagaagacatttgagcagcactgtcatcataagagggttgtatcatggctgctagtgctgtttctgaaagggaaacatacagtaaatagtaacaattagaaacttaaaatccaaagcttttcttggatgtgggattaaaattgaaaataaagctattaaagtcaactagtttagtaatagtagaccaaatagaaaggtctgagacatttaaatatttttgattccataaaatagtctaacactagttctgtagaataataggtgttaggtaaaaaagatattccatgagcagataaatttgataaatgctgtattaaaagagaggctatactatgggacctctcagagtcctatagtataactttaatactaatgtacattgaaactctgtagagatgcagtatgcaacattgcccacacttatttgaccagggatctctatccatagagcctgtggtaagaagaatgcttagattccacttcagtaaatctcgatgttactcttaagtccattgtatgtaacttattttactaatttaataataactaaactttattaggtgatatgggtgacatttaaaaagactcttgatttaaaattaccacatgacaatccctaatttgtttaactgtatcatagctgaatttgtatatgttctggaaagtctttcagactataaccaagttaggaattaatgatttagggtagaggaaaaaaaataaagcagtttttaaatgggttagtttttggatgttaaaaatgaaacactctaggtagtgtattaacagactaatgagcttcagtaagcatttattcattttctctgtgacaaggaccattttattagttcatgacacaaagattaggaggcggtccataccctgaagagctcccaacagtctagtctacaagagaaacaaattatttttaaaatatatactaccatgtttgcattactctgaaagcaccaagggatgggaggaggatgaggttaagtgctttgtccaaggtcacacaatacatggcagtagggacttaagttattttaactcaggctctagtgagttagatttcttttcactaccccattctgctgacttagagtacctctcatcatagattgaagttttatgaataaaagagaaatatttgttcaatgacagacaataaatttttttttgcctcaatattctagagcaagggttggcaaattgtggccctcagcctcctgagaatatctgcaatcagtttgataatagtggacattaacactatttaagccaaacattatcctgaattaaaaaaaaatctgttcttcccattattagacctatgttatcaaaaaattgttttcaattattgttgttatagtttgaatttcatcaataaattttttttctcttattaaatacttacatggtatcctcaattttaccttttggttcacaaagcctaaaatatttactctctggtcctttacagaaaaagtttgccagctcccatcctagaatgttagactagtgaccttctttgttctttccctacatttcaccaatcctggtaggcaatacgaatgagcaaaccttagatatgttttaattcattgataattgatcacaggtggaagtaatgatgatgaataatttaaggattgttttgttggttcccttcaaatagtggggaagaataaggattggtgtttttcttgacttaagcgttactcataattatggagctgttaccataggtccttgtcttcccaattgagagaaggtaattattcgtaaatgtgtcctggattgtgcctactgcatatgtaataaaggtttctaggtatgtcacaaggaaaaatcgaattacgaaagttaccaggtgagaaaatgttaagccctggctcttacggcctgtttacctatgcacattagctagaatcatagttattactgagcgggagctctcacgtaatatataatacaactttgatattcataaatgcttgagtaagtagaacagtttaaataaagttaagagtaaattggggtggaaacaagttggttgaacttcttgattttccaacaaggtattttgttcaaaaagagatttctgttaaatacctattaatggttctttgccttttaaatttaactttaatcattttgtaatttgttcttgaatctctgttacttaaaattccaactcaaaaatgttacagcttgcctagaaattttatttgaccataatggaagtatcacacctgttttttatttcctcagcctcagtgggcctgaaccatggctgtagtgcgtgtttttattgttgatggtttttattaatttatagttaatacatgattctgtgttacttcttaaatgccagaatgtcttattgacaagattagacaagttagttaagtttagacaaacttaaaatcagattttaagaatacaggtagctgggtgtgatggctcacatctgtaatccaagcactttgggaggctgaggccagagaattgcttgagcctaggatttcaagaccattctggacaacatgatgaaaccctgtctctacaaaaaaaaaaaaaaatacaaaaaaaatacaaaaaattatttggtcatggtggcacatgcctgtagtcccatctacttgggaggctgaggtgggaggatcacctgagcccaggaagtcaaggctgcagtaagctgtttttaaatgattcagtggaagttctccttgtcagtgctaccatgctttgttttaactaatttaccaaacccagcatgttaggcctttatttcactttctgaagtattcctttgtttatctttttaaaagtagagtcaatcccaaggcccaaggggtgtttaaacttagtttacatttcatatggaaatgacacgattttattctaatgtaaaatgttttgtaaaatagaacacattaattatacctcagctatgtttccacctcctgtctaattaacataactcgaggttcccagaacatttctacatgggaaaaatttgaaaaaagtaaatctgttacttgaataaatagtcctatagtctagcaatataactttaagatttacataacagaatgaaagtcagaattgtattttatggcattaaataaattaactttatttctgtctatatcaacatccaaagtttattaggaatttatttaaagaataataaaagcaataggacctaacatttaatgagtgcttactgtgtcaaataccattctaaacagtttacatgtattcttatttatttttaagtacaatataaatcataggtattgagcatgcaaataaataaatagtaaggatattaggcatagatccacagatacactggtagagtgattttcgaaggcatttcggccgtacagatcttcaccaaacccattaattttatgcttgggaatttatttgaaaaaataactcagaagttaagaaaaatatgtaggcataaaagtgttcaataaagccttatttattatagtgaaaaattgtaaagagtctaaatattcaacagtagaataagaaagtaaatgctatattaacttgaagggaatatattctagccataaaataaaaaatatgttaagcttacgaaatttattactgttacaagtataaaaggaattctgttttaagtctttgttttaggagattacattacacacacacatatatatataaaacatatatataaaaaacatatatacatataaaacatatatatataaaacatatatatatatatatatatatatatatatatatatatggtctggctggacagtgatgaattcactgaagaccaatcagtagttcatgattgtccttaatgtttctatagacataaaatttctattgaaatatttttataccacttacctgcacacttattatatattatcctgtaatacattttatctttttatatgtatgttctgtcccctaaattaggtagtaaatttcttaagcatagtggtcttacctcatagaatgtctagccttcattaggtacccagcatcatgtttgctgcccgtgaccactcagagttcatcattataaccattgttactgatctgtgtgctcgtcttttgtccctccccttgttatcattcatttattgtttataacatatatacatatatatatatatacacacacactacatgcaaggcattttattgggaatacagtgcactcaaaataaattgaaagccactagagggaatgagagaacaataaaagaatttgggtatgatatggtgaaagtgaggtataaggatgtttaatctgacaatccagtgtagtttcacttgtgtaagcaggacataaactgttaggcctaagaataggattgaatcttttcttaataaatttttcggtgtaacatatatgttgcttcctcttactccaagagttcacaaaacagatgaatctcttatgatgtagatggtttcaaatatgcatctatatagctgacatttattttaactaacattattgagtgtctacagtatgccaagcatttcatcttattacattttttcttaccaaaattctatagcaaagttgttatgatctccgttttgcaaattaggaaatagagattcatggaagattaaattatttacccagggttatactagaaagtaaaagtcagaaccaaatattctgattccaaatctcttgtctactgaaggaaagtttaaacatgtatcttttgttgacacatgattgttttgaaaattactttttctctgattttttttttgcattctttttagtgccagtaattttgaatatagggtatagcatgtattagcattttcttggcatttcttcttggtaagtagtttctgttttgtttcctttttgttagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaagaagagccttaatcgataaaatgagtactactctttacgtctggaccttttaaacgtgcatgttagaaaactacatttctttatgggaatgtcattcatcctagcttgtcagttctctaaaatgcttcctcttaaatttctcattctttctcagttctctagggatactttatattgggaacttatactctaaacctcattgaagatggaggtgtgaggtgctttggacaagaccaccaataagttgtaaaagtaggttacaattataaactgccagaccaaagattgaccaagtcaggcatagtaattgaccagcagtccttgttttaaggatccgtaaattccaagtagttttgcttgtgtatacgggatacttggaataaagagaatggcgatataacttactgtgtcttcattgtaaatgaaaaaaatctgtagcccttaagtgtgttgctttaatctttgcatcttagtaaaaattgccttgccccttcccttgtttctctattagaccatgcatcttttggctagatacaagtcttcataagtgagaccatggttagtgtttttatacaaatatatttttaaataactaatttctcattacaaaatgtagtacaaatttatgtgtaaaaattttagaaaatacagaaaaacacaatgaaaatagtgccacctgaatcatttcatccagctatacgtgcataaccatatacattgagttcatttagtgtcacaacccacttttttcagttattaatgttctgccatgtcacagaatattctattacagtgtcattgttaatagtaacagtgttcttcaatagctataccatataccaataactgttattggatatcttttaattttttgctcttttcagtaatgatgtaaagaacatacttagaaacatactggattactttgctttattttttaaaagtaaattcttaggatgcaatacactaacttataaatgtttaataaaaaacataaaacattctctgtcatattttttatcaaaatatattggttttgttttaattttttttcctttaagtgttgactagaagcaatttgttattttcataattctttttactcttactacaagaggctcagtttattaccacatggactgtggatatagatgtatggagagaagtagagagagatggtttgtatatcgtatggaacttaaatatttaattttactttttgatagaaacttcaagtcacggaggtccaaaattacacagaaacacagtctctttttgttaattttgttacattaaagttagtgatattactttgagcttgttgtattgattacgttctcttctaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcaggtattttctacagcaaatagtatttcacttcctagtttttgctccatcaggtttttgatctataacacaagaaagtagattgtagtgtgaaaatttctgactaaggtcatcagagtacttcatttaagatgtggactctctctcctctggatagtcacacagtctccctaaatgaagaagtgatataaggatcatcccttattcctgagttctagtttactgtatagtaaaaatataatgtttaagactgaaacaaaactgtaaactcagacatctagtaaacattaaaatcacaaaaagccaaactaaattatttttccccattcaaatatttggactccccaagataatattattcattctaaatgcgcttttctcattgttcttttaactatataataaagcttcccaacgtttttctctctatgcacaaatagaaaattataacatttttatgacatactggatgaggctactctcatatggcagcaaaaaccctggggttctcatccaggcctctcaacacactggtggttgggaaactgctatatagtatgattctttgtctatttatcccctccctgcctcaactgatagttactagataacaagatctggatgttatccatctgtgtatttctggaacttagcaaaatactttatagagtatgtttcataactgttgatttaaattgaatcatctggagatttctcataaaacaaccaaaggtttacaggttgtatttgaggaaccattgattttgatgaatacatttttaggaaaatgttttttcatgtcttaatatctctgacactttgtagtagtagttcactctctttaacagtcttttgtttatctcctaattgtgctagttcattatgctatttggaaaaatgaactatttattcacttagaatgaaagttaattgagttaattctcattgtacattttaagaggcaaatcatgaatatattgtacaaatttttgcaatatgcaactttttaacatcctgatcaacaccaatagtaacatttcattagatttttaaataaaaattaaatatgactttattggtattttaattgatgtaatcttctaatgtcaacattgttttcattttgaggaatttggtagtaactgcagtctcagacttaaattttaattttaaatttttcagccgattaaccatacttgaacattttgcttcaattccatcaatagaaaactggttaaataaaattttgtgtatccaatcagtagaaaacatgaagctaatttttgaaaaaagggaatgagatagctgtatatgtgctaatatggataagtctctaagataaattattaaatgaaaaactaagatttagaaaagttcgtattcagtatctctttttgtaaataaagtggataaatttatttttaacacatgtatatgttgaaatatacataaatttttttttgagaagtgtaaaaaaactttgttgactgcatataaaaggataggtatgctgggcatgacaaaagactttatataaatctttttatattaatatttttctgggggcaaagaggtaattgagtgaagaagataatttagttttgtttgtctctttaagtttttctgtatttaaaaatatttaataattttttctttcaaattttggtcaatctagagtaagattgagatgtactccaaaagtcattatataggaaagttgaataactcttgcctttgtcattgtctaaatgaatattttaactgaatccctttaatgaactctaagctaataagcatttttaatgctctttagctaaaatttaaaaactgtgaagtaactatactgttaaatctttgttagcttctgaaagtgacagtcacaaagtagtatattcaattttttacactgtattattgtcagcaaatttatatgtaagattttaatctttttcagggtaatggcagatgagttaaccaactcaagagcagctttacagcgtcaaaaccgtgatgcacacggggctatacaagatctcctaagtgaacgggaacagtttcgtcaagaaatgatagctacccagaagtatggcacttgtttacattctgaactcttctgctttctcctgcaaattaagttattgtagttttggtttttttgtttgtttgtttttgttttgggtgtgtctacatttgataacttactgagcatatacttttagtagcattttaaaatagatgctctgggagggaagaggactgaaaaaatagaaggcatgcttttcacattcttaattggggaaataattagttatatctgtagtagaaggattctctggatttaaaagcaattgctggtaatagttgtagtcgtacagttttcggtagaagccaaggagtgtacctgtctctcctgtggaaagagatctttttgaagacttcctacagtattagagcttgttttcatgtccatatactccagaactatcaaaattgatggtcttccttaaaagccttttgcatttttatatagttgatttattacacgtagaatcagtaagtgtcaaagagcaaattataggggaaattagaagaatgaaaacacaagaaacgtctaaccagtttaatcaggaaaaaaagagaagatatacattaccagtatcaggaatgaaggggggggtacaatatagactctatacacataaaaaagataatacagaaatgttatgaacaaatccatgtcaataaattcagtaatttagatgaaatggacaaactccatgaaagacaaactaccaaaggttactcaagaacaaatagataacctgaatagccctaacctattaaagcaaatataatttatagttaaaaattaaatattttccagtaaaggaaattccaggtctagatggattcactgatgaatgctagtaaacatctaaggaagacataaaaccaaacttataaaaattattctagaaaacagaagagaaggaaacaatttccagctcatttcatgagaccagcattgtcttgatatcagaaccattagccaaaacccaccaactaatatctctaatgaacataaatgcaaaaatccttaacagaatttcagtgaatcaagtccaacaatacagaaaaagttttatacattttgaccaagtaaagtgaatcccaggaattgtagattggtttagcattcaagaatcaattaatgtaactcaccaaaaaagaaaaaccgtatgaatatccccatagttgcacaaattatgtaagtagttcctatactaaaagatgagaacaaagaaaagtactgtttgttaaatgattttcatacaacaacctagtagattaacatatgctttctgtagtctaacttacttgactaagacatccgaatttatggaactctgagagagaaagggatcagagaaagatgttatataatttcagaaatatttgtattacctatttactattattaatttttacattttgctctcttactatgtccggtgttcatgtgtgttctatgcagattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggtaaaatattttcttttgtgatctatggaacttctaacactgtccttttactgaaaggtgacatatcatggaaagcatttggcattaggaattaggaaatgtgggatctaaaccactcatgctattgagtgtgttatcttggagaaaattatttcctcttctgcgctttaatattttctaacactactgttctatttttaaggacaaaaaaagtaattgttttgaaagaggtcctatgttttagctattaagtcactgataatccttttcatgagttcattttgatataaaaaccactgtgtagaatttttaatgtagattaaattagtagattcatagattacttctgatctaagaaattacttaatttccacatatagatggaaatgtatcaaatactacagtacagatagtatagtcctggatgaattcagggtccatgcagctggcttgtcaaatactcatctcacatgtctgtgacaacaaccaagttcaccttcgttacaactctcatgtccccatctgggtccctgcctgtcgccataactcttgcactattaaaatcttcaactcaacatctctgtctctgtgatctgtgatctcaactttttttctttccaactctgattcttcattctgactccctggatgtgaacacatctttgatcatataattgtttttattcccttggtccctatatttttttatgtatctcatcagctcactcttttagtttctcttcccacatagctttcctagactctattcataagtgccttactgccttatcttcctctccgagtatgctgcaaaccccagtcctgtgtcagttcagctgtttgcctttttatttcagtacccatcaaatactacctcacattcagcagatgactttccttcctaatccacagaagaaaaaggggacagaggcagaaaactgcctgaaggtttcattagatatctagaagcctatctgtatggcagcatacatttctctcagaggaaaaggtgtccttcctcttctcctaagcatacctcccctctaggccctggcttcaccctcaacagttattccttctctctgttggctctttccttttggcttaagaacatgtccaagcatcattcatctaaaaaagaaaaatcttccctctattgtaagatgtctggatatggctttatcaccttcctttcacatccaagaatcttggacaagttgtccagacatgtttgtacttaaacaccatccattcctcaattcctaccgtcacttaaatctgtagacttcctgccccactattctcagtaagtactcttaaaaaggtcatgaacatttactatcatattatactgtatcgagcattccttcctggaaactcccttgacctttgtaacatcactctttcttggccctgatgctacctctctgagctcttcttcatagacttttttcctcctttagatgttcatgtttcataggaatctgtgttccccttttcaaaatctcttcgttcctaaacaccatactcttgaaacgattcactacttttgtgaccattgtttctaagtttttgagggggaggggcatcctcttcctgtgacccctcttgagctttctttacataacatactttctctattctcttggtgttattctgtttaccatagctttatgcttgtgacttttccatctcagacttttttctgagtctgagagatttatatccagccaggtatttccatctacttgttccacagatggctaaaaatataatctcttttctccttgcttttgcatttgtacaaccccccacccctaaaaatctcctccttttcctgtattccctatcttgatgaattatacctactctatagtgctgttttcagatttcgataaaaaacacatataaagcctgcagcagtttccaatatattgtaatttctcaataaatggtagctatcgtttttactatttccttcattcccctagtcctgttgattttacagatcttaccagtttttttctaatttatcccctcccaagttcaaacacctgacttccagcctagcccactgcagttgccccctcactgatatccctgccctccttcttagctgctcctgcccacccactactggcagagagttatttcagaaggccaaatcagtcatcaaacagttcccagtctccctcattattgaatcagaattcattcatattgtatagaaggctttttataatctttcttccatctccccttctcaagaatcatttcccaagtgtcactacccactgcacttaacattccagcagggtttaaccacttttcatgatgcacataggccattgtatctcatgcctctgtacatactttttcttgtctggactaccctccccacacctcttttgttgcccaacctctgtaccacctttaagaacctgccttctctgaatcttgctggcaatctgaagtgttccttctccatccttccattgtactttgcacttatatctgtaactgctctttactgtattaaattataatagttttattttccatccctctcccaaattgtaaactcctaaagggctggggactttgtgtttttatgtttcctcaaggtctggcataatcccttgcacatactaagtgctcagctatttactgaatgagtcagtacctaaaattaatcatttttatccaaaattttgtttctccttttctattctctttgttgggaaattgtgtcactgcctacttagttgctgccagtagcatttggtatagttgaccactccctctttctcgaactattctttccgaggtttatataactttatagcttacaggcttttctcttttatccaaccattttatttcactatacaatgttaggtatcctcagggcttgatttagatccccttcttctcccagacctttatccaccacattctcctatttaacaaaactgacagcccttcttccttagtgtctcttaaacttttcagtcccattgcttcaaggtgccatcatttcttagctagattattacaataacctccctttttctgttcttatgtctgcttatgcatactgcttcccccatcccccacactgtgtatagaatgatctctctgaaaggcaccctgcataaaatccttccccatcactttcaggctaaaatacagaaacctttctgttcatattagtgggtcagtctcctgctcctgaattcccttagcattttgtttctcgctctataaagacctataatgtaataacatctttatagtatttgagaacttattttctcctctaaatttataagcaatgttaaggtaagcccttcatctttgcttatcctctaataccaaacaaacttccataaaaatagaaggatctcaaaaactaaattgaaaaagcagtctagttgaaaaatagaggtgctaaagtaagttgatggctcttaaatgatgccaggacattcttagagtagtgatggctctttgggtttggtggtaacttagaagggaaaaaaaaaatctgcaggaccacatgaccgctagggaaacaggcatcaccaaccattccagaaagctgctttgaacaagccttatataagaaagagagaaagcacttttcccaattcatttcagaattctttccaattgcagtgcttgctacctttgtaccataacccaaacacatcatgtggtgatgactgggaaaataggaacatgagaatcaagagctgtgagccaggcacgttatccctgcccttaactggagaaattttttcagctcaagagttcctgttttgggtctcagtaaaggagacagattaggaaaaatcagagcagaagaagaattaggagagcattgtgttgtggaacccaggaaacaaaaagtggctgtaatcataaaatactgcatataaattagaaaaagagaaatgaaaagccattgatactacagataaaaagttatcaaggattttgaaatatcgtttccatagaagaataaaaacaaaatcctgattctgagcagttgaatgaaagattgaagaggggaagtagtaagtccattttggttaaggaaaagaaattgacatcacttaatgatataattgacatgtaaaaaaactgacctcctggggggccgaggcaggcagatcacaaggtcaggagatcgagaccatcctagctaacacagtgaaaccccatctctattaaaaatacaaaaaatgagccgggcatggtggcgggcgcctatagtcccagctactcgggaggcagaggcaggagaatggcgtgaacccaggaggcagagctttcagtgagccgagatcgcgccactgcactccagcctgggccacagagcgagactccatctcaaaaaaaaaaaaaaaaagacataatgatataacctcattttcttctatgttttcctgctttcctaccaatatctgtaaaacattaacgtcattatttaaaaaaatatgtaacctagataatatagtaatcagacatcattgttaaatttacagcttaaggaagtaagttgtcttttcaatcagattagtcattctgtttttttagtaatagttatatattaatgaagtgaaactttataggtaggtatacatcaatgaaatcttaggcttttaccatctatattgcatacttctgacattatatcttattttccttaggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatgtgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaacaagtacttcagcaaaacatgctagttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttctttattgcgactattccttttttcccccagaattagtgctttggtttaggtctttgtctagcttaactacttccaattgattcttcagccttttcttttaggtttacttactataaaagtctcagaagaaagcataaggggaaagcttcgtgacattgtatttggcaatgatttcttgaatatgacaacagaagcacaggcaacaaaagaaaaaatagataaattgaatttcatcaaaatttcaaatttttgtgcattaaaagatgcagtgaaaaggcaacacagagaatgggagaaaatatttgcaaatcatatatctgataactgtctagtgtccagaatatataaagcactcctacaactcaaccaccaaaaaacaacccaataaaaattagcaaaggggctgggcatggtggctcatgcctgtaatcctagcactttgggaggctgaggcagtcagatcacctgaggccaggagttcaagaccagccgagccaagatggcgaaaccccatctctactaagaatacaaaaaattggcctggcgcagtggctcacgcctgtaatcccagcactttgggaggccgaggtgggtgggtcacctgaggttaggagttcaagatcagcctggccaagatggtgaaacccccgtctctactaaaaatacaaaaaattagttgggcatggtggcgggcacctgtactcccagctactcgggaggctgaggcagagaattgcttgaacctgggaggcggaggttgtagtgagccgagatcgcgccgctgcactccagcctgggtgacggagcgaaactctgtctcaaaaaaaaaaagaatacaaaaaataagccgtgtgtggtagtggacgcctgtatacccagctactggagagggtgaggcaggcgaatttcttgaacctgggaggtggaggctgcagtgagccgagatcgcgccattacactccagcctgggcaacaagagtgaaacttcctctcaaaaaaaaacaaaaacaaaaaaaattagcaaaggacctgaatagacatttctccaaaaaggatatatagatggccaataagcacatcaaaagatgctcagcataactactcattaaggaaatgcaaattaataccacttcacatccattaggatggcagttatcaaaaaagcaaattataaatgtcaaagatgtggagaaattggaacccctatgcattgtttgtgggaatgtaaaatgttgaaaacagtgtggcagatcctcaaaatattaaacatagagttaccatatggcctagcaattctgcttctaggtagattcccaaaagaaagcagaaactagaataggtatttgtacaacagtgttcacagctgcattattcacaatagccaaaaggtggatgtaacacagtgtccatcgatggatgaatagataaacaaaatctggtatatacatgtgaagaaatactattcagccttaaggaatgaaatttgatgctacaatgtagatgaacctttagaatattatactaagtgaaataagtcagacacaaaaagtcaaatgtcaaatgattccatttatatgagttcctagaagagacaaatttgtagagatggaaagcagaatagtggttatcagggactggagagagtgtagaatgggaagtttttatttagtgggtatagaattagagattgggatgacaaaaatgttctggagataaacagtgatgatggttgtacaacaatgtcagtctacttaatgctactgcattgtacatttaaaaaatatttaaaatggtaaattttacacgttacaattaaaaaactaaaaaaaaattatatacacttttgtaaccacaaactcgtggcacacttctgcaactgttggtttaacagtgtcaataacaataataataaagataagagttagtgagctaaatttaaaaaataaaaaagatctcaaatcagcaatctaacataacaccttaaggaaataaaaaaagaactaaacccaatgtgagaagaaggaaggaaattaagattagagtgcagacaaatagagaatagaaaaacaagagagatcaaagaagtcaacagttagttctttaaaaagaaagaccaaattgacaaatctgtagccatactgactaagaaaaataaaacaggtaaaactaaaatcagaaatgaaagtggggacattattagtcaccttacataaagaaaaactgtacaccaataaactaggtaaactagtttacagacaaattcctagaaagacatgtattagtccactctcatggtgctacaaagaaacctgagtaatttataaaggaaagaggttttcaaaaagggagaattattctgaggctagaccatgtgatgcttttacagtgcacttaaaaaaaattttttttcccacacaagagatttctaagtgtctaaattacactttttcttaaaaaacccagagtagcttctgttgcaatagctattaatgaagaaaacagaattcagtcaactgagaagaaaaaaacttttgctcaaaaagacaaggtcctaagaaataaacaaaaacataaaggccttttaaatacaagcatgcacacatgcacacatacatttacatatcttggatgttagcttttaattaagctgacttaaccattgagctcctaaaaattatattttccttcccagaggcctctcagcaggaatggacccaataccttccatttttaagtttacatggtatcaaaaggagtaagacagataaacaagtggagacaaattttggacaacacaaggggaagtgcactcgggcaaaacagattcaaaacctgatctcaatcaaaatgcaaagcgggtgtataaccaagccttattattgcttcccgtggcagtgccagacaaatggtttaacaagcctagatgggaaaacaataggctcccagcataccattcagttaactcaccctttgagttcgtccgctcctgatctccattctaacccagcattgtaagggttgtgcacttttgagcacaggacagccttcaagggggtccctgggaaaatctcacctgcagctgctgggatccccctaaagactgtctccttgcaagccactggccactgaatgcagcaccattccagtctctcctggctggcacgccaaattttgttcccagaccaaactgaggtttgggctgctgtttctcgtggcccaataacgagatgcaaatgaactggggaggaagggagttttcatttctgcaaccggttacagggagaaggcctggaaattatcaccagaccaattcaaaattacaaagttttccagagcttatataccttctaagctatatgtccatgtgtaagtgtgcattcatctaaggatgtaagtgattaacttcttttaatctataactaaggtctgagtcctgaaggccttcctctggagcctcagtaaatttacttaatctaaatgggtccaggtgctggggcagttacccttgtctcctgctaaatcacggaggtttggggagttccttcagacccccgataaacttgtttgtggaggcctggggagtttcttcagacccacaataaaacttgttcaatcctaaatgggccctgttaagaattcctgtattattttgtcatgctttaaggcccaggaaagacctaggcaaaactcttgatgggcttttgtggcatcccagcctttgtataaggagactgacttttaatatttaacttaacccttcagtcagtagtgaaacagtcgttatggaggcctgcattagtgagacctggcctgccacaatcctgtgttcatgtattgaaagactgtattattaagatggcagtactacccaaagcagtctacagattcactgagagccctatcaaaattccaacagcctttttgaaaaatggaaaagcttaccatcaaactcatatggaattgtaaacgccgtgaatagccaaaacaatgcggaaaaggccaaagttggaggactgacacttcccaatttcaaaacttactataaaactacagtggtctaaacagtgggctgttggcacaagtacagatgatactaacatacagatcaatagaatagaattgaggcttcagaaataaacccatacatctatggccaactgactttcaacaaatgatgctgcaataactgaatgtacacatgcaaaaaaaaagttgaacctctatgtgatattgcgatagaagaaatacatattttggtcttgtaccagtttcctggcacatagctcctaaaacccttgcaacatcccaagtccccaagctgtgagtatctttgtatgctaatgaaatgactaatgtctgggggatctggatggggggaagttgccaggaggaaccaaccaagtaattagagagtagacctccaggggagggggaagtcctgaaggttaagttgattaccagtagccaatgatttaatcagtcatgccttcataatgaagcccctccataaaaacccaaaaggtttagacagctttctaggttgctgaacatgtgcaggtaccgagagcatggaagttccacgacccttcctccataccttgccccacgaatctcttcaatctggctattcctgagttgcatccttttaaaaagagaaacagaagtgtttctctgagttctgtgagcgattctagcaaagtactgtgggaactgtaaccaggggacctattatttgcaattgatgtctgaagtggggggcagtttcatgggactgagcctgggtgtatggtctgcattaactctggttagcgtcagaattgaattgtagaatacctacttggtgtctgcagagaacggggaaattgcttggtcttggggaaaacaacctaaacatctggtgtcagaagtgatgtactgagtattgagagtatacaaggaaaaagtttgttttttcttactctacctcacgccatatataaaaattaagtaaaaacgaatcaaactggccaggtgcagtgacttacacctgtaatcccagcactttgggaggctgaggcaggtggatcagctgaggtcaggagtttgagaccagcctgaccaacatggcgaaaccccgtctctactaaaaataaaaaaaaattagctgggcatggtggcgggtgcctgtaatcccagctactcagcaggctgaggcaggagaatcacttgaacccgggaggtggaggttgcagtgagctgagatgtgccacggcactccagcctgggagactgtgagactgtctaagggaaaaaaaaaaacaactttgtctcttttttttgagatacggtctcactctgtcacccaggctggagtgcagtgatgcaatcttggctcactgcaacctccacttctggggttcaagcgattctcatgcctcagcctcctgagtagctgggactacaggtgcatggcaccatgcccaactaatttttgtatttttagtagagacggggtttcgccatgttggccaggccggtctcaaactcctggcctcaagtgatcctcctgcctcaacctcccaaagtgctaggattacaggcgtgagccaccgcacccagccagaagtttgtcttttaaactttgccagaatgcttacagtgactgtccattctccatcacacttgtatgcttacctttgtccttcaccccttacatgctcttacatgtatcagaagtactattcctctacacactggattcttgtatactcttaaatatcacatattctaccaaggaatgtaatctttataatataactgagagaaaggattttgcaaccatacagatcagtctatgtgaacaaaatattcatgtctatatagtttccttctctgcagaacgacactaatagggttgtcatatgattacattatttatataaagcatttataatacattttaaaatgttttaagctctcaataaaagttggctaattttgtaacatacctacctaaaatagtattacacataattgctattttatcatttcaagttttatttcagattcggggatacatatgtgcgttagttacatgggtatgttgcatgttgctgagggtccgggtatgattggtcccatcacccaggtaaagaacatagtacccaatagttagtttttcaacccttgctcccttccctcacccccaggagtccccagtgtctactggggacatctttatgtccatgaatacacaatgtttagctctcacatatagggtgtattttttaaggtactaacgggtggaattaggcctaccctattgcttagcttgccatgattattcaaatccaaagttgacataaataggactttaaggccttgaaccaggcttgtttaaggagtcactccttcagccttatgaaatgttccattgtaattttttaaaaataataggaagtatgaatagaaatctgtacctttcttgtgttttctcctagaaacgttaataaaataatttagaagtagaaggacatagaattcattcgttgttcaatttgttgcacagactaagagatggcacaacacattacaacactgtgagaaaaaaatttattttgttctagtattaaaaaaacaaattcactgtcaataaaagataaataccatttccataatttagaatacaaccaaagtacacagaccctaagaaatcatatccaaaattttgatagcagctgcccactgaaatatttaatagaaactttcagttataatgatcagtaaaacgaaaaggtttggcttctgacatatataggtggtgctgtaactgtttagaacgcttagcttctagtcggagctgtctagttctctctctgacagcttgttgctctgccattttttccatccgtttccttcttaaccatctgtagaaacaggcatgatcagatttggtgagtatcaacctgaatacactcttcatgctataaagttactattatagacaaaataaatggacatttctttacaatgaaatactgtcacagcacaaatttttaagtattaactgaaaaatgtaaagattacacccaaggctcatacaagaaaggaccgttagatttggggtcaaatgtttgaaattgtctgtcttacaatgaaactgccaacttaattggttttttaataataaacactattttatgtgtgctgtagatcctattctttttttagaaacaggatttcttactatttggtagattccaaataacttactctttgtaactagctgtattctaaaacattacttagctaggttaagaatactatcatgcagaaatgctgccttactcttcttataggtaaattatagagcttttaagtccacaaaatagttcttaaaatgaaaagtaagccaaacatgaaaacatcaaaagcaggaaaggaaaagtccacattctaacaaattcaagtcttaaaccttgtttaaataatagcaaaaataactgcatatacatatatacctggtatgtaagtgtgtatgtggtatgtttgtgtgtgtgtgtgtgtgtatatgcacatacatacacctggttttgttgttttttttttttcagaataaacaactaaataactgtattagaaaaaaaagaaacttactaaatatcataatctgatgatatgtggtcctgaattggctactagtttaagcaaataaactgtaagtcatttatgggttagttggggaataaatggatatgggctggatattcggtaatatcattaatgaaaagcagattgcagaaatacagtatgatctcagtattttgaaattgtaaatacatgtacagacaaatacttagacagtatgcatactggtgttaacagtcacaatttctgggtgatgaaaatgtaacttgaaaccgctccatttctacaatgcacatttactgtttctgttataataaaagggtatgttagaaaaacaaaaaggaggctgggcatggtggctcatgcctctaatctcagcactttgggaggccaaggtgggcggatcacttgaggtctggagtttgagaccagcctgagcaacatggtgagaccccatctctacaaaaaaaatataaaaattagccaggtgtggtggtgcacacctgtggtcccagctacttgggaggctgaggtgggaaaatcacttgaacctgggagggtgaggttgcagtgagctgagatcatgccactgcactccagcctgggtgacaggaaaagaaaaaggaaggaagagaaaaaagaaggaaagagcaaaagagacgaaagaatgaaatgaacttcaaacaattggactcaatattcacatttggtcccccaactctccccacacttgctagcaaaaatatgaagccacatctgtattgtcagaattaggcaatgcagtgtcttacccaaataactaaaaaatatcaggtttgccttaaattaccaaaatatgtacccaaatctcctttggtctatacagattttcctccttagtccacctgcctttcttttactggtaaatgcaacttttattggttgcatttatttgtaaattcagtttttctgagggctatgtaggagaagctgtaaccaatcttcaacccatttctcacagaaataagtaaacaataaatgataaggtatcaaaggctatcacactggtgccataagaaataatttaagtattgaaaagtatcttgaagaaaaattggtatgcatatatatatataactccatatatataatatatataatagagttaaagaattatacatttttaaaagcatgaatttaaaattgaataggtacgtgctgtaagagaaaacattttgagggttttttttttccaatcttaattgatgatataacttttaaaatgaacatgaggaaggaggaggggggaaatgccctgcctttaacttactgtttaaaggccctttcccggccttctgttcctttaaggaagaataaacattcctcttgctttcttagttcttctgtctgtctttctttcatctgctcttcgtgcttttttttaagccataatcgaaaagcttgttgtggatctctgttttcctgctgattagaaaaacaagctttacttagtttagataaacaagaactacattttgaagccctgcttatgggatcctacaagaatatatttcctactcttcaatttttcataataatgccagcctcattacctgcattcctagtatccaaaccaaatacatcacgcttaagttttaagaatatctttcagcagttacttaaaatggctaagcccatttttcaaaactgtagttcctattgtaaagggtggccataaggattttcagtcataagaattttcttataaagatagcagccatgataattttaacataagaaaaagctagtaggagtggcttatttcgtggtccctcaaagttcatgatggatagtatcttcagggaattttcaaaagttcaaagagctcttatttggaggaataaaggagagaaagaagacagatttggtactctttacccttgggaaaagtgtcacctcatgtggattcctggctagaatgcaaaaggaaaagatacattcatttaatacttcccccaaatataagctttgtgattgagcttatatcttgcatttccctcatctgttgcctatatcttgcattttttcccttgtttgtaacccacattgccaaatatgctctagtctaatttagaagattattcaggatctttgatgcacaactgaactttgtggagaagacccctggatctaaagaatcattgccaaacacctggaagtctgggaattgctagagatgacataaaaatgttcaatcgggagttatagatcaaaagagtccagatacaaagtaatagataggaggaataagttctggtgttctattacacagtagagtgactacagttaacaataccgtatatttcaaaataatgaggagaggatttttgaatgttctcatcataaagaaatgacaagtgtttgaggtaatatgctaattacacaatgtgtacatgtatcaaaacatcacactgtactccataaatatgtgaaattatgtgtcaattaaatacaattttaaagttaaaatatttttaaagattcaaggattcagggagcaacaggatacatgggtatccccattcttttgttctttcaacagatattcatagtatttactacatagcaggcactaaagtactgggttgcattaataaaattaaggttccctctctcacacattctgtactgtacaatacagtaaccacaagtcataagtggctatttaaataaaatttaaacttcagtttctcagtcatactagctacatttcaagtgcttaacagacacacatggctagcagctactctaatggacagtgcaaatacagaaaatttccatcatcccagaaagttctattggacagtgttctgcacagacaggataaaaataagtgactgactgattgattgactgatctgtctgattcaaaagaaaatatgggaaggagggtaataaacacagcagtgaggagaaaggatggtatttaaatagaaagggaggaagttatgggatatctggagaaaaacagtggtaacaataagagcaaaggagctaagaagggattgtgtttggcatgatcaataaatagcaaagaagtcaaagtgaagctgtagcaaagtagctgaagagtggaagatgaagtcagggaagtagtagggatcaggtaatgtataaccttgctggccatggtaggaactttggatttcattttgagatgagaagccattgggggtttctgagcataagtgacacagtttattcaccattttagaaatatcattctggctgctatgtggaaaactgaatgagggagaggcaaggtagaagggggctgggttattaggcttttgtaacagcccagccaacagaagaaaatagtggtttagattagggtagtgggactctgtatatgcactgaagatagaaccaacataatttgctcaaaaattgaatggatagttttatgtcatgctttaaatgattattttttaaattattccaggtttattagtataataaaaattcaagaaaatatatttttaaaacaaggtaaattacagcagaactatcatcagaatgatagactgcattggtatgcaaatatgtcactgcataagatcatagcaaataactctcaatagtggagggaaccaaaataaaaaattagaggaaaataaaaaattctaaagataaaatatgaattatacacataattagtaatggattaaattatctgattataaaaaaggataaatgactgaattggagacttttgcatccatccatgatatcataattggtatcagatttacccttctgccctaattagctataaagctagataaaatgtatgcagcagcttgataactgagagtaagaaaaaacatgatataacccccatattcaccctggctctgtacttggtgacactttccagacaacggtataggaaggaggagtcatagcatcaagcagtcactagtctcactgggctcatgaaacagataggagtctggggctgctgagacagctgaatttccagggcagggtactagaaatgaagcagtcatgtggagggatgctccaagagtctgtgtgggggtttcccttgggtcttggcaaggcctgggctgcacatgtgtagagtgaggctctgtaaggtctaacagagagtagctgctgttaatgaagaagataataaaggttgcatagttttggagacattggagttccaatccaactatagtgggaatacttcattgcttaccttggtcaaccacttacaaccctaaaaaggccatgctttggaaataagggtcatgtcctagagtaaggaccatgctctaggactaaggacaaaagcaaaataaacccatcctaacaaagcataaaacaaagtctgacaggatcaagagtattccttactaatctaactgcctacaagaaaaaaattcaataccctttaaaggaaaacagtgtattctatatttccttacaacttttatattgaaaagatccacagtctattaaccaatttaaaaaaaatcactggatatctaaagaaacaagaaaatgtgacccataatccagagaaagaggccttcaacagatcgatcctaagatgacatagatattggcatttagatacaaacaggtctaatatttaagaaatgaaaagatgaatataaaaaaggtctaatatgtaagaaatgaacaggtgaatataatgaataaaaagagaatctcagtaaagaaatggaaatttaaaaaaataaactgataggaggatccaagatggccaaataggaacagctccagtctatagctcccagcgtgagtgatgcagaagacgggtgatttctgcatttccaactgaggtaccgggttcatctcactggggcttgtcagacagtgggtgcagcccacagagcacagtggggcatcgcctcacccaggaagcacaaggggtcggggaattccctttcctagccaagggaagctatgacagatggtacctggaaaactgggacactcccaccccaatactacacttttccaacggtcttagcaaacggcacatcagaagattatatcccgcacctggctcagagggtcccactcccacagagcctcactcactgctaacacagcagtctgagatcaaactgcaatgccacagcaaggctaggggagagatgtctgccattgctgaggcttaagtaggtaaacaaagcagctgggaagctccaactgggtggagctgaccacagctcaaggaggcctgcctgcctctgtagactctacctctgggggcaagacacagctgaacaaaaggcagcagaaacttctgcagacttaaacgtcccagtctgacagctttgaagagagtagtgcttttcccagcacggagtttgagatctgagaaaggacagactgcctcctcaagtgggtccctgacgcccaagtaggctaactgggagacacctcccagtaggggccaactgacacctcatacagccgggtgcccctctgagacgaagcttccagaggaaggatcaggcagcaacatttgctgttctgcaatatttgctgttctgcagcctctgctggtgagacccaagcaaaccagggtctggagtggacctccagcaaactccaatagacccacaggtgagggtcctgactgttagaaggaaaactaacaaacagaaaggacatccacaccaaaaccccatctgtacatcaccatcgtcaaagaccaaaggtagataagaccacaaagatggggagaaaccagagtagaaaagctgaaaattctaaaaatcagagtgcctcttctccaaaggaatgcagctcttccccagcaatggaacaaagctggatggagaatgactttgatgagttgagagaagaaggcttcagacaatcggtaataacaaacttctccgagctaaagaaggatgtttgaacccatcgcaaagaagctaaaaaccttgaaaaaaagattagacgaatggctaactagaataaacagtgtagaggagaccttaaatgacccgatggagctgaaaaccatggcacaagaactacgcgatgcatgcacaaccttcagtagccaatttgatcaagtggaagaaagggtatctgtgattgaagatcaaatgaatgaaatgaagtgagaagagaagtttagagaaaaaagggtaaaaagaaatgaacaaagcctccaagaaatatgggactatgtgaaaagaccaaatctacgtctgattggtgtacctgaaagtgacggggagaacggaaccaagttagaaaacactcttctggatatgatccaggagaacttccccaagctagcaaggcaggccaacattcaaattcaggaaatacagcaaataccacaaagatactcctcaagaagagcaactccaagacacataattgtcagatttactaaagttgaaatgaaggaaaaaatgttaagggcagccagagagaaaggttgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaataccttacagacaagcaaatgctgagagattttgtcaccaccaggcctgccctaaaagagctcctgaaggaagcactaaacatggaaaggaacaaccagtaccagccaccacaaaaacatgccaaaatgtaaagaccatcaaggctaggaagaaactgcatcaactaacgagcaaaataaccagctaacatcataatgacaggaccaaatacacacataacaatattaactttagatgtaaatgggctaaatgctccaattaaaagacacagactggcacattggataaagagtcaagacccatcagtgtgctgtattcaggatacccatgtgcagagacacacataggctcaaaataaagggaaggaggaagatctaccaagcaaatggaaaacaaacaaaaaaaaaaaaaagcaggggttgcaatcctagtctctgaaaaaaccagactttaaaccaacaaagatcaaaagatacaaaaaaggccattatataatgatggggtatcaatccaatgagaagagcgaactatcctaaatatatatgcacccaatacaggagcacccagattcataaagcaaacccttagagacctacagagaaacttagactcccacacattaataatgggagactttaacaccccactgttaacattagacagatcaacgagacagaaaattaacaaggatatcaaggaattgaacgcagctctgcaccaagcggacctaatagacatctacagaactccaccccaaatcaacagaatatacattcttctcagcaccacatcacacttattccaaaattgaccacataggtgaaagtaaagcactcctcagcaaatgtaaaaacacagaaattattacaaactgtctctcagaccacagtgcaatcaaactagaacgcaggcttaagaaactcactcaaaaccgctcaactacgtggaaactgaacaacctgctcctgaatgactactgggtagataacgaaatgaaggcagaaataaagatgttctttgaaaccaatgagaacaaagacacaacatacaagaatctctgggacacatttaaagcagtgtgtagagtgaaatttatagcactaaatgcccacaagagaaagcaggaaagatctaaaattgataccctaacatcacaattaaaagaactggagaaacaagagcaaacacattcaaaagctagcagaaggcaagaaataactaagatcagagcagaactgaaggagatagagacaaaagaaacccttcaaaaaaatcaatgaatccaggagctggttttttgaaaagatcagcaaaatcgatagactgctaccaagactaataaagaagaaaagagagaagaatcaaatagatgcaataaaaattgataaaggggatatcaccaccgatcccacagaaatacaaactaccatcagagaatactataaacacctctatgcaaataaactagaaaatctagaagaaatggataaactcctggacacatacaccctcccaagactaaaccaggaagaagctgaatccctgaatagacgaataacaggctctgaaattgaggcaataattaatagcctaccaaccaaaaaaagtccaggaccagacagattcacagccaaattctaccagaggtacaaagaggagcaggtaccattccttctgaaactattccaatcatcagaaaaagagggaatcctccctaactcgttataaggccagcatcatcctgataccaaagcctggcagagacacaacaaaaaaagagaatttttgaccaatacccctgatgaacattgatgcaaaaatcctcaataaaatactggcaaaccaaatccagcagcacatcaaaaagcttatccaccatgatcaagtgggcttcatccctgggatgcaagcctggttcaacgtatgcaaatcaataaacgtaatccatcatctaaacagaaccaaagacaaaaaccacatgattatctcaatagatgcagaaaaggccttcgaaaaaattcaacagccctttatcctaaaaactctcaatgaactaagtattgatgggacgtatctcaaaataatgagagctatttatgagaaatccacagccaatatcatagtgaatgggcaaaactggaagcattccctttgaaaactggcacaagacagggatgccctctctcgccactcctattcaacatagtgttggaagttctggacagggcaatcaggcaggagaaagaaataaagtgtattcaattaggaaaagaggaagtcaaattgtccctgtttgcagatgacatgattgtatatttagaaaccccatcgtctcagcccaaaatctccttaagctgataagcaacttcagcaaaatctcaggatacaaaatcaatgtacaaaaatcacaagcattcttatacaccaataacagacaaacagagagccaaatcatgagtgaattctcattcataattgcttcaaagggaataaaatacctaggaatccaacttacaagggatgtgaaggacctcttcaaggagaactacaaaccactgctcaatgaaataagaggacacaaacaaatggaagaacattccatgttcatagatagtaagaatcaatatcgtgaaaatggccatactgcccaaggtaatttatagattcaatgccatccccatcaagctatcaatgactttcttcacagaatggaaaaaactactttaaagttcatatggaaccaaaaaagagcccacattgccaagacaatcctaagcaaaaagaacaaagctggaggcatcacgctacctgactgcaaactacactgcaaggatacagtaaccaaaacagcatggtactggtaccaaaacagagatatagaccagtggaacagaacagaaccctcagaaataataccacatatctacaaccatctgatctttgacaaacctcacaaaaacaagaaacggcggaaggattccctatttaataaatggtgctgggaaaactggctagccatatgtagaaagctgaaactggattccttccttacgccttatacaaaaattaattcaagatggattaaagacttaaatgttagacctaaaaccataaaaaccctagaagaaaagctaggaaataccattcaggccacaggcatgggcaaagacttcatgactaaaacaaaagcaatggcaacaaaagccaaaattgacaaatgggatctaattaaaataaagagcttctgcacagcaaaagaaactaccatcagagtgaacaggcaacctacagaatgggggaaaatttttacaatctacccatctgacaaagggctaatatccagaatttacaaagagcttaaatttacaagaaaaaaacaaccccatcaaaaaatgagtgaaggatatgaacagacacttctcaaaagaagacatttatgcagccaacatacacatgaaaaaaggctcatcatcactggccatcagagaaatgcaaatcaaaaccacaacaagataccatctcacaccagttagaatggcaatcattaaaaagtcaggacacaacaggtgctggagaggatgtggagaaataggaactcttttacagtgttggtgggagtgtaaagtagttcaaccactgtggaagacagtgtggcaattcctcaagtatctagaactagaaataccatttgacccagccatcccattactgggtatatacccaaaggattataaatcatgctgctataaagacacatgcacacatatgtttattgcagcactattcacaatagcaaagactcggaaccaacccaaacgtccaacaatgatagactggattaagtaaatgttgcacatatacaccatggaatactatgcagccataaaaaaggatgagttcatatcctttttagggacatggatgaagctggagaccatcattctgagcaaactatcacaa

SEQ ID NO: 411 - DNA, 28125 bp, Homo sapiens
tggatgtggatggacagaataataagactctttcaggaaggccagaacacagcagaaaggccctgaagaaaaccaaagcagctgcaggaagtttggtgtttgccaaggttgggggtgaaatgagctacctgttttgcagaagagatggggtgtgttttagcagctgacatcacagaaggtgcaggtcccaagacctaacaggagagcagctgagaagagcaacagctcctcatagacagggatggacaagctaggccagcagcgggggcagactctgcactgtccccgctgcccccagccgtggagagatgcgtgtctgccacaggggaagcagcgccacccaggggctggggtaatgacaggcgtggcctcttgggggtggacagtctagaacccaagcctccatccctctctgtggaggcatcatgggagtcgacttgccccttctggccacctctcagtcccaagggtgccacatttggggttctccaccacgcagtcactgcttgacgtggctcatggcctcccagcctcactgcacgggccacacacacttccctcagttcctttcctcattgtctccgcaaacacacagattcctgctgcctttaagactttactgctgatctccaaagagatgaagcaatctcaaagataaacatgaagcaaatccaaagaaatcctgcaaaattctgggagcgcctttctgtggttggaagctgggcacgtggtgggatgatcctgccagcctgtggaacttccgatattatggatgagggtggattttactacctcccaaattctaggactcacgctcttttttttgggtggggagggggacagaggctcgctctgttgcccaggctggagtgcagtggcacaatctcagctccctgcaacctctgcctcccgggttcaagcaattctcctgtctcagcctcccaagtagctgggactacaggcgcggccaccatgcctggctaatttttgtgtttttagtaaagacagggtttcaccatgctggccaggctggtctcaaactcctgaccgcaggtgatccacccacctcggcctctcaaagtgctgggattacagttgtgagtcgtcatgcttggcctcacgctctttcattcaaataatatttattgaggagcccctatgtgccaaaccctttttctagaggcttaggacacaacagtgaacaaaacaaagacgcctgcccttgtgacgcttacagtctagtggggagtggggtgagaaacagacaataaacataaggactaagtaagtttcataggaggttaaaagatgaaaaacgctatcagaaaagaaaaaatgggagacagagaatcaggagcacaattttaaacaaggcagtcagggtagatggacctcaccagaaggcgatgggaaaatctgaaggaaggagggagccaggcagaactggaggaaggatgaaaactatggaatgcttcctgaatatgcgaggcaatttataactccctgaaatgtgccacatgattcccaatgcatgcctttgcctacgctagactgcaagctccacgtgagaagagactgcttgacttgttctcagaaagtatttatgggatttatagatgcagttgtacagaatagaaagctgctcacaatcctcttcttcacctttcctcctagaaaactcctacacagccttcaagacccaaacacatatgggcagagttggttgctcctcctttgagctcgctactcttgcaccttatataaacctcttttatagccccaatacactgtgtttccctcattttactgcgggtcagagctttcccctgggttgagaacccgcaaggggatctgacctgtctgagctatttatggatccccagagctcctgggacagatgctcggctgacgttgtcaggattgaaatgacctgttactgctttaatgctccctctcaagtaggtggtttgcatttctgggacctttggcacctcagttgaggctctctggttgtgagcaagaaaactcaactattaactaaaggtaaagtaaaaaaaaaaaaaaaaaaagtgatgttggggatggaggcaaggggctagagccccaaccaaacctgcaggaaggaaaagccagggtagccccagctccttggcgcccgctgtgcttgggatccctggctgcacctcctaatgcactcggctccatcagctcctggctgcggtcctgcttcccaaatctgcagagcaggactcaagctggccctgctagggttggggcctcccttggagccgtcaaccatccaatagggcccagaatgaggtagagagatgagcccaagggtggggtaaggggctgaggttttgggggtgggcagtggcgaggggtccctggagaagaggggaacttgtgagcctggggccacacccaaagtgcctccttcactgggcccagcccccacccaagccgcatttctaatgaaggctttgttttgtaagaatttttaaatgctttaactagaaattggcaaactgcaacatctgccaatttctagcagtatatatcctgccaccatgacccatttcaagctagcatcgtgatgtctctgaacctgcgatcgggaagacatgcatgcagtcggctctggtgcaagctggctccagccaccattggctgtggggctgagggcacaagcctcctcatagactcctgtaaggagccctgccctgtcttgagaaccaccgaaagagctagagagtgtttcccatcctccagccatcctctgagaagtcatagctcaggtcctggatgagcctcccctctttcccaggaaccatcccttccttctggtgtggcccactggacaagatcgaatatcccaggtcctgcaaaacctggctccttccggcctctgggtctttctttcagttcctgggaggggctgagcagcctcctacctcctggccttgacccatattggcccctccaccagctgtgctatgtctctcatctttgggtctcagctgaaccacctcttcctcagagaggccttccctgaccacttctccctcccaaatttgcttctcccttgccagcacttaccccacgctgaagccctgctgtgactgtgtaatgtctctctcccctattagactggaagccgcatgagggcagggaccatgtggggttttggctcaccacactgtcccctgtgcttagcacagggccaagcctatagaataggaatcaatccataattattgattgggtaaacaaatgacacatgaaggaaggaaattaatcagtttttctgtacttcacagtttcttcttctgtaaaataaatataagaaagtgtctaccttaaaataatttttaacatttatagagcacctcctacgtaccagtattttacatatacttactcctttaatcctcacaacagcccagatagtgttaatatcatccccattttacaggtgacaaaactgaggcacagagagtttcagtgacctcccctcatttactcagatttgaacccaggcagtgcctccagcagcctcagcattaaccacacactaaactgccagggggggttggggaggggtcctggaggtggtagctttggcgctgctgtagccctgctgccccaagagcttgaagcctcgtgagcagagccaactattgctaaacactataaccaggggacgctcagggatccagctgcctctcacatctgggaagatttcctggaaccaagacaccctggctgagtcaggcacccgcatctgacaatatggccagagagtttttacgaaatgtgaaccaactggactctcaacagcttctccccaccccaccccaacctgtgagtgggactctgatcttgcctggggctccagcccagcccctcagggttcaggggtaaatctcacttccccgaggttgggttaggtatggttatgtgaccagctgtggccaatgagaagcgagaagaggcttttggacagaagaatctctgattctctttcacccacccttgccacatccatgaaacggaagggttcgtcgctgggttttgagacttttttccatgaagctgaaggccaagggagctgaaagccttgccactgaatgctgaaacaaccttcactggctactttagagataacattcataggtcaccatggtaatggtggcttcggttgtttttcaggaattgggccagctgaaaccagttgagacccttcagctggggaaccgtatatgtgcccaagagatggccatttgatattggaggaccaaaagcaccacgctcagatcaggccaatgcatctgttttctgtatgtgtcctatgaaatgccatgaaccccaactatgcttgtacagaacaaaccggttacgtcattcttccccactgccaatcacctgtccccacaccttagatcaccccacttctctaacccattcatatccctaaaccttgtctttggggaggcagatttgaacgctgttctcccacctccttgcttggcaggcttgtgaatcaatcttttctcttttgcaaatcccaagtcacagcgattggctgcacactggcagaacagattgggacctggcgggtgatacccagatatgacacctggacccagaacagaaatctcatggccaccatcttgagactgccatcctgtggccctgagggaagctggctgtattagttcgttctcacactgctatgaagaactgcctgaggctggataatttagaaaggaaagaggtttaattgactcacggttccacatggctggggaggcctcaggaaacttacaatcgtggtggaaggcgaaggggaagcaaggcaccttcacatgctggcaggagagcgaagtgcagagtgaagggggaagggtcccttatacaaccatcaaaactcgtgagaactcactcactatcacgagaaaagcatgagggtaaccgccttcatgatctaatcgcctctcaccaggtgccttccccaacatgtggggattgcaatttggattacaattcaagatgagatttgggtggggacacagagccagatcatacatcattggcctaagggcaaatctgttgtgctgagaatggagatatggggcagacccaggtccttagcgagctgctgagctgctcagctgctgaattgacggaccctgagccgccctgcctgggacttagggttacttttctctcttgctgctttgggttgaatatgtgtaccttgcacccaaaagcatcttaacaaatacagaaactacgaggcaaaaagcagagggggaaagggagacttctgcacgttcttaggtttcagaacaaggagagccccaccagaagctttgggagaggttgccttgagccctctcccgacactcagaggagctcagatgagctcaaggagcgtcatccctgggtgacggggtggggaggtgcagaggggaaacaagagatgagttaggattgggattcctggccaaagtgatcctgtctcctccttcccaggcagacccccaacaggtttgggacatccgagcttcagaggagccattcttctcttcctgggcaaaaccctagaaaggcagctgagaccccagggaagaaatggccccagggtgtatccgggcagatagggctgggtgagacagccctcagagaggcaaggaacttgtgtacaggaagcacccaggtgtcccaagagggatgaggacccgggaggcgctgtgggagtgagcatgaatcaggaggtatgggagtgggacccggagcccagagcagatgggacattgccaaactcgcagaggaaacgtggacatggagtgccccagctcctccctgctggcagggaggggcacttagatgcagccgcagggaaatatcggggggcggggaggaatcccagctgccaaaatcacatttctttgacttcagcccatggaaatgcctaatgggagtgaaatttactcagagaactaaagcacggcctgttttgtatacatctgcatttgtggcatccattccttcccaccagaagcgaagagcagccagccacctgcaggaaccgccccaccctcccactctactgctgacctgcagagggtcacctctttcctccacgcgcctacagccagccctctccaatgactccttcctcccgtgaagcaaccctacttctgccgccaatgccaccacctccaggctgcaactccacagcccacctgactgtatgctacgaccccagcccccaggtgctggtcaccaccgcctcctgtcctcctgggtctgaaggccagctgctccaaagccacgccagcttagccccacgcacccttgactcgtgtcctggaaatccctccttcctctctggctcctgcggccacccgctggcctcacccataatgttcttgacatctgtttctggtcatgttaagtttctgcctgtgtttctcctttcctccagacgcacacgtggcagtatgtggctactgtgacgggcctgccaagtggaggaggaggcggggagaggagaggggggctgcagggcctcctccctggccagagactgttgcttctcacttcgccccgcacctttcccacgatgctcagagaggtcactcatcgaacccatgccatttgagcacggctgtgtgccagacactgctaataccgagatacatcgtcacgtggagtcctctatcggaacaaagccaagactcacagagaggaagtgacaagccccggtcatactataggaaaaataatgttgtgcgccctgaaccaggagctggtctaaggaaagggtgtgctggggtcagaacccgcagcctggctccagattccatacatgccggcgtctgagcactcaccacctctctcaggcttccccagccctgtcccgtacacttagtattctctgggacaactgctgctaatttcacgttttctgtcccactgccacttctccatgggtcctggtttggggttctgaaaatagccatgcccctgcagccttggataccctgaagtcctcagtggggtaagagagaagggcttttgcatctgatattacagataaggacaatatggggcccaaaaaggctaaacgatttacccagcaccctccagtcctccagccaaacaagggactctcctgggcagagctgccacaggagcccacctcctggcaccccggcctgctggcttcccactggctaacgaaagccttgtgggagaaacaccctggtagacccttaatccaagctggaccccgtccccccaacaacccccagctgccctcctgcctcctctctgctgttgaatctctcaccaacttcaaagtcaattggggacatgcctccccctccaggatgacatcatgattcacccagtttctaggcgttctatgtcctcccctggaccatggcacaggccccctcactgcctccagcttcaccctctgcagcctgtgctccacctggctgcagagtgatctgcctcttaaaggcaccccagcacctaagaaagaggtcaatcctagacttagcctgacattccaggcctttcctgtctcaaaccccattctgctctccttgcctcctttccagacatctatccaacctactggtctctcccactgcccagagcatagactacattggtccgcctgcaaccctttcctctcatcagctccttgccccatgtcaagtgcctttgagactcctattcaccctccaaggcccttcccacatgtcccctccactaagaagccttcccagatcgccacataagaattatctactcccttccccacactcccatgtggcagaggagctcctgcgctcatctccccaggaaggctgaacacttccagacacaacctaacctagcccatgaaatggatccagcccatctatccagacagcaggtcaccagggacaccatcaagctaaaatccctgcaccagctctgcccctgattttaactcaggctcccatctaatcaccctttcccccttaatcttccctgcacttgccccgggccactcaacaaaacgatggcaaggtgggggtgaggtcgccctgtctggggtacactccttgtcaggggtatttttcatttcccacggctgcttcccctcttgaccaccctttccttccccttcctcattgcctaacgtttcaggcggaaaacgttttcaaaatatgtaacttaaagggattgccccagaggtgattacatgggcattcagccagcttgctgaggtcatcagtactaagcatggcagatctcctgggggacgctgtgccccacagacctggcagcaggattgggggcctccagtttcccaggacctttgaccaacccccgccaagaacgtgcccattgggagaagcttgtcacaaagatctagtggctcttagcacccatccgggtgccattgagtcagaaacccagacctagcgcaaaaaaacctggcctagacagtccagaggccacatctgagccctgggtggaggaatgtgtgcagtgggtcagatgggatgacacaaagacagccggcctctgttccctgaactaatgtggcctggaactgtctgggggacttggcttcagtttacaaaggataagcttcaatcctcctgcaggcacttggcaagaagtttcaaagctttgctgcctcagcgatcagcaaatggctcatccttgtgctgtacacgacaaaaggctcctggctggcactcaggacagcctttgtcccaaggctggtgaggccgattgtgtacaaatagagcctggcccagaaacacgctggagatcgctccccggggtagcctctgacatgggaggagcctctttggcaagagctgtatgaccctgaggtgcagtgggaagcctcccttcagtgtcaggggacctccgaggaaacggagacctgtctgcccctgcaaggtgggctgctgggctgggctgaatcctggcacaggtgtatggtcagttctcgatagcatgcttcttccacctggtgcccaaaagccatgcaacacaccagggacaacacagatagagcaggatgcccggtcaagtctgttgggaaatcagcgtcggtcactttaaatatacttatgtgagtagccaccaggctagcctagagagtccaaacttgacgacatattagaaagccaggccgggcacggtggctcacgcctgtaatcccggcactttgtgaggccgaggtgggcagatcacaaggtcaggagttcaagaccagcctggccaacatggtgaaacccccatctctactaaaaatacaaaaattagctgggcgtggtggtgggcgcctgtaatcccagctactcgggaggctgaggcaagagaatcacttgaacctgggaggtagcggttgcagagagccaagattgcgccactgtactccaacctgggtgacagagagactccatctcaaaaaaaaaagaaagccagatccatcaagatgctccactgtacaatgtagtagtgtgtgttttcccacagagaagatccaacagttctctcatcataattaaacgcaaaacatgcgacagggtccccggggcgggaggtgggggggcttgcgtgtgcctcactggagcataaacggcacaggtgctcagctctgcgccacacagttggcgctcagcagatgctgagcatgaacgcggcactcatcaagcaacctggcatctgatccttatgtccaccgcatgaggtagattaccattgtccccattttacagacaggaaaccgaggcgcagagatatggggacttgcccgaggtcacaaccaaagagtgacacggctgactctatgctggtgccactagctccaaggcgcgccagctgcgtgagtgacctgggggctcgcttctttgtgggcagggagcacgcagagtgggcagagggagccgagcagaaagaaccagtctgaatcgccaagaggagacagcattctttaatcatgctggacggcagggcgtggcggggtcaggcaggggcaggatcaggcagggtggtttatagcacaggtcttcctggcacttggtcagaccctgtttccgtcatctggccatggagccacggctcctcggctgtgagcaccagagatcaccccccggggcacctcagccccagagtctgcatgagcaccaatgggcggaggccgcctccctctggggagaagggcaggccacctgggtttggaaggctaggggaacaccaggccaccccaccctggaagaagaaacggaaggcctgaggtccctcctttgctctagctccccagacctgctgagggctctaaagcctggggcttccgtggcccttctcctgcaggtgtttgtaaaggcagcaccaggccggaggagggctctgagacgaggagctgcccacccgggccttagcaccttgataaagcctggagagtcggggcactgggccggtgagaggggcatgaggggcagagagcacctggggacagacatcagtgtctgagggcagctggaggccctggggaaacggaagttcagatgactttggtggaagggactgagcaaggccctggcagagccctgggaggaggcaggaaggggatcccagtgaggagggcaggtcttctcgcaggatgccgtatcagctgtggggagagctatgggtgtgggttccattcttcgggggccacttcaccccccaaatgcccccacactcctgggtcctctcctcacagaacccttgacctggccaaggccccctggggtttgctgtaacgatgagcactgggcaggtggatgaggaacgggaaggagatacctgcccctgccaccgggaccccgtcccaccagccttggggagcagtgggtaatggaggaccagcagcacctgaacacccagaacacaggcccccatgagctctgggtctgctttaaaacctatgtacacatctctccccgcctgggctggactggccagtcactgagggcaggggcagggcctgtgtctgaccccctcacccttcccgggacccagcacagagtgagtgctcagtgtttaatgaatgaataaatgaacggtggctgcagtggtgcaggcctgagcaagagaagagggggaaggggtaaagagaacatagcacggggagccctggagggatgagagaatttaagaatgttggaattggccaggcacggtggctcacacctgtaatcccagcattttgagaggccgaggcgggtgggtcacctgaagtcaggagttcaagaccagcctggccaatatggtgaaaccccatctctactaaaaatacaaaaattagccaggcatggtagcaggcgcctgtaatcccagccactagggaggctgaggcagaagaatcgcttgaacccgggaggcagaggttgcagtgaactgagattgcaccactgcactctagcctgggcaacagagcaagactctgtctcaagaaaaaaaaatgttgggagaattctagaatgtggggaggattccagaatgttcagaaagtactagaatattgagaaagtcctagaacctggttgctccagtgtggttcatagactgaccccatcagcatcacccaggaacatatgagaaacacagaatcctggacccactcagacctgctgagtcagaatctgcatttaacacgaaccccgggtgattcgcatgcatttccaagtttgagaagtgctgggctacgaggctgggaaagttctagaatatttaggttagcaagcttcttaaaataggtccaagagagaagagaggagcagaaataggctgggagggatgatggcagccaagatagaagcagggtctccccagaatgccaggtccccggggacctccctggccttcctgcttcacagcagtgcaaactgagccctgcaggggacgggaccagcacctgagctctccagccgggagggtggcccagaggccctcagtcgtcctcggccttgatgaggtggccgctgaaggtgatgtaggtgtcgaagtcgttgctgtagatggcgttctcgcgctggcgcttgaagagccgcacccagacgcggtccccgtaggccaggtccagcatcacactctggctctgcatgatgctgcgctcgctgggctgcgcgtacaggatgacagcctctttctggttatgcataatgtgcacgtacgtctccttgtaattccagctgtgcacattgaggctgaagaagtagatgccacgcaggggagcagcaaactggccggtcgccatgtcaaagcacccatcaaggttcacaaagaccctttcgaagagcagcgtctggaagtcctcgccgctgtgcagggccgtcttgcggcccactgagaaggcgaagaagcgcttctggcacggggcgccggggctgcccatctcccccttgtcacccttgctgccctgagggccaggctccccttggggaccctccctgcccatgtaccctggcaggcccattgggcctgggtcccctttgtcacctgtggggataaaaaggggacaagtcagggtggacatctgagcctgctccaaggaggtgcccacactcatctgtgacggctctgcccctgtcctggcccagagaagaagccagcatttatttagcacctactgtatgccagacattgcctccccacatgcctgcctaaagaaaacatcatgaccgtcttcacttcacagagagggtgagtgactcaccccgggccacacagtgcaggagcagaagaggcaggacttaaaatatggtctgtccccagggtgacttgacttcccctcacccagcagggagggtccgactggtgtctctgggaggccaggcccaggcccccaccccaggaccacagcgcagtccaggctggcagggatgtggggtgtgctggaacatactttgggtttctgacccagggaagaaaccaagaaaaatacatttgcccacctggaggaaaagcccaggttaggagccaggaagcccttggttggcagtcctgccctgtgtgacctcgggcactccacggctggggtctcggttttctggtctatattttaaagaggattatgtccacctcaggggtgtttgtgagccctcaacaaaatgtcctgtgggaaagcactttgcaaactctgcaactaagaggcagaacagttcacccagcacggctggcccatcccgacctgctctgaggtctggcagcatctacaatggcccccaggcaggcacagccctgcccggcccttagtccaggctgactttcaacataagaaaagcaggtgaccacccacgcctggagggacccgacctcacatagctccctgccacctgtcacagtgcctggagtcacacgagcaaccacatccttgcatgggctagaaggccctgtgttttccacagggggggaaggggacagaaaggagggcacaggcccttgaggtggaagcccagagagctgggcagggcaaggccacagctctgcagggttctggctccaccgcctggctggagaaccacgtcctcacctgcacagctctagaccttgtgcaggaagtttgttgtgccccagcccaaggaaaggaaggagtggagggtggacaggacgaagggactatcttctttttacaaataaggcagcaagctcagggcgggggagagaccagcctgactcactgggcaagggggcagaagaggtgaggctgggacccaggactcccaaagccagcccgaggtccctcacggcagcctacccacctcccagcaggctgctgagctgggcccaggagcagtgaccctgggtttggggagggcaatgaggagggaccatcagcagccaggcacctctccaacctcatgcagagagctaagtcagccctggggaagctgggtggggaggggggtgtgaggaagagcaacgtcctcaccacgaaatcagaacaagggcaggccaggtgccaggtgaccactggctgtgcagtgagtgtccccggggagagctcaggaacaaatcctggctccatccctgacagctgtgtggccccaggagactgggtttccccatctgcaaagtgggaggaataagaaaatatcgacctcacgggctgttgtgggcagagacggacgctaaggatgtcaaggcctggtcacagccgtcagccaccacagcctggaagggaagcgagtccttccacgtcctattgagagagcgggtagccagcccgcacctggacggccctcacctggatgcctttcacctggacgggccctcacctggacagccctcacctggacagccctcacctggatggccctcacctggacaggccccacagggctgcatgctccgaccctcggcccccgctggttgctctccacatgacattagagggatccatttgaaacctgggtgggatcaagtccctgtcccacccaaacctgcccctgttcccactccactcagcggagcccaagtccctacagtagccgggtggtgacagcaccccatgtgatctgagcctggtgcatctcccggccctgccccagggcccctgcaccagctgtgccctttgccaggaggctcctccaccacctcttagaagcctgtgctccatgggtcctccactgaccacctcattcaatatgcagcctgcagcccagacccgcactcctgaagccccttttcatttcccagagcactgatcaccatcgaacattccactccactaacttaggtgatgtgtgccttgctcacagcccatctccccaccgagaacgggtgctcaggcaggaggcatcttggtctggtttgttcacgctccgtcatcagtgtttggaacagaccaggctcacattggggctcaataactcaggatgaaagaggagtctggacaggtttccgccctgccctctactccctccacctcagctccctggccctccctgcccactaccaggccccacaggagggcactcacccttcaggatggtgatattaatgtagggtctgatctcaggcagggcgtgggggcggccggaggaagaggctgaggatacatgggcaggatccagggggtcctcagagtcacagcaccgttggcagccgctggccacagctctgtcaaaggtgagctccaccatagggatctcacacatcaggagaaagagcaggagcgctgcccagacgggacccagggcggctgtccccatggtgacctggaacaaggaaggagggacaggaactatacttcactcaacatctactatgtgccgatgcctggggtgggcgggtgctgcgtcctccagccacagcactcctgacctaactccagagggaaggttattgtccccatctatcagacaagaagactgagacctccacagagcagcaagttccccaagatcgggaggagactggcagggcagggcctgcatgctgagtctccgggcacccagtccatggaggcttctgctccacacaggccttggaaggatgaagcccctctgaaaacagccacagctgagagcagacagggatcccaggaagctttgctggggcaggtgagaagatgccccagctggccatgggtggcaacccaggagaccgtcagatgctttcccgcccgcgcacctccctctggcactttcttgccaccgactccactatctccagcaaacacatgccctccgggcaggaggactgaggttagtgaacactggggacaaacgtggagggttctggaggcttgttctcaggagaggggatgggtggccgagcccatgctttggtgtgagaacaccatagttctgaaaaaaaagagataagagagttcattgatcctagcagacagaaagcaacgtccatgagagcatgtggggtggtgcgcggtgatggtgtcattgcatcgctgagcagtcaggagaaggaatactgggtccttgactgcagcccattgctagtctttagagtgcctttgtgcaaagcaaagaaggtgcccctctggacaaattagaaatgataagagtccccgttggagggacgtgatgctgagggtgtgcagcttggcaagggctggcgctagtccacctccctgctcagcacctttgtgcagtcaactatctatgcaacccaaccttatccagaagccctgcagggagggttctgtagagagagttagttcattggaagatggttgtgtcaatcatcgtagacctgccaatcagatgccaaggtggtaaattggaattaaggggtaggactaggaggtataaaaaattctaaaggatcagaaaagtgtaagtgttggtgaggatctgtctctggccttggccaagaaggggtctagggctccaggagagaggcaggaagtagcctggacaccaggcgctagagacagtcctgggttgggtgggcaggaagccgggcaaaaagacctttgaggtggtgcagcttctgggggctggtgccgagttatcacaggatcagaaactctgcttttgaaaccagactggtttttacacttctggcgtttctttgtttatttcctttttgttctcctttaacatttagtagaattcaaaaatattttttttgtggttaatacatgtagacaaggtacaattattactttttaaaatgccaccctgtctcagctgagcactgaggtgagggcagagttttaaaggggcaggatggccaggtgcagtgacttactcctgcaatcccagcactttgggaggccacggagagaggatcactcgagtcccggagttcgagaccagtctgggcaacatagtgagaccctgtctctatttttcaaaaattaaaactaaaaataaataaagcggcaggagccctgccccccacccccagagctggatggtagcagcaggagaagggggctggacaggaagtctccagagccacctccctcttcctggaggtgactcttcccaagcttctctctgcccaccctggttgggttcctggttctgctcaataaggaggtcaaatcctcagagatcaacatcctccctgtctgagactgtcatcctcaacttttacttataaatgacaaatcccagtggttttggaaatcccaaaattcccttctttttcccagccacagatatgacctcatgagaaaagctgaggtcttagagtcaaatctgagacccagaatagtttgcaagctgtgtgacctagggctagtggctgaacctctctgggcttcctgctccttgatacttacaaggaaatgacaccaccctttccctcccaggtaatttggaaggatttcaatgcaggaaaagtgcctgccttataaaagacttaaaaaaaaaaaaaaaagtgtgctttgacttcttccctgtgcctgcatgggatgggaaggagaacttctcccagaggactggcatggtttgggagcatttctgtttcctattggccccagcggatgggagtcaaaggctgtgagacacagaaccgtggcctgggagcaggaatcaggaagccgttaacgaggaatcataaccacagccaggatcacgaactagctctgggggtgggtgccaggcagggaccaagtgtgggaaccaagtcatagggaggacttttggggtccttgctgcttccactgggacctctttggggagggagcggcagggcaacttttctcggtccaggcaggccgtgcagagctgagtttgtgtgtgcccgggtaggggcgggcacaaaccgggagcagtggagcgcagccctcagccagaggcaggaggaaatgtggaggggagagcctggagaggctgtcccagtcagagggagagagcagggcccgagatgcttccaggaagcaaggagggaggagaggaattccaggctctgaccccagcccccaagcttgaggagcctctggtcactcaccctgtgtcctgtggcctccccaggcgactcacggaccctgagccactgcatggcctctggctccttggcccatgtctgcaatactaacttgttgctggcccagacccccaggcccagcagaggagggagagaggaggggatggagggagagagggcggagggagggcggagggagagggcagagccgcttcccacttcccctcctccctgctccctccctttcagcctctgggttctgcggagataaagggaggcagggatttcctttgcttaactctttggtgatccagtggggtcttgcttgattcaaaggcctagaaagtcagagcaggcaggagtctgaggccccctgatgattgggaaatggacacaggcatggggcacaggagcccctaggttgctcaggaagggggaggcagccctgagtccaccctgagctaaagtgcttaactgctctgagtcacagaggcagggtgggtagcagagaaggtgcaggtgttggccctccaggcacaggctagaatcctggccctgctaccacagtcgcgtcgcctctcagagcctaggtgttccagaactgcagtcctcagccccctttgtgccaggcacatgggagggcttaacccatgtttgttgggtgaatgaccaggctgacctcctcaggtatcatgcaagtgttaccagagaggggtactgatcagaccccaagagagaattcttggatcttgcaccagaaagaatttggggtaagtccacagagcaaagtgaaagcaagtttattagagaagcaaagaaacaaaagaatggctactccataggcagagcacccccaagcactgctagttggctatttttatagttatttcttgatcctatgctaaacaggggtggattattcatgagttttccaggaaaggggtgggaatttcctgaaactgaggcttcctcccccttttagacaatatagggtaatttccggacattgccatggtatttgtaggctgtcttggtgctggtagaagtgtgttttagcaagctaacacattttaattaacatacaatgagcaataaggatgaccagatgtcactttcattgcaatcttagatttggcaggttttggctggtttgtttaccgcatactgtttctcagcagggtcttgatgacctgtatcttgtgataccagtcctgccaacttcctatcccttcctgtgactacaaatgcctgacctcctgggaatgcagcctggcaggtcttagcctcattttacccagcccctattcaagatggagttgccctattttgaacacctctgacatatttccctactctcttttacgagggaacgtttaatcttaagggttgtagaggcatgaagatccatcttctgtaacttcttcaggctgaatagaggcgatgatattcctgcctaactattagagtctcttgggtttggtgcagagaggaactgagtaagaaaatgttggtgtgttcagagtcatttgtaactctgagtcctaacaaaaggtgatatctggaagattaatgtgttcaatttaaggaagcactgagtaagcttatcttgcattcttacacaaagagtatagcagcaatatattctacaacagcaaagtaaaataagtaaaattatcccaagtaatccaaataagaaggctttccatgaactgggcaagaatgcctgtgacttatcgggtaaaatgaggctgagacctactgggctgcattcccaggaggttaggcattcttagtcacaggaattgctagatgagctgatacggagttgctagacgattccaatacatgctcagaattagatactgatccagatttttatgttatccatccctcttgtttctgacgagaagcagtcaagagatgactgtttggttcacagaaagaagcaaggtcagtctaaattgcagacaaaaaactcaaaaacaatggatgagactagaatctatgacaggtgtaccatattttttgaaacaccgtttttctctctccagtctcccattttttattaaaaacaaatcatggtaggaccaatttatttgcaaaataagctttagtcttattatacttggcttcattatttgcataaagtgcagcaagtataattatttgccatacaggctccttttaaaattggctttgtttcataaggtatcttagattagatgttttaaagctttgagcccagccatggatttacctatgcctgcaagaacctgtatgagttagataaattcctctcctcttgaggtcccgagataactcggggctcccaggcctgtcagaaagttacattctttacttaccacaggtcaggaaccctatacagggacttcatacacaaggtacaagaccagtttttccaagaggcttttattggctctattagtcaactttaattccttaaagaagtctgtttatatttgaaagcatgccactcgagtcaaacccttgttaaataaccagtttctccaattgtgtcctgttacaaaaaaaaaaaaagaagaaagaaggaaaaacagattcttactgcacttatgcaaataactatattgccgtaagttaagaacactcacaaatagtttccaaattctgcagaaatcaggtaaagagaaaaaaacatattccaaattttgtttttggacaaaactttgttttataatccttaccggagcgtactttactcaattgttaaaagctgtaaatagctcaagaagggggggtttcttgactctgaaaaacaaaacagaaagatcaacaacattttaagcaaaaagtcataaaagattatttcagtcttttattagttcagtctatgcaattaattcctgttttgcttgatatatatgtgttagttttccaagagtcttggatgatgttttctttttctctgcatttaagagtactcatcagagtcctatagctgattataaaccaccttttgaagagaataaaagcaagacaacaattgtctatggatgacagaaagacttagagcagtcatggttaaagaattaatatcattgactaggaaatgtggatacctctgtggcatataataaattaacatcataacaattataattattattgataatgtccattagtattgataatgttcatatcagaattataggagtttcccataattttggaacacataccaataacatatttatataaacacagcccaaagaaagccaaacacaatttcatatttgacaatgcttcctgtattattttaatgtaccaaataagccaaatatgtcatttttggactttaggggacctaatatctaaaggactaatcaggttagaaaaaggcataacttagaatttgattttggaaagtttgtcaaatatcaaaaatttaaaacatttgatactacaaaatagcatcccaggtcaccataagtcatttatttggccaaaatgataactcaaagatgtttttaagggcaaaaacctttactcaccgataaagggaagacttagctttccaaaaaaaactgtctcttttcgttcctttcttttttctatagcttattcaaaaggcaaacaaaaatctttaattatttttcaatattacatgaaaaacttgttcaagagagaaagccaaattttacctttgcatttgtgtactattaatgtcaaacccaattcataataaagccttatagacaactctatccaattttaatgtttgaccatgaggtaagagtctcataaaccttttatagctctttacaattttcttgttaaagagtataccagtgctctaagaaaaccttgttatacttttattccatatttaatttatggaaaaactgaataatatccctttaatttaagccaataagttcacacagaatttcttttacaagattaatctttcacaaaccttccataacttgctcaaaccttcagctttatcctacctaacttgaaacaatcctttaaccctctaaagtagggggaaagtccacattcccatgctttcttataatcttcttaccaaaagcatattcaattttccttacacaccttgcatataaaactgtttctctagtagtctcaattacatataacatattacgatgttaactcttagcaacttttattttttggtgaaaaacctggtaagtaagcagttttacttatattccaggtgtggagcctaggacagccttatctgcagaagtgcagataaggtctgactctttccagcatagctgggggcatggctaactcgacaagtccccaggccttatctagaatctaatggccccaaagcaggtaagctgggcaattttcaaaagtcaatgatgcagtttatgaccttgaggcatttagcaaacctaaaatctgacctgcctaatttagaccaaatgtctaaagtttgaagatattttaatgttactgataatctttaaaactgtctctatttcccaaagattattaaagtcatgtgaaccaaaaggcattaatgtttctatttttctgacaaaatatttgatttaagtacttattatttttaagccaattaatcagagctctttcatatatcaacatcacacacacaacatatataaatacacagacagaagatccagtagttgtaagatttttcatttgccaatttttaagtttcttaattggattactgacttcagggtggagcccttcaagaaacagggccaggaaagcctgcagtttctaaggcctaataagcaggcacagctggaaggcaaaacagaaccccaaaattaagggtttcatttttatattggatcctggatcccaaagagagggaatcagcccatcccccatggcagtcttatctttcaatggagggtggggacacttccatactttctaggtggccaagagcatgcttttctgatccaaaggtgcgaagagccaagtatccccacaaaactgccattagccatccctaaaagtgtattccccacctagttattacatagcaaggctaaaagctctcttaaaatgcaaagtaatttctgatatccccaaaagtcaaaactgtcagataacacaatacaaaacagagcagagccttagattttgagagtggtctatctgctttcaattcctgggggtgtccatgaggagaacagaggtttctcccaaaacagggtctgtagcacctccttttttcctgagaagtcccaggctattaaaatttatcttaggtcctctcaggtggggcatcaagagtggcaagaagacaaaatggggaaaaaaattaagtcgactgaaaagaaaaaatttttcagaaaaataagagccaagaagagaaaaaaaagcataaaggccttttaaatatatgtatagcttggatatccatttttaattaagctgacttttaaccaaatcttgttaccagactctagccgggacaaacagccaatatttctggcttttgaacttcactaacagtaacctcccaggtgaaaccggtaagccttaactaaggttagcacttaacccaggtatacaaggtattttcaaagaggtgataagcagtttttacgagatctagaatcgccaagggtagtgcagagaaaggaaaattcaaacgagaagtcagaagctgtttatggagaagaaaatgaataaatggcaaaggtcacatagatattaaaccagaaaggactcattccctaaggtgggaattgaacctgggtccccagtgtgaagagacaaagccttagctactgagccacggcactagacagtttctgttttccttcctggaaggagcccagagaagccaatttcaagcgtgcaaaggcttttaactgctcaggacaatttttagggctatcacatgaagccccagcttcctgtcgtctggatggtggagactaagagaaagtactcccacacggtcacaaggttaaacttgcaaggacgtaaaaaaaaagacaagacagaaacctcatctagtttttgtttcagggacctgccgccaagtttgtaactgacgagtttgctgggccaacttgaataatgggcttatatgggtcctaggcccacattctatcctatagtacctctttttatgacagactgacacagaaagaaaaattcatagcactaagtacaccagattttctaaagcttaagactagcccccatgaattctttttcgtattaatcaaattccttgcaggagagacaaacagtgatttttatcatttattcaaccagtttgcaccaagagaggccagaagcctgactggtaagaaattcttaccctttgccagcatgccaggtttctgggttccctttctctctgtggctttgatggccctgcttactgtgccattgctatgggggccaagacacgttacaaaagaaaatcgtctttttccatttcatggaaccacaggcaaaagcctcttaattttgtaagatgctgtccaacaggctgcatggggaaaccaaattaacattttccattccaggagactagccaccccactcagtgcccaacatcaacctggcaaggctcaaacttgctcccgatggcccttgtcatctttgatccactccaagtgaggtggaatgccctccaaccagaagtttcaacatatggtagctgggcaagatggaagagtggagagtcaccctgagtgacagaaaagatagaaaagagaaaggagagaggaagaaaagcattgcctgccggggggtggagaagctgaggagctcagggaggccagaggcctccattccattgacactggatcaatagttcaggaggtcgcttgtcagtagcaaaggtatcttttccagcaatctcatcatctctaaagtttccccctttggggagaagaaagctccccatgtcccatgatcctgtacgtgcctaatcctgtcactcacagctgtcagcaaacagtgcaaggcagattaatgaaaagagaatagtggttaatatcccatagtgcctaatccatttctccttaccaagggacatgaccgagggggacctctaactccctaaggactccaaccttcttcatttgggcctctaacccaatttctgataagcatctttgcccttcactaagaggggcctttaaccccctatttctgaggagggaacctaacccaaatccatacattacccagaataaaatatccctcacttacccaaagtcagccaattggggctgtagtctatttcctttgggttgagggtgttttctggtatcgtcccttcgtggttcactagaaaaaatggtactggaaaggggtcccaatccagacccaaagagagggttcctggactcgcacaagaaagaatttgaggtgagtccacagagtgaagtcaaagcaagtttacagagaagtaaagaaacaaaagaatggctactccatagacagaccacccctgagcgctgctggttggctgtttttatggttatttcttgattatatgctaaacaaagggtggattattaatcagttttccaagaaaggggagatttccccagaactgagagttcctcccgcttttagaccgtataaggtaatttctggacattgccatggcatttgtaaattgtcatggtgctggtgggagtgtcttttagcatgctaatgcattataattagtgtataatgagcagtgaggatgaccagagatcactttcatcaccatcttggatttggtgtgttttggccggcttgtttagcgcatcctgtttatcagcagggtatttatgacctgtatcttatgataccagtcctgccgactcccatctcatcctgtgactaaaaatgcctaacctcctgggaatgcagcccagcaggtctcagccctattttacccagctcctactcaagatggagtggctctggttctaacacctctgacacagggccagggcggcagccaagtcgctcctctatgctccagccccagctacaccaaagtcttcttcctctgactggaattctgccattgttactgactcaccctggtcttctagaactattcccttgtggaaatgacccccaacaagttcacaggagggcagcctgtttgcctctgggtctggcagggtcctgcctcagtttccttcttgttaggcagggggaagtttggcaaagactctctgccctggcttcctggggcccgagactcctgtataaagactgtctcaaatgtcccttatcctccaccaagggatttggtgggttttggctggcttgtttacagcatcctcctattctacatttgttgaagacttactgcctgggccaggtctcatctctctaggggcttttggtccccaaagggtgtttatatccattacttcaactagtcctagggagctggggtcaggcagctgaagtgacttgcccaaggtcacataactggtagagaggagcaaagccccctacagaagggaagactctccaacccgatggaattccctcggggcttgggcatgggcggggaacaatgcctgcaggtcagggccgtcctgggaggagggaggtgcaggagtgcggggaccccggcggggagtggggatatatttaaatctggggcttcaggtgctaaatcccattcccccactcacagctgggccaagtgtggaggatgggacggcccctgggctctgcgtcctcaaccagggctcatccttgggcctccaatttccaatttatttggggggataatcaaacagaagaatatgaagcctggaaagatcctcagaaatgatctcatctgattctttcatctgaccagcagggacactgtggcccagggaggatttatctttggcccaaaggtcacatggcagactacaatccaagctgggatgacagccagactctcccaacctccagccttgtgctgtcacccctcccaaaccgacttggaatcccccaggtcatccattcaggggtgcaagggggcccaaaggaaagcagactaaaggactttggccactgggaacacccaaaggcctgcactggccctgctctctacgtggccctgccccaggcagcattcccagggcgcagagccagggctgcagagggagggagccaaggggagcctccctccctgcttctaagggaaaagggttgagtcggcagcactggagagggagacagctcctgcctggctccaagccttcgggcttagaaaacctgaccttctgaggaaacagggatagagagaaccatcaatgggacttggggagaaacaggctggggacacagcaatggttttgtcaagggccaactgtgtgcctggcagtgttccataccgccctcaacagctcctctgcagagaagagctgttcaacccacttcacaggtgaggaggctgaggtctgaaaagccaggcaactcaccaggttctggtgccagctcatttggctcccggccatgcaatgccccggagaagagcctcctgtccctctaggtgcagggcagctggcaggagtcagagcagacaagagagaactctggaatattacacttcagtattttccctcccattagctttgaccgtgcctgaaaattcctccatttgtgcgtcatccgttggtgtcccagcctttctgacgatctcctcagctggtcaggtggcctgaaaacagagctccagccctggggcagacaaacctgggtgatgactcagctccccctcctagctgtgtgacctcgggcaagtttacctctctgagccttggtgtccctgggccagataaacatgaggaggccaggaccatcggggccgactggtggaatgcccgatgggggcactccccactggccacccatcagtaaagctgtgtgccctttcccaggcaccctgggacccaggacaacagcatgaccaggaggagcgcaggcccagggtggctctcatcaccctgctatcactcccagcagcaaaggagtaaccccaatgcagaaacccagggtacaggccctgcttccccagccactccccaccctttcccctgcctccagaagctggcttttctccccaaccattctgtgggccttccatatcttgactcctctaatccttcc

SEQ ID NO: 412 - DNA, 52557 bp, Homo sapiens
ggggactttgtgtttttatgtttcctcaaggtctggcataatcccttgcacatactaagtgctcagctatttactgaatgagtcagtacctaaaattaatcatttttatccaaaattttgtttctccttttctattctctttgttgggaaattgtgtcactgcctacttagttgctgccagtagcatttggtatagttgaccactccctctttctcgaactattctttccgaggtttatataactttatagcttacaggcttttctcttttatccaaccattttatttcactatacaatgttaggtatcctcagggcttgatttagatccccttcttctcccagacctttatccaccacattctcctatttaacaaaactgacagcccttcttccttagtgtctcttaaacttttcagtcccattgcttcaaggtgccatcatttcttagctagattattacaataacctccctttttctgttcttatgtctgcttatgcatactgcttcccccatcccccacactgtgtatagaatgatctctctgaaaggcaccctgcataaaatccttccccatcactttcaggctaaaatacagaaacctttctgttcatattagtgggtcagtctcctgctcctgaattcccttagcattttgtttctcgctctataaagacctataatgtaataacatctttatagtatttgagaacttattttctcctctaaatttataagcaatgttaaggtaagcccttcatctttgcttatcctctaataccaaacaaacttccataaaaatagaaggatctcaaaaactaaattgaaaaagcagtctagttgaaaaatagaggtgctaaagtaagttgatggctcttaaatgatgccaggacattcttagagtagtgatggctctttgggtttggtggtaacttagaagggaaaaaaaaaatctgcaggaccacatgaccgctagggaaacaggcatcaccaaccattccagaaagctgctttgaacaagccttatataagaaagagagaaagcacttttcccaattcatttcagaattctttccaattgcagtgcttgctacctttgtaccataacccaaacacatcatgtggtgatgactgggaaaataggaacatgagaatcaagagctgtgagccaggcacgttatccctgcccttaactggagaaattttttcagctcaagagttcctgttttgggtctcagtaaaggagacagattaggaaaaatcagagcagaagaagaattaggagagcattgtgttgtggaacccaggaaacaaaaagtggctgtaatcataaaatactgcatataaattagaaaaagagaaatgaaaagccattgatactacagataaaaagttatcaaggattttgaaatatcgtttccatagaagaataaaaacaaaatcctgattctgagcagttgaatgaaagattgaagaggggaagtagtaagtccattttggttaaggaaaagaaattgacatcacttaatgatataattgacatgtaaaaaaactgacctcctggggggccgaggcaggcagatcacaaggtcaggagatcgagaccatcctagctaacacagtgaaaccccatctctattaaaaatacaaaaaatgagccgggcatggtggcgggcgcctatagtcccagctactcgggaggcagaggcaggagaatggcgtgaacccaggaggcagagctttcagtgagccgagatcgcgccactgcactccagcctgggccacagagcgagactccatctcaaaaaaaaaaaaaaaaagacataatgatataacctcattttcttctatgttttcctgctttcctaccaatatctgtaaaacattaacgtcattatttaaaaaaatatgtaacctagataatatagtaatcagacatcattgttaaatttacagcttaaggaagtaagttgtcttttcaatcagattagtcattctgtttttttagtaatagttatatattaatgaagtgaaactttataggtaggtatacatcaatgaaatcttaggcttttaccatctatattgcatacttctgacattatatcttattttccttaggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatgtgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaacaagtacttcagcaaaacatgctagttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttctttattgcgactattccttttttcccccagaattagtgctttggtttaggtctttgtctagcttaactacttccaattgattcttcagccttttcttttaggtttacttactataaaagtctcagaagaaagcataaggggaaagcttcgtgacattgtatttggcaatgatttcttgaatatgacaacagaagcacaggcaacaaaagaaaaaatagataaattgaatttcatcaaaatttcaaatttttgtgcattaaaagatgcagtgaaaaggcaacacagagaatgggagaaaatatttgcaaatcatatatctgataactgtctagtgtccagaatatataaagcactcctacaactcaaccaccaaaaaacaacccaataaaaattagcaaaggggctgggcatggtggctcatgcctgtaatcctagcactttgggaggctgaggcagtcagatcacctgaggccaggagttcaagaccagccgagccaagatggcgaaaccccatctctactaagaatacaaaaaattggcctggcgcagtggctcacgcctgtaatcccagcactttgggaggccgaggtgggtgggtcacctgaggttaggagttcaagatcagcctggccaagatggtgaaacccccgtctctactaaaaatacaaaaaattagttgggcatggtggcgggcacctgtactcccagctactcgggaggctgaggcagagaattgcttgaacctgggaggcggaggttgtagtgagccgagatcgcgccgctgcactccagcctgggtgacggagcgaaactctgtctcaaaaaaaaaaagaatacaaaaaataagccgtgtgtggtagtggacgcctgtatacccagctactggagagggtgaggcaggcgaatttcttgaacctgggaggtggaggctgcagtgagccgagatcgcgccattacactccagcctgggcaacaagagtgaaacttcctctcaaaaaaaaacaaaaacaaaaaaaattagcaaaggacctgaatagacatttctccaaaaaggatatatagatggccaataagcacatcaaaagatgctcagcataactactcattaaggaaatgcaaattaataccacttcacatccattaggatggcagttatcaaaaaagcaaattataaatgtcaaagatgtggagaaattggaacccctatgcattgtttgtgggaatgtaaaatgttgaaaacagtgtggcagatcctcaaaatattaaacatagagttaccatatggcctagcaattctgcttctaggtagattcccaaaagaaagcagaaactagaataggtatttgtacaacagtgttcacagctgcattattcacaatagccaaaaggtggatgtaacacagtgtccatcgatggatgaatagataaacaaaatctggtatatacatgtgaagaaatactattcagccttaaggaatgaaatttgatgctacaatgtagatgaacctttagaatattatactaagtgaaataagtcagacacaaaaagtcaaatgtcaaatgattccatttatatgagttcctagaagagacaaatttgtagagatggaaagcagaatagtggttatcagggactggagagagtgtagaatgggaagtttttatttagtgggtatagaattagagattgggatgacaaaaatgttctggagataaacagtgatgatggttgtacaacaatgtcagtctacttaatgctactgcattgtacatttaaaaaatatttaaaatggtaaattttacacgttacaattaaaaaactaaaaaaaaattatatacacttttgtaaccacaaactcgtggcacacttctgcaactgttggtttaacagtgtcaataacaataataataaagataagagttagtgagctaaatttaaaaaataaaaaagatctcaaatcagcaatctaacataacaccttaaggaaataaaaaaagaactaaacccaatgtgagaagaaggaaggaaattaagattagagtgcagacaaatagagaatagaaaaacaagagagatcaaagaagtcaacagttagttctttaaaaagaaagaccaaattgacaaatctgtagccatactgactaagaaaaataaaacaggtaaaactaaaatcagaaatgaaagtggggacattattagtcaccttacataaagaaaaactgtacaccaataaactaggtaaactagtttacagacaaattcctagaaagacatgtattagtccactctcatggtgctacaaagaaacctgagtaatttataaaggaaagaggttttcaaaaagggagaattattctgaggctagaccatgtgatgcttttacagtgcacttaaaaaaaattttttttcccacacaagagatttctaagtgtctaaattacactttttcttaaaaaacccagagtagcttctgttgcaatagctattaatgaagaaaacagaattcagtcaactgagaagaaaaaaacttttgctcaaaaagacaaggtcctaagaaataaacaaaaacataaaggccttttaaatacaagcatgcacacatgcacacatacatttacatatcttggatgttagcttttaattaagctgacttaaccattgagctcctaaaaattatattttccttcccagaggcctctcagcaggaatggacccaataccttccatttttaagtttacatggtatcaaaaggagtaagacagataaacaagtggagacaaattttggacaacacaaggggaagtgcactcgggcaaaacagattcaaaacctgatctcaatcaaaatgcaaagcgggtgtataaccaagccttattattgcttcccgtggcagtgccagacaaatggtttaacaagcctagatgggaaaacaataggctcccagcataccattcagttaactcaccctttgagttcgtccgctcctgatctccattctaacccagcattgtaagggttgtgcacttttgagcacaggacagccttcaagggggtccctgggaaaatctcacctgcagctgctgggatccccctaaagactgtctccttgcaagccactggccactgaatgcagcaccattccagtctctcctggctggcacgccaaattttgttcccagaccaaactgaggtttgggctgctgtttctcgtggcccaataacgagatgcaaatgaactggggaggaagggagttttcatttctgcaaccggttacagggagaaggcctggaaattatcaccagaccaattcaaaattacaaagttttccagagcttatataccttctaagctatatgtccatgtgtaagtgtgcattcatctaaggatgtaagtgattaacttcttttaatctataactaaggtctgagtcctgaaggccttcctctggagcctcagtaaatttacttaatctaaatgggtccaggtgctggggcagttacccttgtctcctgctaaatcacggaggtttggggagttccttcagacccccgataaacttgtttgtggaggcctggggagtttcttcagacccacaataaaacttgttcaatcctaaatgggccctgttaagaattcctgtattattttgtcatgctttaaggcccaggaaagacctaggcaaaactcttgatgggcttttgtggcatcccagcctttgtataaggagactgacttttaatatttaacttaacccttcagtcagtagtgaaacagtcgttatggaggcctgcattagtgagacctggcctgccacaatcctgtgttcatgtattgaaagactgtattattaagatggcagtactacccaaagcagtctacagattcactgagagccctatcaaaattccaacagcctttttgaaaaatggaaaagcttaccatcaaactcatatggaattgtaaacgccgtgaatagccaaaacaatgcggaaaaggccaaagttggaggactgacacttcccaatttcaaaacttactataaaactacagtggtctaaacagtgggctgttggcacaagtacagatgatactaacatacagatcaatagaatagaattgaggcttcagaaataaacccatacatctatggccaactgactttcaacaaatgatgctgcaataactgaatgtacacatgcaaaaaaaaagttgaacctctatgtgatattgcgatagaagaaatacatattttggtcttgtaccagtttcctggcacatagctcctaaaacccttgcaacatcccaagtccccaagctgtgagtatctttgtatgctaatgaaatgactaatgtctgggggatctggatggggggaagttgccaggaggaaccaaccaagtaattagagagtagacctccaggggagggggaagtcctgaaggttaagttgattaccagtagccaatgatttaatcagtcatgccttcataatgaagcccctccataaaaacccaaaaggtttagacagctttctaggttgctgaacatgtgcaggtaccgagagcatggaagttccacgacccttcctccataccttgccccacgaatctcttcaatctggctattcctgagttgcatccttttaaaaagagaaacagaagtgtttctctgagttctgtgagcgattctagcaaagtactgtgggaactgtaaccaggggacctattatttgcaattgatgtctgaagtggggggcagtttcatgggactgagcctgggtgtatggtctgcattaactctggttagcgtcagaattgaattgtagaatacctacttggtgtctgcagagaacggggaaattgcttggtcttggggaaaacaacctaaacatctggtgtcagaagtgatgtactgagtattgagagtatacaaggaaaaagtttgttttttcttactctacctcacgccatatataaaaattaagtaaaaacgaatcaaactggccaggtgcagtgacttacacctgtaatcccagcactttgggaggctgaggcaggtggatcagctgaggtcaggagtttgagaccagcctgaccaacatggcgaaaccccgtctctactaaaaataaaaaaaaattagctgggcatggtggcgggtgcctgtaatcccagctactcagcaggctgaggcaggagaatcacttgaacccgggaggtggaggttgcagtgagctgagatgtgccacggcactccagcctgggagactgtgagactgtctaagggaaaaaaaaaaacaactttgtctcttttttttgagatacggtctcactctgtcacccaggctggagtgcagtgatgcaatcttggctcactgcaacctccacttctggggttcaagcgattctcatgcctcagcctcctgagtagctgggactacaggtgcatggcaccatgcccaactaatttttgtatttttagtagagacggggtttcgccatgttggccaggccggtctcaaactcctggcctcaagtgatcctcctgcctcaacctcccaaagtgctaggattacaggcgtgagccaccgcacccagccagaagtttgtcttttaaactttgccagaatgcttacagtgactgtccattctccatcacacttgtatgcttacctttgtccttcaccccttacatgctcttacatgtatcagaagtactattcctctacacactggattcttgtatactcttaaatatcacatattctaccaaggaatgtaatctttataatataactgagagaaaggattttgcaaccatacagatcagtctatgtgaacaaaatattcatgtctatatagtttccttctctgcagaacgacactaatagggttgtcatatgattacattatttatataaagcatttataatacattttaaaatgttttaagctctcaataaaagttggctaattttgtaacatacctacctaaaatagtattacacataattgctattttatcatttcaagttttatttcagattcggggatacatatgtgcgttagttacatgggtatgttgcatgttgctgagggtccgggtatgattggtcccatcacccaggtaaagaacatagtacccaatagttagtttttcaacccttgctcccttccctcacccccaggagtccccagtgtctactggggacatctttatgtccatgaatacacaatgtttagctctcacatatagggtgtattttttaaggtactaacgggtggaattaggcctaccctattgcttagcttgccatgattattcaaatccaaagttgacataaataggactttaaggccttgaaccaggcttgtttaaggagtcactccttcagccttatgaaatgttccattgtaattttttaaaaataataggaagtatgaatagaaatctgtacctttcttgtgttttctcctagaaacgttaataaaataatttagaagtagaaggacatagaattcattcgttgttcaatttgttgcacagactaagagatggcacaacacattacaacactgtgagaaaaaaatttattttgttctagtattaaaaaaacaaattcactgtcaataaaagataaataccatttccataatttagaatacaaccaaagtacacagaccctaagaaatcatatccaaaattttgatagcagctgcccactgaaatatttaatagaaactttcagttataatgatcagtaaaacgaaaaggtttggcttctgacatatataggtggtgctgtaactgtttagaacgcttagcttctagtcggagctgtctagttctctctctgacagcttgttgctctgccattttttccatccgtttccttcttaaccatctgtagaaacaggcatgatcagatttggtgagtatcaacctgaatacactcttcatgctataaagttactattatagacaaaataaatggacatttctttacaatgaaatactgtcacagcacaaatttttaagtattaactgaaaaatgtaaagattacacccaaggctcatacaagaaaggaccgttagatttggggtcaaatgtttgaaattgtctgtcttacaatgaaactgccaacttaattggttttttaataataaacactattttatgtgtgctgtagatcctattctttttttagaaacaggatttcttactatttggtagattccaaataacttactctttgtaactagctgtattctaaaacattacttagctaggttaagaatactatcatgcagaaatgctgccttactcttcttataggtaaattatagagcttttaagtccacaaaatagttcttaaaatgaaaagtaagccaaacatgaaaacatcaaaagcaggaaaggaaaagtccacattctaacaaattcaagtcttaaaccttgtttaaataatagcaaaaataactgcatatacatatatacctggtatgtaagtgtgtatgtggtatgtttgtgtgtgtgtgtgtgtgtatatgcacatacatacacctggttttgttgttttttttttttcagaataaacaactaaataactgtattagaaaaaaaagaaacttactaaatatcataatctgatgatatgtggtcctgaattggctactagtttaagcaaataaactgtaagtcatttatgggttagttggggaataaatggatatgggctggatattcggtaatatcattaatgaaaagcagattgcagaaatacagtatgatctcagtattttgaaattgtaaatacatgtacagacaaatacttagacagtatgcatactggtgttaacagtcacaatttctgggtgatgaaaatgtaacttgaaaccgctccatttctacaatgcacatttactgtttctgttataataaaagggtatgttagaaaaacaaaaaggaggctgggcatggtggctcatgcctctaatctcagcactttgggaggccaaggtgggcggatcacttgaggtctggagtttgagaccagcctgagcaacatggtgagaccccatctctacaaaaaaaatataaaaattagccaggtgtggtggtgcacacctgtggtcccagctacttgggaggctgaggtgggaaaatcacttgaacctgggagggtgaggttgcagtgagctgagatcatgccactgcactccagcctgggtgacaggaaaagaaaaaggaaggaagagaaaaaagaaggaaagagcaaaagagacgaaagaatgaaatgaacttcaaacaattggactcaatattcacatttggtcccccaactctccccacacttgctagcaaaaatatgaagccacatctgtattgtcagaattaggcaatgcagtgtcttacccaaataactaaaaaatatcaggtttgccttaaattaccaaaatatgtacccaaatctcctttggtctatacagattttcctccttagtccacctgcctttcttttactggtaaatgcaacttttattggttgcatttatttgtaaattcagtttttctgagggctatgtaggagaagctgtaaccaatcttcaacccatttctcacagaaataagtaaacaataaatgataaggtatcaaaggctatcacactggtgccataagaaataatttaagtattgaaaagtatcttgaagaaaaattggtatgcatatatatatataactccatatatataatatatataatagagttaaagaattatacatttttaaaagcatgaatttaaaattgaataggtacgtgctgtaagagaaaacattttgagggttttttttttccaatcttaattgatgatataacttttaaaatgaacatgaggaaggaggaggggggaaatgccctgcctttaacttactgtttaaaggccctttcccggccttctgttcctttaaggaagaataaacattcctcttgctttcttagttcttctgtctgtctttctttcatctgctcttcgtgcttttttttaagccataatcgaaaagcttgttgtggatctctgttttcctgctgattagaaaaacaagctttacttagtttagataaacaagaactacattttgaagccctgcttatgggatcctacaagaatatatttcctactcttcaatttttcataataatgccagcctcattacctgcattcctagtatccaaaccaaatacatcacgcttaagttttaagaatatctttcagcagttacttaaaatggctaagcccatttttcaaaactgtagttcctattgtaaagggtggccataaggattttcagtcataagaattttcttataaagatagcagccatgataattttaacataagaaaaagctagtaggagtggcttatttcgtggtccctcaaagttcatgatggatagtatcttcagggaattttcaaaagttcaaagagctcttatttggaggaataaaggagagaaagaagacagatttggtactctttacccttgggaaaagtgtcacctcatgtggattcctggctagaatgcaaaaggaaaagatacattcatttaatacttcccccaaatataagctttgtgattgagcttatatcttgcatttccctcatctgttgcctatatcttgcattttttcccttgtttgtaacccacattgccaaatatgctctagtctaatttagaagattattcaggatctttgatgcacaactgaactttgtggagaagacccctggatctaaagaatcattgccaaacacctggaagtctgggaattgctagagatgacataaaaatgttcaatcgggagttatagatcaaaagagtccagatacaaagtaatagataggaggaataagttctggtgttctattacacagtagagtgactacagttaacaataccgtatatttcaaaataatgaggagaggatttttgaatgttctcatcataaagaaatgacaagtgtttgaggtaatatgctaattacacaatgtgtacatgtatcaaaacatcacactgtactccataaatatgtgaaattatgtgtcaattaaatacaattttaaagttaaaatatttttaaagattcaaggattcagggagcaacaggatacatgggtatccccattcttttgttctttcaacagatattcatagtatttactacatagcaggcactaaagtactgggttgcattaataaaattaaggttccctctctcacacattctgtactgtacaatacagtaaccacaagtcataagtggctatttaaataaaatttaaacttcagtttctcagtcatactagctacatttcaagtgcttaacagacacacatggctagcagctactctaatggacagtgcaaatacagaaaatttccatcatcccagaaagttctattggacagtgttctgcacagacaggataaaaataagtgactgactgattgattgactgatctgtctgattcaaaagaaaatatgggaaggagggtaataaacacagcagtgaggagaaaggatggtatttaaatagaaagggaggaagttatgggatatctggagaaaaacagtggtaacaataagagcaaaggagctaagaagggattgtgtttggcatgatcaataaatagcaaagaagtcaaagtgaagctgtagcaaagtagctgaagagtggaagatgaagtcagggaagtagtagggatcaggtaatgtataaccttgctggccatggtaggaactttggatttcattttgagatgagaagccattgggggtttctgagcataagtgacacagtttattcaccattttagaaatatcattctggctgctatgtggaaaactgaatgagggagaggcaaggtagaagggggctgggttattaggcttttgtaacagcccagccaacagaagaaaatagtggtttagattagggtagtgggactctgtatatgcactgaagatagaaccaacataatttgctcaaaaattgaatggatagttttatgtcatgctttaaatgattattttttaaattattccaggtttattagtataataaaaattcaagaaaatatatttttaaaacaaggtaaattacagcagaactatcatcagaatgatagactgcattggtatgcaaatatgtcactgcataagatcatagcaaataactctcaatagtggagggaaccaaaataaaaaattagaggaaaataaaaaattctaaagataaaatatgaattatacacataattagtaatggattaaattatctgattataaaaaaggataaatgactgaattggagacttttgcatccatccatgatatcataattggtatcagatttacccttctgccctaattagctataaagctagataaaatgtatgcagcagcttgataactgagagtaagaaaaaacatgatataacccccatattcaccctggctctgtacttggtgacactttccagacaacggtataggaaggaggagtcatagcatcaagcagtcactagtctcactgggctcatgaaacagataggagtctggggctgctgagacagctgaatttccagggcagggtactagaaatgaagcagtcatgtggagggatgctccaagagtctgtgtgggggtttcccttgggtcttggcaaggcctgggctgcacatgtgtagagtgaggctctgtaaggtctaacagagagtagctgctgttaatgaagaagataataaaggttgcatagttttggagacattggagttccaatccaactatagtgggaatacttcattgcttaccttggtcaaccacttacaaccctaaaaaggccatgctttggaaataagggtcatgtcctagagtaaggaccatgctctaggactaaggacaaaagcaaaataaacccatcctaacaaagcataaaacaaagtctgacaggatcaagagtattccttactaatctaactgcctacaagaaaaaaattcaataccctttaaaggaaaacagtgtattctatatttccttacaacttttatattgaaaagatccacagtctattaaccaatttaaaaaaaatcactggatatctaaagaaacaagaaaatgtgacccataatccagagaaagaggccttcaacagatcgatcctaagatgacatagatattggcatttagatacaaacaggtctaatatttaagaaatgaaaagatgaatataaaaaaggtctaatatgtaagaaatgaacaggtgaatataatgaataaaaagagaatctcagtaaagaaatggaaatttaaaaaaataaactgataggaggatccaagatggccaaataggaacagctccagtctatagctcccagcgtgagtgatgcagaagacgggtgatttctgcatttccaactgaggtaccgggttcatctcactggggcttgtcagacagtgggtgcagcccacagagcacagtggggcatcgcctcacccaggaagcacaaggggtcggggaattccctttcctagccaagggaagctatgacagatggtacctggaaaactgggacactcccaccccaatactacacttttccaacggtcttagcaaacggcacatcagaagattatatcccgcacctggctcagagggtcccactcccacagagcctcactcactgctaacacagcagtctgagatcaaactgcaatgccacagcaaggctaggggagagatgtctgccattgctgaggcttaagtaggtaaacaaagcagctgggaagctccaactgggtggagctgaccacagctcaaggaggcctgcctgcctctgtagactctacctctgggggcaagacacagctgaacaaaaggcagcagaaacttctgcagacttaaacgtcccagtctgacagctttgaagagagtagtgcttttcccagcacggagtttgagatctgagaaaggacagactgcctcctcaagtgggtccctgacgcccaagtaggctaactgggagacacctcccagtaggggccaactgacacctcatacagccgggtgcccctctgagacgaagcttccagaggaaggatcaggcagcaacatttgctgttctgcaatatttgctgttctgcagcctctgctggtgagacccaagcaaaccagggtctggagtggacctccagcaaactccaatagacccacaggtgagggtcctgactgttagaaggaaaactaacaaacagaaaggacatccacaccaaaaccccatctgtacatcaccatcgtcaaagaccaaaggtagataagaccacaaagatggggagaaaccagagtagaaaagctgaaaattctaaaaatcagagtgcctcttctccaaaggaatgcagctcttccccagcaatggaacaaagctggatggagaatgactttgatgagttgagagaagaaggcttcagacaatcggtaataacaaacttctccgagctaaagaaggatgtttgaacccatcgcaaagaagctaaaaaccttgaaaaaaagattagacgaatggctaactagaataaacagtgtagaggagaccttaaatgacccgatggagctgaaaaccatggcacaagaactacgcgatgcatgcacaaccttcagtagccaatttgatcaagtggaagaaagggtatctgtgattgaagatcaaatgaatgaaatgaagtgagaagagaagtttagagaaaaaagggtaaaaagaaatgaacaaagcctccaagaaatatgggactatgtgaaaagaccaaatctacgtctgattggtgtacctgaaagtgacggggagaacggaaccaagttagaaaacactcttctggatatgatccaggagaacttccccaagctagcaaggcaggccaacattcaaattcaggaaatacagcaaataccacaaagatactcctcaagaagagcaactccaagacacataattgtcagatttactaaagttgaaatgaaggaaaaaatgttaagggcagccagagagaaaggttgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaataccttacagacaagcaaatgctgagagattttgtcaccaccaggcctgccctaaaagagctcctgaaggaagcactaaacatggaaaggaacaaccagtaccagccaccacaaaaacatgccaaaatgtaaagaccatcaaggctaggaagaaactgcatcaactaacgagcaaaataaccagctaacatcataatgacaggaccaaatacacacataacaatattaactttagatgtaaatgggctaaatgctccaattaaaagacacagactggcacattggataaagagtcaagacccatcagtgtgctgtattcaggatacccatgtgcagagacacacataggctcaaaataaagggaaggaggaagatctaccaagcaaatggaaaacaaacaaaaaaaaaaaaaagcaggggttgcaatcctagtctctgaaaaaaccagactttaaaccaacaaagatcaaaagatacaaaaaaggccattatataatgatggggtatcaatccaatgagaagagcgaactatcctaaatatatatgcacccaatacaggagcacccagattcataaagcaaacccttagagacctacagagaaacttagactcccacacattaataatgggagactttaacaccccactgttaacattagacagatcaacgagacagaaaattaacaaggatatcaaggaattgaacgcagctctgcaccaagcggacctaatagacatctacagaactccaccccaaatcaacagaatatacattcttctcagcaccacatcacacttattccaaaattgaccacataggtgaaagtaaagcactcctcagcaaatgtaaaaacacagaaattattacaaactgtctctcagaccacagtgcaatcaaactagaacgcaggcttaagaaactcactcaaaaccgctcaactacgtggaaactgaacaacctgctcctgaatgactactgggtagataacgaaatgaaggcagaaataaagatgttctttgaaaccaatgagaacaaagacacaacatacaagaatctctgggacacatttaaagcagtgtgtagagtgaaatttatagcactaaatgcccacaagagaaagcaggaaagatctaaaattgataccctaacatcacaattaaaagaactggagaaacaagagcaaacacattcaaaagctagcagaaggcaagaaataactaagatcagagcagaactgaaggagatagagacaaaagaaacccttcaaaaaaatcaatgaatccaggagctggttttttgaaaagatcagcaaaatcgatagactgctaccaagactaataaagaagaaaagagagaagaatcaaatagatgcaataaaaattgataaaggggatatcaccaccgatcccacagaaatacaaactaccatcagagaatactataaacacctctatgcaaataaactagaaaatctagaagaaatggataaactcctggacacatacaccctcccaagactaaaccaggaagaagctgaatccctgaatagacgaataacaggctctgaaattgaggcaataattaatagcctaccaaccaaaaaaagtccaggaccagacagattcacagccaaattctaccagaggtacaaagaggagcaggtaccattccttctgaaactattccaatcatcagaaaaagagggaatcctccctaactcgttataaggccagcatcatcctgataccaaagcctggcagagacacaacaaaaaaagagaatttttgaccaatacccctgatgaacattgatgcaaaaatcctcaataaaatactggcaaaccaaatccagcagcacatcaaaaagcttatccaccatgatcaagtgggcttcatccctgggatgcaagcctggttcaacgtatgcaaatcaataaacgtaatccatcatctaaacagaaccaaagacaaaaaccacatgattatctcaatagatgcagaaaaggccttcgaaaaaattcaacagccctttatcctaaaaactctcaatgaactaagtattgatgggacgtatctcaaaataatgagagctatttatgagaaatccacagccaatatcatagtgaatgggcaaaactggaagcattccctttgaaaactggcacaagacagggatgccctctctcgccactcctattcaacatagtgttggaagttctggacagggcaatcaggcaggagaaagaaataaagtgtattcaattaggaaaagaggaagtcaaattgtccctgtttgcagatgacatgattgtatatttagaaaccccatcgtctcagcccaaaatctccttaagctgataagcaacttcagcaaaatctcaggatacaaaatcaatgtacaaaaatcacaagcattcttatacaccaataacagacaaacagagagccaaatcatgagtgaattctcattcataattgcttcaaagggaataaaatacctaggaatccaacttacaagggatgtgaaggacctcttcaaggagaactacaaaccactgctcaatgaaataagaggacacaaacaaatggaagaacattccatgttcatagatagtaagaatcaatatcgtgaaaatggccatactgcccaaggtaatttatagattcaatgccatccccatcaagctatcaatgactttcttcacagaatggaaaaaactactttaaagttcatatggaaccaaaaaagagcccacattgccaagacaatcctaagcaaaaagaacaaagctggaggcatcacgctacctgactgcaaactacactgcaaggatacagtaaccaaaacagcatggtactggtaccaaaacagagatatagaccagtggaacagaacagaaccctcagaaataataccacatatctacaaccatctgatctttgacaaacctcacaaaaacaagaaacggcggaaggattccctatttaataaatggtgctgggaaaactggctagccatatgtagaaagctgaaactggattccttccttacgccttatacaaaaattaattcaagatggattaaagacttaaatgttagacctaaaaccataaaaaccctagaagaaaagctaggaaataccattcaggccacaggcatgggcaaagacttcatgactaaaacaaaagcaatggcaacaaaagccaaaattgacaaatgggatctaattaaaataaagagcttctgcacagcaaaagaaactaccatcagagtgaacaggcaacctacagaatgggggaaaatttttacaatctacccatctgacaaagggctaatatccagaatttacaaagagcttaaatttacaagaaaaaaacaaccccatcaaaaaatgagtgaaggatatgaacagacacttctcaaaagaagacatttatgcagccaacatacacatgaaaaaaggctcatcatcactggccatcagagaaatgcaaatcaaaaccacaacaagataccatctcacaccagttagaatggcaatcattaaaaagtcaggacacaacaggtgctggagaggatgtggagaaataggaactcttttacagtgttggtgggagtgtaaagtagttcaaccactgtggaagacagtgtggcaattcctcaagtatctagaactagaaataccatttgacccagccatcccattactgggtatatacccaaaggattataaatcatgctgctataaagacacatgcacacatatgtttattgcagcactattcacaatagcaaagactcggaaccaacccaaacgtccaacaatgatagactggattaagtaaatgttgcacatatacaccatggaatactatgcagccataaaaaaggatgagttcatatcctttttagggacatggatgaagctggagaccatcattctgagcaaactatcacaaggacagaaaaccaaacaccgcatgttctcactcacaggtgggcattgaacaatgagaacacttagacacagggtggggaacatcacacaccagggcctgttgtggggtggagagagagcattaagcgatatacctaatgtaaaggatgagttaacgggtgcagcacaccaacatggcacatgtatacatatgtaacaaacctgcacgttgtggcacatgtaccctagaacttaaagcataataaaaaagaaaagaaaaaaaacccaccacaaaaaaaataaaaaaaaataaaccaacaaacaaacacaacctaaattccctgaatgggcttaacagtggaatgaacattgcagaagtactgatgcctcaagatggatcaatagaaatgatgtaaactgaacaaatgaaaaaaattttcagtaaacagacgtttagtaacatgagataatagcaagtcttctaacatacgtaaaattggatttccagaaggagaggagaaaaaagatgaggcagaaaaaaaaaaaaaaaaagcctttgaagaaacagtggctgagaatttcccaaatctggtacaaaacatgaacataaagattcaagaagctcagcaaaacccaggttaggtaaattcaaagaaaatcacacatgtaatacacttctaaaaaccaaagccaggaaaattttaaagaagccagaggaaaaagatttattatatacaccagaacaatgataagaatgatagccaacctctgaatagaaacaaaggacattgtaaaacaattgaacatcatctttaaaatgctgcaggggaaaaatacctgtcagcctcaaattctataccaagtaaaaggaaaaaaaaattcttcggtgattttccacacattcagtatatatgtatatattcagagcaatgccttaaaaaaagcatgcagaggcatacttaaaaagtatataagaaaataaaaaggactgttttttaaatacttgattataaggcagaaaaggatgagtaattgaacaaatagataacaaatatcaagatgacagatttaaaaactatcgatcaataattataattaaatacaggggtggctggcaagatggccaaataggaacagctccaatctgcagctcccagtgagaccaacacagaaggcaggtgatttctgcgtttgtaactgaggcactcggctcatctcactaggactggttagacagtgggtgcaacccacagagggtgagccgaggcagggtgaagcgtcgcctcacctgggaagctcaaggggtcagggaactccctcccctagccaagggaagctgtgagggactgtgctacgaggaactgtgcattattgcccaaataccacccctttcccagggtcttcacaaccaggagaccaggagattcccttgaatgcctacaccaccagggccctgggtttcaagcacaaaactgggtggccgtttgggaagacaccaagctagctgcaggagtttttcatcatactggaatgccagtgagagagaaccattcactcccctggaaagggggctaaagccagggagccaagtgatctagctcagcagatctcacccccacaaagcccagcaagctaagatccacttgcttgaaattctcactgccagcacagcagtctgaagtcgacctgggacgctcgagcttcttgtgggaaggggtgtccaccattactgaggcttgagtaggcagttttcccctcacagccaggaagttggaactgggcagagcccaccacatctcggcaaagccagactgcctctctagattactcctctctgggcagggcatctctgaaagaaaggcagcagccccagtcaggggcttatagataaaactcccatcaccctgggacagagcacctgggggaaggggtggctgcgggcacagcttcagcagacttcaatgtccctgcctgccagctctgaagagagcagcggatttcccagcacagtgcttgagctctgctaagggacagactgcctcctccagtgggtccctaacccccgcgcctcctgactgggagacacctcccagcaggggtcgagagacacctcacacaggagagctctggagagtgcccctctgggacaaagcttccagaggaaggaacaggaagcaatctttgctgttctgcagcttctgctggtgatacccaagcaaacaaggtctggagaggacctccagcaaactccagcagagttgaagcagaggggcctgactgttagaaggaaaactaacaaacagaaaggaatagcatcaacatcaacaaaaaggatatccacacaaaaaccccatccaaaggtcaccaacatcaaagacaaaaggtagataaatccataaagatgaggaaagccctgcgcaaaaaggctgaaaattccaaaaaccagaatgcctcttctcctccaaaggatcacaactcctcgccagcaagggaacaaaactggacagagaatgagtttgacgaattgacggaagtaggcttcagaaggtgggtaataacaaactcctctgagctaaaggagcatgttctaacacaatgcaaggaagctaagaatcttcaaaaaaggttagatgagttgctaactagaataaccagttcagagaagaacataaatgacctgatggagctgaaaaacacagcatgagaacttcgtgaaacatacacaactatcaatagccaaatcaatgaagtggaagaaaggatatcagagattgaagatcaacataatgaaataaagtgtgaagacaagatcagagaaaaaagaatgaaaaggaacaaacttggcctccaagaaatatggaactatgtgaaaagaccaaacctacgtttgattggtgtacctgaaagtgacagagagaatggaaccaagttggaaaacactcttcaggatattacccaggagaacttccccaacctaccaaggcaggcaaacattcaaatttaggaaatacagagaacaccacaaagatactcctcaagaagaacaacaccaagacacataatcgccagattcaccaagtttgaaatgaagaaaaaaatgttaagggcagccagagagaaaggtcgggttacttataaagggaagctcatcagactaagagcagatctctctgcagaaaccctacaagccagaagagagtaggggcccaatattcaacattcttaaagaattttcaacccagaatttcatatccagccaaactaagcttcataagtgaaggagaaataaaatcctttacagacaagcaaatgctgagagattttgtcaccaccaggcctgccttacaagagctcctgaaggaaggactaaatatgtaaaggaaaaacagataccaaccactgccgaaacatgccaattgtaaagaccattgacactatgaagaaactgcatcaactaacaggcaaaataaccaactagcatcataatgacaggatcaaattcacacataacaatattgacctttactgtaaacgggataaatgccccaattaagagacacagactggcaaatcggatagagtcaagacccataggtgtgctgtattcaggagacacatctcatatgcagagacacacataggctcaaaataaagggatggaggaacatttaccaagcaaatggaaagcaaaaaaaaaaaaaaaagcaggggttgcaatactagtctctgataaaacatactttaaaccaacaaagatcaaaaaagacaaagaagggcattacataatcgtaaagggatcaatgcaacaagaagagctaactatcctaaatatatatgcacccaatacaggagcacccagatgcataaagcaagcccttagagacctataaagagacttagacacccacacaataatagtgggagactttaacaccctgctgtcaatattagacagatcgacaagacagaaaattaacaaggatattcaggacttgaactcagctctggaccaagcggacctaatagacatctatagaactctccaccttaaatcaataaaatatacattcttctcagcatcacattgcacttattctaaaattgaccacatatgggaagtaaaacactcctcagcaaatgcaaaagaatgcaaatcataacaaacagtctctcagaccacagtgcaatcaaattagaactcaggattaagaaactcactcaaaactgcacaactacatggaaactgaacaacctgctcctgaatgactactgggtaaataacgaaattaagggagaaataaataagttctttgaaaccaatgagaacaaagacacaatgtaccagatctctaggatacagctaaagcagtgtttaaagagaaatttacagcactaaatgcccacaggagaaagcgggaaacatctaaaatcaacattttaacatcgcaattaaaagaactagagaagcaagagcaaacacattcaaaagctagcagaaagcaagaaataactaagatcagagcagaaatgaaggagatagacaaatgaaaaacccttcaaaaaatcaatccaggagctggttttttgaaaagattaacaaaatacatagaccgctatccagactaataaagaataaaagagagaagaatcaaatagacacaataaaaaaatgataaaggggatatcaccactgatttcacagaaatagaaactaccatcatataatagtataaacacctttatgcaaataaactagaaagtctagaagaaatggataaattcctggacacatacaccctcccaagactaaaccagaaataagtcaaatctctgtatagaccaataacaagttctgaaattgaggcagtaattaatagcctaccaaccaaaaaaagccaaggaccagacagattcacagctgaattctatcagcagtacaaagaggagctggtaccattacttctgaaactattccaaacaacagaaaaagagggactcctacctaacttattttatgaggccagcatcatcctgataccaaagcctggcagagacacaagaaaagaaaatttcaagccaatatccctgatgaacatcaatgtgaaaattcgcaataaaataccagcaaaccaaatccagcagcacatgaaaaagttcaacatcaagtcaacttcatccctgggatgcaaggctggttcaacatatgcaaatcgataaacataatccatcatataaacagaaacaatgacaaaaaccacacaattatctcaatagttgcagaaaaggccttcgataaaattcaacagcacttcatgctaaaaactctcaataaactaggtactgatggcacgtatctcaaaataataagagctatttatgacaaatccatagccaatatcatactgaatgggcaaaagctggaagcattccctttgaaaactggcataagacaaggatgccctctctcaccactcctattcaacatagtattggaagttctggccagggcaatcaggcaagagaaagaaatacagggtattcaagtaggaagagaggaagtcaaattgtctctgtttgcagatgatattattgtatgtttagaaaaccccatcatcttagcccaaaatctccttaagctgataagcaacttcagcaaagtctcaggatacaaaatcaacgtgcaaaaataacaagcattacgatacagcagtagtacaaacagagccaaatcatgagtgaattcccattcacattgctacaaagagaataaaatacctagcaatacaacttacaagggatgtgaaggacctcttcaaggagacctacaaaccaccactcaaggaaataagagatgacacaaacaaatggaaaaacattccatgctcatggacaggaagaatcaatattatgaaaatggccatactgcccaaagtaatttactgattcaatgctatccccatcaagctaccattgacgttcttcacagaattagaaaaaacttctttaaagttcatatggaacaaaaaaagagcctgcatagccaagataatctaaagcaaaaagaacaaagctggaggcatcatggacctgacttcaaactatactacaagggtacagtaacccaaacagcatggtactggtaccaaaacagatatatagaccagtggaacagaacagaggactcagaaataatgccacccatctacaaccacctgatcttcgacaaacctgacaaaaacaagaaatggggaaaggattccttatttaataaatggtgctgggaaaactggctagccatatgcagaaaactgaaactgtaccccttccttacatcttatacaaaaattaactcaagatggattaaagatttaaacagaagacctaaaaccataaaaaccctagaagaaaacctaggcaataccattcaggacacaggcatgggcaaagactttatgactaaaacaccaacagcaatggcaacaaaagccaacattgacaaatgggatctaattaaactaaagagcttctgcacagcaaaagaaactatcatcagagtgaacaggcgacctacagaatgggagaaaatttttgcaatctatccactagacaaagggctaatatccagaatctacaaggaacttaaatttacaacaaaaaacaaacaaccccatcaaaaagtgggcaaaggatatgaacagacaattctctaagaagacatttatgcagccaatagacatatgaaagaaaggtcatcatcactggtattagagaaatgcaaatcaaaaccacaatgagataccatctcccaccagttagaatggcgatcattaaaaagtcaggaaacaatagatgctggagaggatgtggagaaataggaattcttttacagtgttggtgggagtgtaaattagttcaaccactgtggaagacagtgtggtgattcctcaaggctctagaaccagaaataccatttgacccagcaatcccattactggattatatacccgaaggattataaattattctactataaagacacatgcacatgtatgtttattgaggcactattcacaataacaaatacttgaaaccaacccaaatgcccataaatgacagactggagaaagaaaatgtggcagttatataccatggaatagtatgcagctataaaaaaggatgagttcatgtcctttgcagggacatcaatgaagctggaagccatcattctcaacaaactaacacaggaatagaaaaccaaacactgcatgttctcactcataagtggaagttgaacaatgagaacacatggacacagggaggggaacatcacacactggggcctgtcggagggtggggggctaggggagggatagcattaggagaaatacctaatgtagatgacgggttgatgggtacagcaaatcaccatggcacgtgtctacttatgtaacaaacctgcactttctgcacacgtatcccagaacttaaaatataattaaaaaaaataattaaatacaagtgaatactaagtataaggagtggactgctggactggaagattcaaatatatgacgtctgcacaagccattttaaatataaagccacagatacattgaaagtaaaatatgaaaaaagttataccatgcaaatggtaagcataacaacactgatgtggctacattaacctcagccaaaacagacttcaggatatgagggacatttcataatgggaaaaggtcattatcaggaagacataaagtcctaaatgtatacccacaacacttgaaaatacatgaagcaaaactcaacagaaccaaaggagaaataggcaagggcacaatgatagatgaaattattaacactattttctaagtaattcataggaaaaatgggggaagacaataagcatgcagaagatcttaacaacactatcaaccaactagactatattgacattaatacagcactacatccaatgcagaatacacaaggtatacaagtacccatggacggttaacatagatagactatatacatacatacattttcatgtgtgtgtatacatatatatcactgagcaagagaagcaaatttcaaaacaacgttggaaagacatttttagctatttttcctaaaaatggcaataaaaattacatcacctaagatcttttatccatctaatgtaaaaaaggtcattccacaatctataaatctaaagatattttctggaaactatgactcacattatacacaatgtcccacagaaataatcaacataatgcacttattatagcaatgtattaataagccaaattaatcaactaccaaattgtgctatatttcagcttgagtagagacaaagctcataaaagtacttcagaatactattagtttgtgatactatttctcattaaaatatatttttgagacaaacttgaaatgtagcaaaaaatactacatattcaaaataaatattcaaagggaaatatataaccatgatgtcttctacataaaattttttgaaataaattatgttcaatatgactcatgttttctgagaatacaatccaagattactatttactatgtacaaatacagcacaattatgtgcaaatattgcacaatatactgtacatttatttttgcaaataccccatttaaaaaattataatacttggaatgccatgaggcctgaaggcccatcatcgtccaagaagctatcagcagtatggccatagctgtgttttccgtggtcactgactgaaacataaactcctcttgtcttctatacctgtaatcactacagcaatatgctgtgctgcttcttcacccaatcccaaattcctcctgtccttcataacccttgttagttctctgtaattcctactcaatgatataaaaactcccaaacaacatccatcctcccaagtcactgaaagggatctggccctaaatttcctatcttatgcaaattctgattctcccccaagccacatcttctctgaaacagaggctgcattttctaccatacttcaagtacttcggtggtcagacaaataaattaatattctcttcattcccccatacgtcttctgaattgtatttctgttttcctgagaaaacccatcctcctttgacatttgtatcatttggctctattaaaaatagttatgtaaccacctctgatcactcctgactcaatattcctctccatgccagtcccaaggtatatttttaactacatagaagagccattgaacatccacccccaaagacctttgattctctcatcttctacgtctttctccattacacttgccacgtatttctatggccatatcctcatcacacaaactactccacctctgaaatcgctaatttcctatctccagtcccaacttttctcctgaaaaccggataaatttctccaactaatcttcaatatcttcatctggatattttgtgcatacctgaaactcaacaacttaaattggtcacccctcccacgaggagttttcagtaggcttaagtagattccagctgagaagctgtaagaatcgtgttctagggttgggacgctaggccccagtggcctagattttctagtgggatcttctgatccatgggttgcacagttctgtggaaaaagcacagtttccccttctgggtagcgtgctcattcactgcctccctttgctgggggtagggggttctcctttcccatgtagctctcaggtgggccacgcactacactgctcttccttctgtccatgggtcacgccagccttctagtcaagtttgatgagagaacctggataccttggttgccagtgaaggattcacatgcttattatgtttttttccgataggagcctctgagcccccctgcttctagtcagccatcttggccccgtcactcctattatttttacctcatttccttttcttaatgaattggattgaaacaccagaatacagttatttaatatagaaccttacatgtttctgattgtaacaggtatgcctagagtatttccccattatagtgtttattatccgcattttattaggaatttttaaaaagaaattatacctttgctatatctttcaagataatattcttttatctacttactgatgtgatgaatgatattagtacatgttattactgatccataatttccttcctaaatcttactcagtgtattattattttactatatggtatcagtcaaatttctccatatttcctcttttagtttatgttttttctgccttgcctgtgaaagtactgcccatcccaagattttaaaaagctaaaaacttccacaaatggcataataaacactgtaacaaaaaatatattgtcagactaggaaaatatataacatatataatagacaaaggatcaaaatctctcatataccacttagataataaaaaccaaactaaaaaaggaaaaagattataaacaggaaattcacagaataatacacacgctatataaatagaaaaaccaattggttttccttctcattcacactcaacacagaatacttcacctctggttaccaaaatggggaagggttcccacttcccacactgacaagtttaacaccagctgggtatcctacaatttaatccgattctgataatatatccctggagttagcatcaaatcccatgggttaagggctcaatccctcaagattgcctccacttcagatatcaatcaaaagcctagattgtgaccagagcttctgtctgaccagctatatattgccagggtggggagtggtgggaacatgaccctctcctcaggtttgattaatttgctagagcaactcacataactcgaggaaacacatttacaagtttattaataaagaatataataaaagacacagatgaagagctacacaaggcaaagtatttgggaaggggtgtgaagcttccatgccctcttgggggcacaccacccccccaacaccacatttcccataccctagaagctctctgaaccctgcagcttggggatttttataaaggcttcatcacatagttattgagattattaactcaatctctagccccttcccccttcctagaagaaaggagttagaactgaaagttccgggcttctaatcatggcttagtctttctggcagccagcacctaaccaggagcccaccaagagtcatcttattagaacaaagagagtcctatcacctaagaagttccaaggaattagcagctgtttgtcagaagccaggataaaagctcagttattagaacaagagatacatgtagaacccccatcactcaagaaattaaaaaggttttaggagctgtgtgccaaaaactaggggtagagacctatatctatctcttattatttctcacacatgctcatatacaagcatgtatattattaatttgaaggaaaaataagatgataacccacatacagtgttagtcattcactctcacacaccgttggaggaacaggtataacatttactctcacacactgttggaggaactataaattcatattatcttttgggaggttacttttgcatctttaacgaaacatttcactctaagccttcaaacattttaaattcacctctgaagaacttctcctacagattactgatgttcccatagaatgtacctcttcactacagcactgttaactaacgcaacattggaaccaacctaaatatctacaaatgaagaatggcttaataaattaacactgtaataccatgcagctatttgaaaaagagagatttaaatgtaatggcttagaaagagttccatgatgaagtgaaaaaaaactgaataaaacttttgacatgtaaatatataaatataaataagatataaaaggatttgcaccacgctgttaaaagtggttatcactggagatgagcctggaggagcttagggttaaattttctttttttctttttttttaaattttattattattatactttcaactttacatatatatctttttttagtaagaatatgaatgatttttaaattttctctattttctgttttagtttttttaattcttttaaattaaataatttggtgtctttaatttgctaaagatttacataatatttctatacgtctagtcttaagtgagaccagtctctagggttttgtgggggggtgtgtgtgtatctttgccctgtttgaataacaaagttacaccttgaaaaaacgaattgatagttttctgttttctgttccatcaaagtctgaacaaaataggaatcattttattttcacaagacctcttagaacctaattgtagttatctgcatgttgcatcttttgcaagggtagttcttgaacaacttttctacttcttccataggctgttagtctgatatccagactcccttctataaataagttcagctttcatatctgtatgaacttatttttcagagaagttttacttactctactgttcatgtcttcaatttcctttgctcgctgaattctcctcatttctaagacctgctctcttttcttttgcaaccacgctttaaatactatgtcattctctctctttttttctttctcttcttctatttttcgtcgctcttcctagtaaaagaatatgaaaagacattaatggaagattaataaaattgtatgagttatcagagtagagagatatattttgagatctgaaattaggattccctgaccctaaaactttccatcagaaaactggtccttctaggccagacacggtggctcatgcctgtaatcccagcactctggggggccgaggcaggcagatcacttgaggtcaggagttcgagaccagactggccaacatggtgaaaacccatctctacccaaaatacaaaaattagctgggctaatttaacaagttcatagtaaaattttcttcaaataatggaattctaagtgttttccttacattttgacaatatagcaagactttctaattccttttgattgaacagaaggaagggaggaaaggaaaattctaccaaacagcataaaatatatttgagaatacctatatactattttctgagccctaaagtagcctgtattataggaaatataaatgaatttattaagaattaaattttacattatttatacatttccatttcacacaaaggactttggatgccttgcatgaatacagtatgacaaacgatgattatctttccaaggggaacattcaggtatattacacagaagctatcagccaaagcactgataacggagttgccaaagagaacactgaaatgatgcacttaggttagaaagacagagtatagcagcccaacccagaaaatatgggcataaaaaagcaaagccttcccctgaaaccaactaaaacatgttaaaagccttagtacttgaagaccatgccttgagccaagttagttataggatacaataaaagtgtatttcagaacaaagagtgtgtgacattcagaaaagagaatccaaatgaaaacagaattatccatccttcacaccagttaaagactaacatcagttcattaataaaaaggcagtgacaactatataaaatcacctgtataacttttgtaaaaatatacacatacctacacatttgtgtatagcaaacatatagatgtcattctcaaaaaattattttgtattgtcaccaaattcctatactttcaagtgtttttatacctgaatcaagtaaacttagtttgactattagagctattagtgaccaagtgaacgaagctctataagcttgcacccttttaggttcttatctgagtgtgctagaggttacacgttcttacgaagtcatgtttcactttttttttttttttttgctaatgccaattcctgatttaaatgccagatatttccctgataatttcccatataaagtagataacacaccatttctcaagggtgccagagaactggaaatttttattccagtttgctactaacaagtacagatataccttggtaaagttatttaaactttctaaggttttcttatctgcaaaatgatctgtaaggtcacttctcatgtattatctgctgagctttgtatttagaattagacattttgtatggctcagcttaataccattaggtttccagtaaaacaaagaattggagcactgacataagtaattctgagaaaactcaccagtttaagtcctggaattttcaattataagatacatagagtttcacataagaacaaatatgaaaaacaaaaaaaattaatttgggattctatatggcattttggagacatttcgttaagaatattaggctatattcttaatctgaaactaaactcctggaaataaaagaattgtaagcatagaacataacatgaaacacatgcaaataaaagaattatagtccaagtcttcctgttgcctcctaaacctctacactttatgccttcatttttccatctgacattttatttttacctatcatatcaagattactttcagcagtcacttaacgtctcatgagtctcacctttaaaatgaaaggatcagatgaagtcatcactgagatctccgctaacacagatcagtctactattctttgtgatccttacaaggaccaaagtaatcactgtgttcattccataaatgcacattcttaacacttaatcaatctaacaatagataaataaagcaatcaaaaaaagtctccaatggtttgaacaactgttttaattcccattgcatttataaaacagtaaaacatactctacttttaatataatgcccacttaggttctcacctctcttttcagtttttctctcttttcttctagttgtttttgtagttctttctgtcgaggggaaagacagtatgttgaagtcactggtgagatatgtgcagactgtgtcctgtgattagatttcccattccctttacttcgatctgagttgacagcagagcttggacaagtcttgcggttgagtggtggctgagcgatataagccagcggctctcctgttgatgagtgagtgacagcatgaatctttgctgtagaatcttctttcttggtgccactgacagaggagttggaagatctgggtaacaactgctgagggtcattttctgtactatttgcattattaatgggaggcaaaaacccctgactggcaatgtcttgtaaattcagaagttcaaattttccatctctctctaccagtattgtcctatccttgttttcttcacagcttccattagtaagtgacaggagcacatcttcttgtccaaaatcattggaaatacataattgtgacagtttcccaaacatattcctttcgttttcaaaataatttttaaaagtagtagtgtcttctagtggaggaacttccaaatcaactaactggtccttgaacttaagttttcgctcccttttatcattcaccggttcttgattctgtagaagcttgttagcttgtacaattttctccataatatatctccttacttcctcatcctcttcctcctccaagtctttctggctttctagtttggattcctggaaagagttttcactatctgaatctgatatgggatccaaaggttgaatacctggtacagaaatgatgtcatttcttcttggtgagacctcatcctgcaaagatttgtcaggatcagaatgccgtttggtgtgctccattactgtctcattctcttttaagtcttggttaatattctcttccttctcacaagccatctaaaaacaagatatttttcagtcaaaattgagattcttcatttataagtagacatacaaaatgggatttttcctgttcatgtaatttattttatgaatgggaaaatttaagtgtttattgctcataatttgctcataacattctaattcatacttatgagtatccaagggaaataatgtgacagcaatgcaggaaaaattcaactttaaatttgaatttgatgtagctaagtgctacattgatttttaaacatttttatgctaatgtatcaaaaggtaactacaaataacaatattaatattccttcccctataaaattttcctctctttacattttcagaaaaacaattttcaaaaatctttcctccttgtaatatttgcattcttcaatcaaacagctttctccccagaccatttcaaggatgaattatttggtcaggtcctaatcacttgaggttcttttaatcttttcagactattattatcactataatctgcaggacctatctaaattccaggtcaatttttacctctagatcagatttcccttcttcaactatactcagagatttcagaaatccatgctaaccaccatcagataacttggccttaaattaaaaaaagttaattccacatgaaccataaaccagtatcagtgcagcacaaaactccacttctgctgtatctaactaaaagcttatatatataaaaatataatagatataatatataaatgtatataaatattttatatatatatatattttttctctttgtcaaagttctctccctcctaaagcagttctatgggagctactacatgcttctctcttcaaccccttaaaatcactttcctccttcatttgctcataggtcatcctgtgtgatagtgaaggtcatcttgtctgatagtcagatgtctaataagcaaataaacctggcccatttaaatgactgccaaataactatgatttaactaagagctctgtatcacaagtgttcattttagccttatttgtttctctagttgactcttttttatttttccaatatcatgaggatggcagatctctggttcattcttatagtctctgtttctgaactctcctttagcttttcttttcttttcttttgaaaacccactttttacaaaaaaatcttcccctgaccctcttatgtgtctctagctcagtcatccccttttcccaaaagcctcaaaagaagaggttgttataatcatccgctggaatgtgtaagattcataacagcacttttattttattcctgctatatatatccctagcacctagaacagcctctgatatgataggtgatcattaatacttgttgaattagaaaataaaacaataaatcatccctattacctctctaattctatcgcactgtgctttggatctcacacccttccagtcttgagaaattggttcaaccttaccactctgggtatctgcctctactcattctgcttatttttctgttaggatgcataaaactcccatttaaaagccatcttagaaaaatcttcacttttgactctgtttccatcttcaaacattgtgtattccatttgtcttttccattatataagaaagcaaaatggaactaagaaatctgtaatataaaacctgcatttcctcatagtcttttccttaacacctttaaaactggcttctgctataactctgatcattatccctccaaagtcacctatttatatcctagtgttattcctttttctacttattgacactaacttatgtatatacatatatatacacacatacatatgcatatatacatatatatgttttacagaaatacatatacacattatacacatgtaaagagagagagaaataacctaccttgatgcaggaactggttaattttcctggagttcctttcttcatctctgataaatagtatatgaccatgcttaatgcatccacttttcctaggagtattcctgtgactcagactttgaccctttactttgttctctatattcattgccaagaagagctaattcagtcttaaagttttaaatattagctaaaaggtcatgtgtttagaggatttgctttatttttcatttattttaatagcataaccccatgattttacccaagttcacagaaagtaggaattaactgtattttttactttcgatgcaataaatcatgattttactatttatttatattatttaaattataattttataatggtcactttagtttattaaatgctagcgtaataactgttctctcactaacctgccctatgccttaggatacaacatttaagcaatctacgcctcatttttcttatctttaagatgaggataatagtaatttgcccaatgtagatcaaagaaattttgtgatgtttagatgagataataatgtgaaaaccttaaagaattgcaaagcactttgtaatataattattatgaatgctgttggcaatatatacctctattatgctggcatcacttttttcattttcattaattaaccactccaggtccttttcaaagtcatcttcgtattcttcacttttctttgaatcagtatctttattttcattcattttctgtttgtgaaggaaatatgctgtaagattttaaaagataaggtatatgttatgcccactctagaggaggaatggagtatggagattaatgctgtaggtaagctaattaacacagagaaacacaaaatagaatgttcaaaatgaacatgcacttgaatacaccatgaaagagagatctgcaatggcaagacatttccataggtaaacattcctaaaaactctcccaccttccccctgttccccaaatagttattgatgttggttccttttccctctcaagataaagttaatttttggtacactttaggtatgctgaattaataaataatccaccagctgttttagccattagcttcgctttgttctccccaaacctttggccagactaagttattactgaataataactgttattcaacttaattattattcaaaaataactgttaattgttcaactggataattattgtttttttctaaactattcattggactataattctttctagatacttatttattttaaactaaaaacacaaaatagatttgctaaaggactcaaaagtaagcccttcaataatttctaaatcaggttgagcacaaattttgaagtgatctggagaaatcaagtcaacacttcagagtgagtttcacttcctaactgcaagacaagctaaattgcttaagctattatatctaactacctaccaattaaaagcaagggcaccatgaatgatacagaataaaactcactgtaatccgaaatacttacagtaaaaatagtacttttcacagtcacaatgccttggaataatcagttttcttttcagagcagggatcttgaaatttattattttaagatgtttgagttacataaatattataagaatatttctttggaactcttcagtgctttcccttattttatgataaacatagttctgaacttataaataaatggttgcctgaagactttagtagatatgttttattgtttacagagaatcacacacacatgaaaactaaaatttaaaatgaaaacataaaatctgtataataaaagcacagtaattaaaaatttaacaggttaggggtctttaagtcatactattatgccataattcaaaggaaaaaaaagccatagttaaggtaactctgagaagtaaattaagtcacatcaaatctgaagtgcaattcttttgttgtaacttaaaaacaaaaaaacaccctcatggccggttctcaagtaaacaaagaacataaattacaaactctggttatcaaatcccttaagcctttttcaaatgcgtcacaggatattcaaccccttcaattcttttaatcttcatcaccagggtactgtccatatggtacagaatcaacaagctagaacaaaaatacatcttatacaaacaaaatcacttaacacttcctactttatgcttgtgagtttcacacatttaaatttcaacatttatcatcagtaaaaatctaggtaaacggcttagaccagctctaccctcttaatacggaactgtagtaagagacggaaataaattccttcctccctgagtgtctggtaaatcccatgtggataggtgaactgccgatctttcagtaggagtcttaaaccaagtccacatgtatacataattttgataactttcttccagaattcaggatattcaaaaatagtttaaataattgggtcccatcttacagcgttttaaacatatgcttgcttaaaaatctaagaactgaaagcatgtcaaagagaatgccttttaatataaagtaagtacttaagcaaaaactaatccatacatcatgaaaccatctggcccattattcctgtgtatcctgccaagactgtgatcctataagtaagtttttaaaaaatcataaactgtcacaaagtatgatgataaatattttatggactttaggtgataattttaatctgtattcaggatcccaaggtaccaccaacgaaatgaataccattgcctcctcatggaagctacaatttcgggagtgactttttctcccagggacaaaattattactttccacgttcaagaactttgagaggggaaagaatatgacaaaaatttagtctaagctactctcagacgagtatccttcatacatagtgaagaaaggtgttaccagacttccccaccagtgccagactcggtggacctcggactccagaggataaggcgccaccagaaagcttcttccctcactacctaccctccctcccagctataccagacgtttatacctttaccctctatcccaccattaacatctccgcatcgtccttcccttctctccctctatatccctcttgcctgtgtaaaatgcggcggctgggatcacagagatggccgggggagttctcctctcctcctctttctaagctcttcacattgaggcaaaggagaccccggcacctgcctccgcggcagccaggaccacactgccatggcaacagcgtgcctctgcgtcctccatccgggcctctctaactacgagagcgacaaaaatctgcgcaggcgcatgcaatatcctcagaccaccgacccctcccggcacccatcccggtgcttgcgaagggccagtgaagctgaggtttctaaggggacgactaaggaatccacgcatcactaacgttatagagactcgcgaagtgccgctgtgttggttgtgaaatttccctcttgtagctgtctctcgtcagatttagaatttcttaggacaacttctaaaactatatttctatatgttatgtgcttcacagttaacgtagaaaagtagtttttagttttcattagtagataagcaaattgctaatgagttaccatatttttgaccctcagcttctttttttcctaatcaaaaccaaaactttacccaagagagttgccaaagaaaataggatttttgctctagctttgaggcatgtcaaaatggtcaactagaattttctcaaattctgcttatctttatgtataaaggcaaagcaagatgaatttagattgtggtgaaagttgagatgattttaacaactatccattcccagccagaaataaataagaactgggagaagtaaaaatatttcctcagtacaatccagtgtgttcggattatttttaaattgtttattattaggatttctatcacttgatgtgatggagagcaccttttctccaagagaggcaatgtaaaattaaatttttagatattcttcaagttatagacttaaggtcttttaaaatggaaggttaaaatgaattgtaatattgagtgcacttcctagatgtggtgtagttgtaatgacctaatgttgctactgcttcagcgcttgaaaaaagacgctcccaaaaaaggttattcactgctaaaggttgaaggaattttagtcaaatctcctttaatggatgtagagttgtagagttacttaccaaagctggaagtagaccctaggtttcagaactcctaggttaatagttttttcctctgaccatcctcctaaatttgtatttttcaaataatgggtgatagcagctttttttttaagtatcaggttttgggggaacaggtggtgtttggttacatggataagttctttagcggtgatttctgagattttggtgcacccatcacctgagcagtgtacactgtacccaatatgtagagtttttttgtttgtttctttgtttgtttgttttgtttttgagacagagtctcgctctgtcacccaggctggagtgaagtggcacgatctgggctcacttcaacctccatctcccgggttcaagcgattcttgtgccttagcccccagagtagctgaaactacaggcacgccaccacacctggctaagtttttgtatttttagtagagatgggttttcaccatgttgcccaagctgttctccaacaactgagctcaggcagtctgcccacctgggcctcttaaccaatatgtagtttttttatgcctcatcctgctcccaccctttctcccaagtccccaaagtccactgtatcatctttacgcctttgcatcctcatagcttagctcccacttacaagtgagaacatatgatgtttggttttccattcctgagttacttcacttagaataatgatgaaataacctccatttccatccaggtagctacgatgccacaatttcattccttcatatgactgagtagtattccatggtatgtatatgtaccacattttctttatccactcgttggttgatgggcatttggtttggttctttatttttgtaattgcgaattgtgctgcgataaacatgtgcaagtgtctttttcacataatgacttcttttcctctgggtagatacacggtagtgggattgctgcatcaaatggtagatctacttttagttctttaaagaatctccacactgttttccatagtgattgtactagtttacattcccatcaccagtataaaagtgttccctgttcaccacatccatgccaacatctgttgttttttttattttttgcttatgaccattcttgcaggagtaaggtggtatcgtattgaggttttgatttgcatttccctgatcattagtgatgttgagcattttttcatctctttattggccatttgaatatcttattttgagaattgtctattcatgtccttagcccactttttgatgagcttattcgttttttccttgctgatttgtttgagttccttgaagattgtggatattagtccttagttagatgcatagtttgtgaagattttctcccactctgtgggttgtctgtttactctgctgattatttcttttgctatgcagaagctttttagtttaattaagtcccatctacttacctttgtttttgttgcgtttgcttttagattcttggtcatgaagtctttgccaacgccaatgtctagaagggtttttccaatgctatcttctagaatttttatggtttcaggtcttagatttaagtatttgatccatcttgagttgatttttgtataaggtgagagatgaggatccagtttcatttttctacatgttgcttgccaattatcccagcaccatttgttgaatatggtgtcctttcctcactttatatttgtgtgtgctttgtcagagatcagttagcttcatttcttggttctctattctgtttcattagtctatgtgcctgtttttatgccagtaccatgatgttttagtgactatagccttgtagtatagtttgaagttgggtaatgtaatgcctccagatttgttcttcttgcttagttttcctttggctctgcaggctcctttttggttttatatgaatttgagggttgttttttctagttctgtgaagaatgataatggtattttgatgggaattgcattgagtttgtagactgcttttggcagtatagtcattttcacaatagtgattctacccatctatgagcatgggatttgcttccatttgtttgtgtcatctatgatttctttcatcagtgttttttagttttccttgtagagatctttcacctccttggttaggtatattcctaagtattttattttttgcagctattgtaatggggttgagttcttgatttgattctcatcttggttgatgttggtatacagcagtgctactgttaccggtggagggtgtccatgttcttggtattttgaacaaagaattggaaaaaaaaaaacacacaaataaagcaaggaaagaatgaagcaacaaaagcagagatttttattgaaaatgaaagtacactccacaatgtggcaacaggcatgagcagtggctcaagggctccagatacagaatcttcttgggtccaaatacccactagaggtttcccattggacactttacattggttcaccccatgtaaatgaagtggtggcccgcaatcagtctgattggttgtggaaagcaaccaatcagaggttgaagtgaagttacaaagttacactcctatgcaaacattacactcctatgctctttgcaaccaatcaggggtactttcaatttcccatctgcaggaaagaggatttgccaaggaagtagcctctggtccttttgttacttaaacatggcaagttagggttttcctttcaactgcattctaggaagtcagtgtgaaatggccttaggttcactgactccagaccctattctcctgcctcactactgatttgtgtacattgattttatatcctgaaactttactgaattaatttatcagttctagaatctttttggatggttttctagtatatgattatgtcactgacaaacagcaacagtttgatttcctctttaccaatgtggatgccctttatttctttctcttgcctggttgggatatagcagcatgattggtagccaaaagtggaaatgactcaaatgtccatcaaatgatgaatggataaatgttatatatctatacaatggaatattattctgcaataaaaataaatgaagtactgctggaggattctaaaaagatggtggaataggaagcaccaggaatctatctccccacctggaaaaacaattgcactgtcaaaacctatctcttgtaactattttggaactgtggagtctattaaaggcttgcaactttcaagggaaggcttggacagaaaactgaacttattttggtgaatttcagctcttagttcagtatcatctacccaaccccaaaccccagctccctagcaggcagtctgtattacttgcaggagcagctttaacatagttcatgagagtcaatgagcagtaaggaccctgtcctcctattgatgagggtctatgttctgataattgattactgcttctgatcaaggagatgcaaacacagaggtagccgccattgttgttgcaccttcccccaccattgtaagcttttactcctccagctgaagcaacttccagggaattttccttgttttcttccttttggaagacaaacattaaagactaagacattaaaaagcaactacatttacagagaaaagtataaagttaaattgaacacccagagaaaggcataaactcagaaaaatacctgagaagaccttaaatcataaagatgctcaaataactaaggaaagatgtggagaaagtgaagaaaataatatataaacaaaatggaaatatcaataaattgaaaactaaaaaagaaatcaaagaaattctagagctgaaaagtacaactgaaatgaaaatcttactgttgggattcaaaagcatatttggtcaggcagaagaaagaatcagtgaacttaaagataagacaattgaaattgttgtatctgagaaacaaaaaaattaaaaagttaaaagtgaagagagcctaggggacctgtagaacaccaccaaatggaccacagtctgcattgtgggagtccttgagaaaagagaaagaagtagtatgataatttgaagaaataatggctgaaaacttcccaagtttaataaaggatatgaatatgatcatcacagaagctcaatgtactccaagtagtatgaattcaaacaaacctccactgaagcatattatccatctaactgtcaaaagacaggaaagaagcaactcatcacatgcaagggatttgcaaaaatcctctacaaaatacctgatttcagcagcatattacaaagatactgcaccatggccaaaagtgatttattcctagaatgtaaggatggtttaacatacaaaaatcgatgcagtattctacattaacagaaggaaagagaaaaactgaatgatcattttaattgatgcagaaaaagcattaaattcagcactctttcatgataaaaaacaaacagactaggaatagaaggatactgcctcaacttaataaaaggcatatatgaaaaacccgcaccaaacatcatgctcaattctgaaagacagaaagcttttcatctaagatcaggtataagatgaggatgctggctttcactactgctattaaacatagtactggaagtacaagccagagcaattaggcaagaaaaagaaatataaggcagccagattagaaaggaagaagtgaaattatctctgtttgcaaatgacaggtcttatacgtagaaaaccctaaagatatcatttttaaaactattagaattaatacattcagcaaaaattgcaagagacaaagcacataaagtcagttgtatttctatacactaatgatgaacagtctaaaaggaaattaagaaaacaattcaatttataatataaaaaagaataaaatacttaagaattaactaaatggatgaaagatgcatacaatgtaaaccataaaacagacaaatggaaagctatcccttgttaatggattggaggacaatattattaagatgtcagtattacccaaagtagatatgcagattcaatgtaatacctatcaaaatctcagaaaagcagaaataaatccatcctaaaatttgtatgtaatttcaaggaaccccaaaagccaaaagagtcttgaaaaagaacaaagttggagcactaatacttcctgatttcaaaacttactataaagctaaaataatttaaactatgtggtactgcataaagacagctttataaaccaatggaatcaaatttagaggtcataaataaactctcacatatatggtcaaatgatttttcacaagggttttatgaaactccgaggggaaaggatatcatctttcaacaaatggttctgggaaaactggatatccacatgcaaatgaattaggttggacccttacctcgcaccatattcaaaaataaaatggatcaaagatgtaaatgtaagaactaaaactatgaactcttataaggaaacagagcaatagctttgccacattggatttgacaataatttcttagatatgacagcaaaagcacatgcaaaagtaaacaaattggactgcacaaatattaagtactgttgcattttaaatacttttgctcactagacattatcagcagaatgaaaaggcaacctatgaaatgggagaaaatattcgcaaatgatatatctaatgttcataggtatccaaggtattaatatccataacaaatagagaccttctaaactcaacaacaattataaaaacaaacactccaattcaaaaaatggacaaacaacttgattagacatttctccgaaaatacatgaattgccaggaaacatatgaaaagatgctaactatcactaattattagagacatgcaaatcaaaaccactatgagataccaccctcattaggaagattactattaagacaaaataaatattggcaaggatgtggataaattgaaacccttatgcactgttagtgggaatgtaaaatggtacaactgctatggaaaacagtatggcaattcctcaaaaaattaaaaattgaattaccatatgatccagcaatcccatttccgagcatatacccaaaataatcacaagcaggatcttgaaaaaaatatttgtacagtcatgttcatagaagcattcttcacaattgctaaaatgttgaagcaacccaagtgaccattgacagatgaatggataagcaaatgtagtatatatgcacaatggaatattattcagccttttaaaggaaggaaattctaacatatgctacaatgggatgaacctttgaagacattacgctaggtaaaataataataaagccatgtatgaaaaacccacagcaaacatcatattcaatagtgaaggactgaaagcttttcatctaaaatcaggtacaaagcaaggatgcctgctttcactactgctattaaacataatactggaagtcctagccagagcaattaggcaagaaaaagtcataaaaacacaatattgtgtcattccacttatataaagtgcccagaacagtcaaaatcttagagacagaaagtagaatcgtgttttccagagcctgttaaggcaggggaaatgagaggttattgtttaatgggtacaaggtgtcagttttaaaaaataaagtgttctggagatggatggtaatgatgtttgcatagcagtgtgaatgtgtttaatatcatggtaatgtacacttaaaaatggttaagataataagttttatgataggtgtttttttaccacaataaaaagttttagacaaaaaaaggaatgaagtactgatagatgctacaacattgatgaaccttgaaaacataaatattatgttatgaaagaagccagacacaaaagatcacatattgtataattccattaatatgaaatgtccagaataggtaaatctatagagattgaaaatgaactagtgtttgcctagggctggaacaaaggagttgttgagaggaaatgggtgtgtgaccactaaaagttgaattgtatggtattagtatatgaattatatgtcaacaaaaaagatgttacaagaagtattaatggaatggtgggcaaaccataactgtggagttgaacatgtaagaaaaatgggttttccaggactgattgatatatggctcatatctcctatgtttaactagcctgtagaagattttaatttctggccaatttccccatcaataacatagagatcataatatttgccttatttttgtgaagattaagtgagttaatccatgtacttagcccagtgcctgatgcatacaaagtgcttaacagggactattacattacatagttttccaaaaggatgaaagtaggttctagagtatctttattgatattccaaaatgaaaataataaaatttttaaaattatgtgtggaattctgtaagaaaaatagttgctacattatcaaacattttttaacttatgaaaggtttagatattaatgtatcaatttcaaataaatgttaaatattacaattatagaaaccttgtgcgatataactgagcattaaaggtgaaatggatagtgtaaaaatcataataacatccccacttaaatggaagtcagagttccagttatctcaaccacctaaaaccaagctgtaaacaaaaacaagtgtaaaagatgtgaaagcaataatgcaaagctaatacagtttgtgaactaagcttgagccatttttaggacagtctttcacagtcctttcacttactttagtctcataaacccaggtctctgaattcccagcccagaaattaggacgtgataatttcaaaaaagaaaaacagttgtgttgttaaaagtaggtactctgacaccagaaaaaaaaaatgcttttaaagaactcacagctcagcagaaatatgcttaactatcccaaagacagtataagtttcagtggaaactttcgttcacagatcaggattgtgttagttttcacggtatgtttgtggtatttcagaggctaccatgcacagtgaggaatagatttcatcttatgccataccccatcttgcttttgttttttagcagtctggctctgtcacccaagctggagtgctgtggcacagtcatggctcactgaaacctctgcctcctgagttcaagtgattctcaaaggttgacagactgacatgcagaaaacaaaaaataaaaagaatgaaaagcaaagacgacctagactaaaagaaaatttttttgtctcttctaacggcaagcagagacaaacattaaattgcaatatcgtacaatcattcaccatctgtaattcacaatctatagtgacaatcttgagcttctaaaaaaggttgatttcactattacctctttagtaaggcagagcactattagttttcaataatttcattcaatttagcctgttgagctccttaacttctgggcccactgggaggtgaataattcataacttctacatgaaagagctcacagactgaaaaagaaaataggcttaaacaaagggagcacagtgtgacacacaaggtacagatttagcttgaaaaatggaggaattaattaggaggagagtgacaataaaatgatttctacaaagtgttgacatcagagctgacatttttttttttggcgggagggagacctgagttttattattactcaaatcagtctccccaagcgttcagggatcagagtttttaaggacaatttggtgggtgggggtaagccagtgagccaggaatgctgattggttaggtcagagatgtaatcatagggagtcgaaggtgtctccttgcactgagttcctgggtgggggccacaagatcagatgagccagtttattgatctgagtggtgccagctgatccatcaagtgcagggtctgcaaaatgtctcaggtactgatcttaagggcagtgtatccttaaatattgtagcctctagctgcatgattcctaaaccataatttctaatcctgtggctaatgttagtcctacaaaggcagtctagcgcccaggcaagaaggaaatttgttttgggaaagggataaactataaact

SEQ ID NO: 413 - DNA, 83819 bp, Homo sapiens
attctgtctatcttgaaaagacacctatatgaagactctctccaacctcattggaaggtcccataccaagaccttctcaccaatccctgtatcaccaaactcaaaggcattgactcattgatccacatctctcattttaaaagggcttctacttctgcctggaccggtaccccagcaggcaatttaaagtttatctgttatctgaagcagacaacaattgaaataaactgctattcacaagacgtccagaccaggccaatatacccttttccttttactattggtctcttcttatgtgcttttattttcctggaaaaataaggctctaatttgcattttctaatctatttccaaaatgagaaacataaccgatttattggatttggtaccaaaaaaacttcaatctccatgatgcaagtgaacccctggtctaactcataatggatttttttttttttttttgagatggagtcttgctctgttgcccaggctggagtgccgtggtgtgaccttggctcactgcaacctctgcctcctgggttcaagcgattctcctgccttggcttcctgagtagctgggattacaggcgcaccaccaggcccagctaatttttgtatttttagtagagacggggtttcactgtgttggtcaggctgttctcaaactcccgaccttgtgatctgcccaccttggtctcccaaagtgctgggattacaggtgtgaccagcggtgcccagccctcagaacagattttactgatattccccatgtaactgttctaattatacatctagtcctttttacaaggtcaagcttttagactcacatattcagatttcctgtttcaccctaacattacctaagatctacaaaaaaggccttgaagttagattaagattatgcaaacaacatgctgatagaattcaagagaaaagaaatttgacagcttataaaaatatttatgaccttcctcctctaattgttgatgacttccaacagtgcaataattcaataatagaaccctggataattactgttgacacctccctacaagtaactgttaatgcacaaggtactccatctacgtggaattacctgttgtgacacatcgagatacattttcatctgtgggggagcctacagtcagctttattcatgggcaacatcatgtctcaataaatggaaaataaagcaccaatgtggtctgggatatttctacattcaatttaaacttgcaaaatctgaacattggttgacatctactaacttgcaccatcatatcaaaaaagacactctacctagaggcataaactcagcaggatgggcctcagttgttagatccttcttcctctggattggggttagtaccttagaaataatggttagaaatttatccctaactattggagctccagctgactccacagccaaagccatggcagctcaccaaacttccttagattttcttgccaaagtggttttcgataacaggattgctctagattgcttattagctgaacaaggtggtattcgtgcaattgcttacactagctgcacatggaagtagaaaacacaattatgaaagataacggaacatgccacctggctccagaaagttccacccaatgcatttggacttttcaatctgtttagtgacttaccttcaaaataagattcatggtttagagctatttttcaaactgaattcatgatactattgctgcttattcttgacattatgatagttaagttacattattgttgcctgtctaatctttgcaaagcctgctttcccaacaggaaaatgttagtccagtgcttccagatgattgctaatgcctgtgtaactgataagatggaatccaatgctgaatctcaggtagacctatcctgtaagggtctttccttccggcccctttgttgtccaaatgtgacttgggcctctaatgttgactcctattgactcctattttccctctagtgtggggtcagaacaactaggacaaagcacatcccggcattgagggagatcaagcctaacttcaaggatagttgaccagtgatgctttcagggaaagatcttagtcaaaaaagggaaatgtgggcgcgggggctcacgtctgtaatctcagcactttggggaggctgaggcgggtgcatcatttgaggtcaggagttcgagaccagcctggccaacatgatgaaaccccgtctctactaaaaatacaaaaattagcctgaagtggttgcacatgcctgtaatcccagctactcgggaggctgaggcacaagaattgctggaggctggaaggcagaggttgcagtgtgccgagatggcgccactgccctccagagtggccaacagggcaagactccgtctcaaaaaaaaaaaaaaaggtgggggggtggcagggagcagaatgtgaaagttgattatctaaatggagtcatacctgtcatacccaactaaaatttacagtgcagggtgggggggcatagagaaaaaacaaaaatgaaaacaaaactcaggtctcaaaagcctgctccagaaactgtccagtaagcccaattcaacgaaacagctgctacagttttaagactagttttacaaggaaacagccaccatgactttaaaactagttttacctagaaattgtggccactgaccaatcagagctcaccagctcctgcaaaaaacatgttgcaagcaccaaagagctttctttcataacaacccacatactctttctcctttcccaataaaaccttcaccatttttttgttctaccacatatcagagaccaccctggtctacgcatgtgtaccagattgcaaccctatttctttattccaaaataaaccctcttttgcttggagattcatctctctatatatttgttattgatagaagataaaaagctaataagagactgtgtgaacatacacacaaatgaataaaagttggtgaactacctaaaataaatgagatcaagcctgtgtatttttgtctttagcttccggttgggaagaatttcttcctttctatagctgtgagaccatcaaccaaaattcagaacaaactccaataagttgcaaaacactgatcaaaatcaaatgctcactgcagcctcaaaatcctgggctcaagctatcctcccacctcagccactgagtagctaggactacaggcgcatgacaccacgcccagctaattttgttgctgttgttgttgtagagagaggatcccactatgttgcccagcgtggtctcaaactcctggcttcaagtgatcctcttgcctcagcctcccaaagtactgggaatacaggcatgagcgaccatacctggcctaaatgctctctctctctctctatatatatatatatatatactaacctgtaaatttaaaatttcacctaatgagccagcttaaactggaaattttgttttctaataacatttgttttttctgattgaactgatgttttccaacagtagcaaaagctgatgtatagcatttagaagctaaatgtaactaccatgtaatgtagtagtaaatgttactatgtaatagttacatagtaactaatagtatgtattagtagtacacagtactaatactgctgatactactgctagtactatgtaactggtagttacatagtagttacattttgctactaaatgtaactgaatagcatttagctactaaatttatatatttaaatccatgtttacttacatttagctactaaatgctattcagttagtagtgaaatgtaaatatgtgtttaagtatatgaattatatctttaacagtcatgcctattctttagccctacatttgccctttgtattcttacatattttaagatgaatatcagatgtagttctaggtaaatgggaagctcatgatgcacgaagacagaaatggagaaattgagaagatttatgaagctaggtagtattataacatttatcggacactcgctatctaacagactgtgttctaagtcctttgtaggtgttacctcccataattttccctgatattattgctgtttgttctcattttagtgttttggaaactgatgcatgtggatattaagtaaatgccgaagatcacacgaactgttttagaacaaagattcaaacttaggaaatctgattctaatgttcacgtagttaatcactgtattagagtttctgcagtgtacggaagtgttagttttactgaggatgtattgagtttgtctagtagatgtttggtcatttgaaatggaatatcttaaagattgtgaaggtatgaaattggcagtgagacagaagtgaaagtcactgatggcagacaggtaaatacatgaataattcagtagctcaattcattccaatgtattttcctttagcacctgctttgtgccaggtgctggtgtaactacccagtgagttctccttgctcgctggctagacagagtcagtttataagataggggaactgcaatagaaaaagagtttaattcacacagagccagctgtacaagagactggagttttgttattactccccaaacgcttggaggttaggggtttttcggagacagtgtggagggcaaggggggtatggtagggggcatggcatactaattggctgggttggagatgacaccatagggaattgaagctgtcctcttgggctgagtcagttcctaggtggaggacgacaggactcgttggcaggtccaggtggggccatctggttgtcagaaatgcaaaggcctaaaaagatacctcaaaaggccagtcttaggttctataatagtgatgttatcttcaagagtaattggggaagttgcaaatcttatgacctccgaaaaaatggctggtaattatttataattcaggcccctttcatcctaactttgtggactttcactcattttataaaaatagtttagtttttgggaggggctattatcatttaaactataaactaggccaggcacggtggctcacgcctgtaatcccagcactttgggaggcccaggcaggtggatcacctgagatcaggagttcaagaccagcctggccaacatggctaaaccctgtctctactaaaaaatacaaaaaattagctgggtgtggtggtgggcacctgtaatcccagctactcaggatgctgaggcaggagaatcacttgaatctgggaggtggaggttgcagtgagccaagattgtgccactgcactccagcctgggcaacagagcaagactccatctcaaaacaaaaacaaaaaacaaacaaacaaaagtatactctaaatttctcccaaagttagcttggctcatgtcccagaatgagcaaagacagccaacctgtgaggctagagtcaagatggactcagccatgtcagatttttctcactgtcataattttctcagttataatcttttgcaaaggtggttttactggcctaagagatatggatgaattcagggtgaacaggacatttgaggtctctggtctcacagagcttacattctagtgggaggagatataataaataagcaaatcagtaacatttcagtgctataaaaaaaatcaaggtaatagtgtcttcggatgtgtttatggaggctgctggctgttgactaccttagatagtttatctgatagaatgaggaaaagaagtctttcttcttcttcttttctttcttttttttttgagacagagtcttgctcttgttgcccaggctagagtgcagtggtgccatctcagctcactgcaacctccgcctcccaggttcaagcaattctcctgcctcagcctcctgagtagctgggattacaggcgcctaccaccacgcctggctaatttttttgtatttttagtagagacggggtttcaccatgttggtcaggctggtcttgaactcctggcctcaggtgatctgcctgcctcagcctcccaaagtgctgggattacaggcgtaagtcaccatggctggctgaggaaaagtctttctgatgagattgccagaggcgtttaaacctgggcaactccattttgagtaggggctaggtaaaataaggctgagacctactgggctacatttccagatggttaggcattctaagtcacagtatgagacaggaggtcagcacaagatacaggtcataaagaccttgctgataaaacagattgcagcaaagaagctggctaaaacccaccaaaaccaagatggccatgagagtgacctctggttttgctcactgttacactcccacagtagcatgacagtttacaaatgccatggcatgtcaggaagttaccctgtatggtctaaaagggaaggcatggataatccacaccttgtttagcatatcatcaagaaataatcagagccctcgggggtgctctgtctgtggaatagccattgttttattcctttacattcttaataaacttgttttcactttatggactcgccctgaattctgtcttgcgtgagatccaagaacattctcttggggtctggatgcagacccctttccggtatagagagaacattttaggtgatgtcatatgttgaggagctagctgtgagaagataaggaggtgggagtgaggaacattgagaagaagaaacgaaaagtgggcggctctgagaacgtagctgtaccccagacagaaaagtactataccattattatattgtactttgcttctgtgtcagctttctctatcatccagtgagctgtacaaattatctcaaaatctttaacacctattatatagtagacattcagtaaatttatttaacaaagggatggatttagtaatcatttcattaagatttcatgtaccagatacctcagagatacaaaaatgaccaggtgaagggctgtgccctcagtgaactcaaagttgtgggaagcagagttgtgaacaattactgattactaatacaaggtggtcaatgctattggtgctactacagcattggaaggatgatatctcactgtatttgaaagatatgaggaaactgcatagaagtggcaaagttagaggtgagtgttgaaatgtacctaaattagttgaggggtgttaaagaaaaaattattcaatgatcttattaaggcatggacaggcagagtgcgttcaagaccattgcaatagatataggaattactgcaacagggtcttgtagttgggggagggattgggttcaactccgaatatagcataagcaagtagaaatttatagcaaagagcaggctgagggtcagtggatgaaaaattactaagaggaaatatcagaggtaaagagaattctggttaaactcatctcaaaggattcttgctgaagacagccagggtaatcagacttcacctgggggtgaaaagcgaaagcgaaggatgaggaccccagtcagatatctaggatgggggattcttaccaaactgacatagcacggttctttgctaaaactggattttacaagaaagtacacagacagacctaggacatggctggttttcaaaaaccccaagaagtttaggagtagagacaataagttaaaaccaggagtatatgcagaaagagtagtaggccaggaagcgtattcaggaagtgtctgtggatcacattgagggactaagtggctaagttggctggacttcctggttcaatagggacttccctaaggggactttcccctaagccaaaatgagtcatagctgcaagctaagggattgaaacttcaaccaatcaaaggggactttcccctaagccaaagtgagtcccagctgcaaattaagggattgaaacttcagccaatcatatagagagtttaagctctagctgcagcctgatgtttttaaccaatcaggcccaccaacctaagagaggagaccacccctcatattgtgttatgcccaatttctgcctccaaagaaagaagaatttaaaacaaaaaggcagaaatgaaatccacaggcagacagcccagcactgtgctctgggcctggtagttacagattgacccctgacctaaccgatatgttatctatagattccagacattgtatggaaaagcattgtgaaaatccctgtcctattctgttctgttccgattaccagtgcatgcagctcccagtcacatacccactacttgctcaatcgatcacgacccactcacgcagaccctcttagagttgtatgcccttaaaagggacaggaattgctcactccgggagctcggttttcgaagatgtgagtccgccaatgctcccagctgaataaagccctttccttccataactcggtgtctgagcggttcttgtctgtggctcgtccggctacaaacccacaagtggatagaaaataacctaatcctatgggacagaaaaaggaaaaggggaggagtcataaggggatataaacataagatacccaaaccagaaatggcaacccttccaggttcccttccaccacgtggaagctttactttcgctttccctttacttttgctttggctttaataaatcttgccaccgcacagtctttgggtccacgcatttctctagtgaagctgtaacacttgccactgtggtccacggcttcattccttgaagcctgtgagaccatgaacccttcgatcgagaaaaacctttgatcggaagaagacttctcgtctcaacattaaaggacaaagaagccaactctaaggcatgccattagctttaataatctgagtgtaataaataataatgatcataacggattaaaacatcagatctgtaaaaaatgcatgcattcataatgatatcaaacaaacaaaaactttgtggttaactctggagtttggtagggcaccaactcatgtctctgaaatttcataattaaaaagaacaaatccagcatttacccagtctttcctctatgagattatcctggttatctcaggataaccaatgagttggtatgaaaagattccttttatagaagaacctctggtaataatagagaattattgaaaggattagaaattcactgctctaggataaaagacttaagagacataccaaaatgcaacatgaggactttttttggatcttgactggaacaaaccaactataaaagataatttggactcaaacaggaaaattggaattatttatagtactaaggaattattgttaattttgttagatatgataacggtagttaaatttttaaaatctatgtcagtttgagatgcagactaatttaagggtaaaataatattatgtctaggatttctttaaaaaagaggggaaggaaactgaaacttgattggcaaaatgttgctaaatgttgattctgagggatgggttacttgagggtttgttattaaaagtagaatcacttttgcttatgtttaaaattttccattataaatagttttcaaaagcagagccagtgcctaccccacatcatcttctgttatttaatgcccaggactcagaaagggtcagcagtctcagatcaacagttactgatgtcctaacccatcctaaacactgatgctaatgagtgtggggcaaagttcacagcgtgctaaggagcaacatttaggaacctgactggattccgcagctctcgggacaagccccctggaaaagggctggggggaggggcggggaggcacccaattattctagaaggttctgagatctcccagggatttccgagaggctacgaggtgtaactggcaaatcaatgacttaagagtagctttctcccagcctccccgctggctctggagtatagagggaagccagccttttcctcccccatcctgcccctcccctctcttctcatcttcccctccactctcctcctgaccctggcctggccactcctgctttcacttctctccactcctcttcggccccgccccgcggcctcctccctcctccttgccccgccccctatccctgcgcgccggcggccgttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacggtaaggaccgccgcagaccttcctccgcgtccgtcgcctcctaggccaggtgggctcccagatggtgggacctggccaggggcatggcgaacgaaacacgaccctctggactgacctcttgcccacggttgtccttggtcgggtgggggcagctccgagccctccaggtggccgcactcaggttggggtcgggggttcgggtacatcgaaaggcgcgggtgcgctccgcttcggggggcgattttcctgaaacctgttccgggcgttttggtacccagaaagtgtgcaacgatttgtacactcggagattcactcaacgttcctgcataaaatgccctacaaaaatgatcttttctctccaactctctgggcaaatccaagttgggcgaaaagaagtgccagtttatcccatgcttgtttttaggttttttgttgttgttgttgtttgttttttttaacttctgcgtcaaagcattgcttatagactgggtccgctggctcctcttgggccaataaaaccccagtttattttaacggcttggttgtccattttatgttttctctctctccacgctccttgagttccttaagttcctgttctacacatttttgtagccttctgagcacctattctagtgctgatacatatactaggcgcttcaataaataaatgtttattgaatttgccgtggcaagaactgtaaccagctataagcatgattttttccaattttgccctctgcaatcccaggtttttcacctgaaccttgcattgctttcagcaatgtggtgttgcctctgggaatcccagtctcctttgtgtgggaatctagggtacacattcctagatagaggctgtgtaatgattgctgacatattctggccagtgtttttctgtatttactcttggttttgtgaaataaatcaagttagctcctgtaaacacatcaccatgtttttttttcacgggtaatttgagaaggaggacaaacatctccccaaagtatttattaagctggttgtttctttgatgccgaagtgtctcttttgcagaggaattgctaaatgtttccatgtcccttgctaagaacagaaattcactcagagtagatcaaataaaagtttggattgttataaaacaatctcgccgctagtcatggacaggaagcgaagtatagccagggcggatgagaacctggatggggaaaatcagaactaagatgctgtgctctcctgctttctttctttgaccttatgacctttcaccttgttagggttgccacatttagcaaataaaaatacaagaggcaccgttaagcttgaatttcagataatgaataatattttagtataaatttttgtcctgtgcaatattttggaacacatttatactaaaaaattattcattgtgtatctgaatttaaatttaactgggcatcctgtattttatctggcaactctagccttctttctatgtataatcaagccccaagtaatgatatttcggtcaacagtggactacatgtataaggatggtcccataagattataatgaagttgaaaaactccaattacttcgtgacattgtagctgtcataacattgtagcccaatgcatcactttttctgtgtttagatatacaaataccattgtgttacaactgtctacagtattcagtacaataacatgctgtatgggtttgtagcctaggagcaataggctatactatatagcctaggtgtggagtaggctataccagctaggtttatgttaagtaccctctgatatttacacaacgataagctcacctcataacccgtttctaagaacgtatccccatcattaagcaacacatctctatgcttgcttccttccatctgacagaaagcctcttgtgtatggatttctcttactatgatagggactagggtggcgtgcttcttgactaattagccctaaagctcaccaccaattgtatagcgtctttgtgtattgtagctgaaaatttaagttagaaatttaagattggttgttggctggccaatgaattgactggccttgggccaggtttccaccttgacagaactgtggtggtgcaaagatgaacacctttccaggttcttttacccttccttatgaagccctatgtgattagttccctagttacttctctggcctcttatctactctctttcccctccttcattctgcctcatttgtcctggtttctttgctattcttcagacgtatcaggcatgttcccatcctagggactttgctgttcttcagatgtatcaggcatgctcccatcctagaatgttcttcagatatctaactagctaactccctcaccttcaagtctccttacatgccaccttctcaagggcctgccccgaccaccctagttaaaattgcaacccaatcttccttacccgatttcttcttttttaaaaataacaaccctcaaattctaatgtgtaatttgctagtttattatgtttgttgtttgttgtctctctctcatgaagtcaaagatttttgtcgttttgttgatgtattctaagcacctagatagagtagccagtcaataaacatgtgttgaatgaaggagcaaaaagagcctgagcctcttgcagcttttcagccttggtgggaatatccaatgtctgcattcagtaaatcgtatttgttgggttactaatgaattattaggttttaggaattgacacacattatccaaattcaaaagagacttgtttctaaatcacaattcccaaattattaatttctatggagaaatatgtgttaccatgttatctagactagctggtcagggtatttgcctccccagagacaagtctacttgggaaatcaagtgtatccaaaggctgcttgttaatttaatggcaaatcagttgattttaaagggtggtacagtatagtcaatcatgaatattcttcatcactttaaagatatacctgataaacagatacttataatagcagggcaatattttgttgaactttgtaaaaataacagttccatcatcagcaaacttacaaacttaaggggtgaattctgaagatagctgattttttttttaaccgtgttcaccaattctgagatatcatgtggtttgcatctttctagtgcaccaaatatgggagatggtataaatgtattgcttctttcacttgcaaattggcatagtgcgtatatacaaggtctttcccttgaagaattttttgggttacccaggctcaaaaggagttttgttcataggagagaagaaagtgtgttcagggtgtagtacttgaaaacatgctagactttctttatgaattccacttccgtaagctgacttggaatactcagaaaagaaaaacatcttgacaactgttgctggtagaagtggtagagtaacagggccacatgcacaacagagcatgagctgctgcagagtcagacaatatttaaacttttaaatttgttttccaattaagagattacattactttgccattattctcagcctaggggtagatatgttctatctgttatgctacttgattgtttattttgcagatccattgtttattgtgtcaagtgagaaagaccatacacaggcaaatatccaagctaccctgattcgcagcagactggtatgtctaattcatcagccaaggctacctgatgaacctgaaccatctagtttgcctgactgcattgatcagattgactaatcaccaaatcttcactggattttaggttccacagaaattaccttgccaagattactggagggcaaagcatcttaatacgtgtggctcattgtgaggattaagtcaccaataatgaacagagaacccataagctaatttatttcaatgggataaatttaataatatatgcccatgttaaaagaattcaagtagtataaaagcatatacagtgtgaagtaaattctagccctatcccctaccccctccacataaacagccattgtcatcagtttcttgggcatgtatttaaagatattttacgcatacagcaataacccctcttcttatgctgtatacattgttttgtatgtttttaaaaagagtttacaatgtaattaaaatgctttagaaaagctgatggtataattttgtcctttgcctcccttctctaacattagagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacgtaagtgtcgggtggctccagggcctaaaataaatgcattaaaagcatttctttaaattcatttaccatgtgtggttttaaaatgttcagttgtggtgttatacctaggccaaattttctttctaaacctcttttgaccaaacaaacctgattatatattgtatatatgagatatatatatatatataattttgtcatatatataatgacaacttgccaccaaaggtagggatgattgagtttgttgttgcttggatccaacttagcaactgaaagtgctctgttctgctagtatctaaaatattttttgggaacttggggccaaagcaccttcaagaataagtcgaattctttattcttttaattacttacaagttcacatttagtaaattaaaaattataaagccttttaacctggacatagaaaaagtgtcttttggccaggcacagtggctcacgcctgtaatcccagcactttgggaggccgaggcaggcggatcatgaggtcaggagattgagaccatcctggctaacacggtgaaaccccgtctctactaaaaatacaaaaagttagccgggtgtggtggcaggtgcctgtagtcccagctacttgggaggctgaggcaggagaatggcatgaacccaggaggtggagattgcaccactgcactccagcctgggtgacagagcgagactctgtctcaaaaaaaaaaaaaaaaaaaattgtcttttaatattttgctattcttgtgtgcttttaattaaaattgggcatttttgtatgtgggatttcataaatccactcttttctcagctcttgctctgtctgactaggttctggtctcctggctcaggggaagaatcatatatactctaagttgtatggcagtcaaatgcaggttatggaagactttactctcagtatgagatactctgtgtaggtcctactctatacacatagaaatattaaatagaaattatatgtggaaatattttagacttgaataatgttttcttgcttcattttagaactgacgcttcttttcagatgcctaaagaagtttatgaagatcctgaagttactggaaagaatcgctataaatactttgaaaggtagaacataattactaatgaatatttgagccctaatattattagagaacctctttatgataataataatagttatcatttttcagtgcatacaacgtgccagactctattttaagtgctttacatgcatatgatctaatcgttaaaacaggaatgtaggctaagatatatatgatccctgttttaccagtaatgaagctgagaccgagagatgataaatagattgctcaaggtcatataagctagcaaggggtagatctggggttccaactaagcctgcctgactttagagatactgattgcaactaagaatatgtatttgaaaatatttgaaatgaagtcatcaaatgaacgacacacagttggagataccatgaagtcatagtgaaggggaaacttgtgttcaaagggataacatttgttctctttgtatgaatcttgcctaaaccaacaaggccaaaaggttcattttatttcatttgtgatttatgcttatgtaataaccatatactcaaatcaaattaaaattagatggggatttccttatatatcctactggagttagaaaaaatagtcttgataccacatctgtataagcttccttgagaaagtaaatttctaatccacattattatttatgagcaacctccttatggaaattttgtgatactgacttttccagagaaatgttaaattcttaactgttaactatacaattctgtacagttaactgtacaattcttaacttttagggggaggcttcatattaaatcactgtgaattccagaatgtctcaggaacttgagaagttgttgggaactaatggccagctgaagcccaagtacagggcttaaagtgtggcttcttcaagtgtgacttgtttcccatctgaagagaaaatactggagtgtttattaagaatgcacattcattggctctaccctatatgtactgaatctcatgggccagacctgggaatctgcattttagacaagaacctccccaccctgcagtgattttttatgtccagaagtttgagtaacactgatatatgggatatttaagctcactgatttttaagggacaaatattagagctggaagagagcttagagtgcattcattgcaaaagtcccacacatttatgttttctttttcctcccaggccttttctcccattttttcagcagatgccattcaatgttgtttatgccgtatccaagtaagtaaccattatttgaaaactctttttcagtttatttattgtttgcttccatattttttcttagaagatagttcactaaatcactatttttcaaattgtggatcacaaaacattagaagggtatgaaatcttctagtgtgtcatgagcagcattttaaaacatgaaacagaatagaaaataaccaaagcatcaagtatatggagggtaagttggtttttgtttataacttttgtttcagaaaaatatatgcatatgtttatatgtatatgatggattatgatataaaatgtatttcttactgttagttgtccatttgtgctgctataacaaattaacagattgggtgatataaataaaataaatttatttcttgaagttctgaaggctgggcagtccaagaagcaaggcagtccaatgggcagtcagtgtcggtgagggccttcttgctgtgtcttcacatggcagaagaagcaaatgctgtgtcctcacgtggaggaaggtggaaggccaaaaaggacctatgctagttctctgtaatccttttataaggcactaatccattgatgagggtggagtcctcgtgacttaatcacttcccctaaaagccttacctcttaataccacgacaatggggactaagtttaaacatgaattttggagaagacacagacacatattcaaattgtagcagttgtagtttaaaaaagttgaaaagtgctttaaatatcttcttttgcttctctgaaacacttatttgatgacagttcttcaacatttcattaaataaacaaatcagtcatgtaatattttttgaatgctagaattttataacttaataaccatctaatctacacagataatgtggtatacaaagataaataaaacatggtttctgccccacaacggagtgaaccaaggtaagagggaggtaagggacaagggctgaatctgagacaaatgtgtatttcttgtctctagtttcaggacaagacagcagactggtagagtattcctttaaaaatctaatttttgctacactctttcctctgttaatataatttaatatttctgtaagagaaaaaagtctaaggtattcatgaaattatcaggaatagaaaccttttttaaggtctcatatttctgaatacaaatttattcaggactaggttttcaagggtgcatttaaagaatatagttattcctaataatatatatcatcatatgaacaggacatgtgttattaaatgtctgtaatcctcaagataaatgctagttatgactctacttcacccttgacatttttttaagactgtgtggatggctttggctctttatagagatggagtacagattccctgctctccctagacagagcaacttcttggggtaccagtttatccagaaatagctgtagacttatattctatgaaatgttttgtatgagcaaaaggggagctatgagctatgtagatccctaaagagccttctggtaattctttaaaatcaggctcactgaattacctgctttggaggtcataactgcctcagtctaaaagttgttaactaattctagggagttcagaggcctgcagtgatgaacaccatgacctccccaactcctccctaaataaccgtgacacaagggataaagattccatccaagagttaaaccatgacatttgacattgtagctactctctatctgtcttagaactttttaaagaatgaatcagtattcctgagtgaggtcaattctggaattccagtatgtttgagtttctgagcagtgagtataatgccaccttgtgttatcagggatggaattgtcttgggaccagctggccttctccagccacacccttttcatggctagctgttggagtctttcctttggattctacataagcaccttttcaaagagaataaaaagttaatacttttaaaacattcaatgaagttcatagtagaacaggatttgctaggtttgtgaagcccctctctgtacagctctgttggggctgggagagaaaatctagaagactgtaggtatggcagacagtgcatgctcctggtgcctgggcagtggtggaggaggaaagggcctggatagaacacatagagcagccctggctgccataagagtactaaagccagagcaggtgagcctgagggcaggagccaggacacagcaggggtcaggccagcatggagcagatgtgggacctttctgagtttgggtcctgtttgaggttggggaggaggtgggaaagggatcattgctctttgttactcatattttactctcccctaaagccaacagaaatggggaaaaaataggttggagaaattaagaagttagttaagaaaccatgtattaagttactgaaagagttcaaagtagctttcctcttttacattctattccctgacccacctggaaagatacgaagccagaaaccttcatcagaggagttcattaggccttattataaactaagcacatttgatcacatggttcaaatgtgtaattatttaatttgagaaaaaataatttattctcttgattcaagataatggtgcagtaatataataaaacttcatgtgacttcggatgacaaagctgatttgaagttatttattcaactagaattttatagtagaataatttctactgaaaacataagaagccatatattatctacatgttagaaatttatagcaactattggaaagtgacttcaatagcagttacagttcagcattacaaactaaagcccgtgtgcggtggctcagacctgtaatctcagcactttggaaggccgaggcaggaggataacttgaggtcaggagtctgagaccagcctggccaacatgatgagactctgactctactaaaaatacaaaaattagctgggtgaggtggtgggcacctgtaatcccagctacttgggaggctgagtcaggacaatcacttgaacccgggaggtggatgttgcagtgagctgagatcacgccactgtcctcaagcctgggtggcagagtgagactccatctcaaaaaacaaaacaagacaaaaaaaaaaaacaactatttaaagtacttgctccagcacaggttgaacttccaaacaggtatttctttctaactggcttgaaatgcttttttaaaaaatttttattttatttttatttatttatttatttatttatttatttatttatttatttatttattttttgagatggagtcttgctccatcactcaggctggagtgcagtggcgtgatctcggctcgctgcaacctccacctccagggttcaagtgattctccttcctcagcctcccaagtagctgggattacaggtacgtgccaccacacccagctaattttttgtatctttagtagagagggagtttcacatgttggccaggctggtctcgaactcctgacctcatgatccgcctgccttggcctcccaaagtgctgggattacaggcataagccactgtacctcgcccttttttttttttttaaacatctttggtgtatgtatttgctgtgctcgtatataagctcttaccattgcctctgtttttcaaaatggaaatatctctttgtttttgccttcatctttagttatttatgtaatttaatcaatgctttcaccaacttgaaaaaaatgccttaagtcaaagtggctatattggtttttttcttattctagaggcaatgcatgtacatgttaaaaaagaagattcagaaaagtataaagatgaaaaaaattatctgtataattttaccatctagaaataattactattaatttattgtatatacatctaggtatttttgtatgcataaaaacacagttttaaaatgtaaaaatggaatcctactatacataccatttaatagtgtcatttttttcttctttacaatgaatcatggatatttttgaatgctcacaggtatagattacattattattttgaatagctgcataaattccattatggctgtttcatatttttttaaacaattctcgtattgatgtgatcatttaagtttctaatttttcactcttagaaatgagactttatgaacatgtttgcatatatatctttgaatacctgtccagttatttcctagaataaattcctaggagtagaaatgctggagcagccgggcgcggtggctcacgcctgtaatcccagcactttgggaggcagagacgggcggatcacgaggtcaggagatcgggaccatcctggctaacatggcgaaaccccgtctctactaaaaatacaaaaaaaaaattagccgggcgtggtggcgggcacctgtagtcccagctactcggaaggctgaggcaggagaatggcctgaacccaggaggcggagcttgcagtgagccgagatcgcgctactgcactctaacctgggcgacagagcgagactccgtctcaaaaaaaaaaaaaaaaaaaagaaagaaacgctggagcaaagcgtattttaacttgtcaatttggtgtacctatttgtatttccatcaacagtttatgagaaggcctgtttcttcacaacataatcaatgctaggtactttcagtcttttaaatctttgcttatgtgataaaatagcataaaatagtatcttgctgttttacttttctttgattactagttattttcattatcttctcatatgtttgttagaagttttactttttgttttgtgaattctcctttactcatttttccatggggtatttaactgcctaattgatttacaagggctttttatatagaaaggctatttaaactttttatcatatatgttccaaaacctttttctaagtttgccattcaccttttaaatttgtttgtgatattttgaggcatagaagttgaaacttaccctcaattctattgatcatctccttttatggtttctggcttttaagcccggcttaaaaagaccttcactcaaagatgatataaatattgacttatgtttcctgttagtacttttatagtctcatttttacattaatttttttaaagatctggaattaatttttctgcaagagacaagctaactttcccacatgttaataacaaagtgatcccagcattaattattgaatcatttatccagatagagcctgtctgcctgcctgcctgccttggttcctcccttccttcctttttctctctctttctttcagcagaaaccatctcttctcttttctctgctcccatatttctggagggaaacagagagtggtatggaactgaaacaaagaagaaagaaaccagagaatgtagtaatgctgaacaggttcagaagtgctgtacagcattctagaatagctctgttctacaaccttgcccagtgacacacatataaataggcacttctgtgggtcaaccatggtactttgacccacttagtttcctggcagaggtgagaataacaaggcaattctctcaagatttgtgcgcataatcctggttataatggattcatgattttgtacctgtcaacatttaaaagaggaatggacttgacaaagcttcgaagatttgtttctacttgattatataatattttaagtgaccataacaggtttcaatttttaaactgatttttctcttttagggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtgagttggtaaatctcctgactattggcagatgacgatgctgataaccacgcatgctgttcaaatggcccatgtacaggcaattgtggtttacagtgttgctatataaagtgtcttagtacagcaacttcatagactcataatttttctgatacttctggtcaaataaagatactatctttttattgtgagtagttttatcgtactctatctgtgaagctgaatttcagcttaatattgcagttgctttgctgactactcacctatgtcctctcatttctctctcctagtgaaccacttccttttcattgagcaatcatacttctttaaacataagctttgagtgtaaaatactgaatgcacattcctatgtatgtcatattatcttaatttgccaaaatatcttaatttaccaatcctcccttatatactttattagatgatttggatgacttgacattatctctgaaatgctaaatatctttcaggctcagaaattaactcttagaatgtaataaaatctggcctaggcctatattatgtgaacctataaaattaataagtgagactacctttagaaattattagaaattagcttatgtaactcacttagttgtattaatagctgggaaactgagaaccagagaggttaactaattcctccaaggacatagagatagttggttcatggtaatgatttttaaatgagattactttcccccgcattgtaacagatagctgtgatcaagtctgcgtcccagacaaagaagatgttcatatctgggctctagttttgattcttgtttcctggcccactttatgaatccagattaagcattatcaacacccatacttttttttgagacggagtcttactctgtcgcccaggctggagtgcagtggtgcgatcttggctcactgcaacctccgcctcctgggttcaagtgattctcctgcctcagtctcccgagtagctgggagtacaggtgcatgccaccacacctggctaatttttttattgtatttttagtagaggtggggtttcaccgtgttagccaggatggtctcgatcccctgacctcgtgatctgcccacctcagcctcccaaagtgctgggattacaggcttgagctaccgcacctggcccaacacccgtactttaaagcagaggctctactttcaggcctagatggcaaattaaaaatatgctgaaaccttccctttctgctctgaatgcataaaaattacaggaaaaaattaataaacatgtagacacacttaaaagcaagaaagaaaatattcgtaatgtagaaatggagactttttcctaagaaagaagtagctgggaacctttggtggtgagtaggagctgtgcatggcagggaaccaggtccaagtcacctgcctgaaggtgaggggccagcgcccttctcctgcacactggtgcaactgaagcctggtgcctgcccaataaagattatagacagagcagagtcaggcattcctgcctgtggccttggactttacctcttggtgtgataaggacttggcgttaaactgcagaaggacaagagccaggcagaggctcagaaatgcttcattaggcaaaaaacaaacaaaaaaaacaacctaatctggtacactgtcatagcagaactgaagttaaagtgtcaataaaagcctctatgagacaggcctactcctaccatttgtgggacccaggactctaagggaggcccacctaccatatgtatagatattttaaaattataaatcaagctaatatctgttaagtaaaatacgttggtttttttttttttttttttcacaaacatctttataacaagttaaaaggacaagtttaaattggaattcttagactcctgggattccatactgtaatgcagcagcgaggtgagagcctgctgtggcctgcccttttctctccccaccctggctctgctctacatctgaggggcctgtcatgcatgcccgtgattaccccagctcttcttctcaatgttcacacatccctacgaacagctgccatttggccccaccttgggcttcagggtgaagaaacagcagcatatagtatgctctcaggaatctgaatcctgtgaagaggcccatggaacctttggaagcaggctcggggccatttgtagaaggatttccaggaccacctggaaatagctccaggtgggcatgaggccttggactcctcaccttgtggtgatgagcagggttctaagaatgaatttaggtagtagccactcgcaggtcaaggctgcttattgaccagggtgcttatgagagaaacctgcagctggtctccacccaagaaccccaaagcacacaaggaacagagacaccaggagtgacccacaacaaataaaggaaatggaagaataaatttctgagtaaacagaaaatggagcagtctgaaaaggacttaggaagtgctttctatattctcaaaaggatgagggggaaatagcaacaccaaaacaagaatgggagtcatgaaaaagaaccagttggaatcaagggggaggaaaactataacgtttgaaataaagtgaactcaatagtagaatagacggagctgaagagcaaattagtgaaatgacagattaaatggacacatattccacaatgcaacatatagtggtagaacaagataaaagaaaagtaagagctgtgggggctaggacatgagtatagggaaaatggtagagaagcaatgcaagaatcagtggctgagaactccccagaactaaagaaagacattagccttcacactgaaaaattccactgagtaccaagcagaatgattttttaaaaactcacacctcctaataaaagagaaagaaaaagtgaaaaaactattagaaaaactattagaaagataactcagattacctacaaagaaaaaaaaagatggatattttgtagtattgcctttaaggtgctgtgggaaaatgattgcaaacctagaattcttttaccaggcaaactattattgaggagtgaaggcgagataaagacattttcatacataagaagaatatctatctcataggatactgtaaggattaagtaaatttatttatgtaatgtgttcatacctacaatccagcaatttcactcctaagtatacatcaaaaaaaaaaaaaatgagcacattattctgctaacggaaatgcataggagtgttcaccaaaagacatatacaagaaaactcacagcagcattaattatgataactccaaactgaaaacaacccaaatgtccatcaaccatagaatggatgaatgaaatatagtctattcacataatggaattctatataataatgagaatgaagtacaactacatgtgattacaagggagattgtagatgtgtatataattgcgtatataatgctgaacaaaataagatacagaagagtgcctacactgtgatttcatttacataaaatgtaaaaccagtcaaaactaaattaacgcattaggaatgagaatggtagctatccttgggacaggtagtgactgggaagggagtatcatgggcattctagtgttctggtaatattctattccttgatctgggtgctgattatatgggatgtttgtttttgtttatgtatgctgtacattcatgaaaagtttacataaagataagggaaaaataacgacagtgaaaaaggatgacactgtaagcactgcggggataaaattaagtgcttatgatgtgtcaagaactgatccaagtgctttacattttaaacctattcagtcttcacatgttaaatgaataataaagttgaaacaaatagttgacaatacagatcttttaaaaggcaaaagaaatggtcattagggccataagtaattttctaatgaagattaataatacagccaagcctcttgtaggaagcatcaagaaagaagacagaagatgcaaacagagtattgggatagaaagggggacagagtaactacagaataaacaacttaagaaatacgagagtgctatgaatatcttttgccctatatttaaaaacttagaaaggctgggcgtggtggctcacacctgtagtcccagcactttgggaggctgaggcaggcggatcacttgaggtgagaagtttgagaccagcctggccaacatggtgaaaccccgtctctactgaaaatacaaaaattagccagacgtggtggtgggtgcctgtaatcccagctactcaggaggctgaggttgcagtgagtgacccaagattgcaccactgtgctccagcctgggtgacagagcgagactccgtctcaaatacataaatcaaaaaaaaaaaaacttaggggccggacgcggtggctcacccctgtaatcccagcattttgggaggctgaggcaggtggatcacgaggtcaagagatcgagaccatcttggctaacatggtgaaaccctgtctctactaaaaatacaaaaaaaaaaaaaaattagctgggcgcggtggcgggcgcccgtagtcccagctactcgggaggctgaggcaggagaatggcgtgaacccgggaggctctgcttgcagtgagccgagatgatgccactgcactccagcctgggcgacagagcaagactctgtctcaaaaaaaaaaaaagaaaagaaaacttagataaattatacaatttttaaagaaaatgtaaattactaagttggttttaagaagaaatcacaaacctgaatagaagagtaactatagaaattgacctggtaaaaagaaaaaaaaattcttttaagagcaccaggcctaaacagttttacaggtaagtttaccacacctttaaggaacaaataaactgctttatgcaacttctttcaggaaacacagaataaaagttaatttattcattttatgagaccagtatagccttaatttgaaaactgaatgaggacagtacagttattacttagtattggtagcacattgattttaggaccctccaaccctaccaagatttttggatgcgcaagtctcttatgtaaaatggcatagcatttgcatataacctacacacatcctcccatatatttaatctctagattacttataattcctaatgcaatgtaaattatacataaatagttattatactgtattgtttagggaataatgacaagaaaaaagtttgtacatgttcagaacagacacagtttaaaaaaaaataatttcaacctgcagttggtcaaatccacagatgtagaaccatggatatgaagggccaactatactagtaaggaaacttacaggccaatctcacatatgaagaaatatgcaaaaaaattctaaataagatactagcaatctaatcttgctgtattttaaaagagtgacttataaccagatggagttaatcagagaagttcaagtttgttgcaataccagaaagccattcatgtaatttaccattttaaccgaaaacataggaaaaatcctctgggtgcaggaaaaagtattttatagcatgcagtgctcatttatgacatatactctgaataaactgggagcagaaggaaactttagagacttaataaggaatatctaccacagcctgtaataaacatcatactaaaggtgaaacttcagaagctttaccttaaaagaaaaagacattggtaatgctcattatcactactatttaacaacgtagaggagatcttagcccagagtttatcaagcctggctatgatctctcctttcaggaacatttgggaatatgagtggcatttttctatgtaataatgataggaagtgcttctggtatttagctcgtgggacagggtatagctgataggctggcatggatactaaacatcctgtactgcttgggggagtttcatacaaataattatctgcccattatggcaatagcaccctggttgaggaacactgagtcagtgcagcaagataagagaaaaatggaggcatggcgattagaaagaagcagcaaaactatccttatttgcacacgtgctctcttagaaaaataaattatcagaactaaaaagagagttcaacaagaagtcaacatacatcagtcgctttcctatatgagagaaatatccaattagaaaaattgttgaggccaggtgcagtggctcacacctgtaatcccagcactttgggatgccaaggcaggaggattgattgaggccaggagtttgagaccagcttggacaacatagtaagacctccatttctacaaaagaaaaattagccaagtgtggtggtgcacacctgtggtcctagctactcaagaagctgatgcaggattgcttgagcccaggggttcaaggttacagtgtacagtgaaccatgatcttgccactgtattcccacctgggcaacagagtgcgaccctgtctctaaaaaaaaaaaaaaaaaaggaagaagatgaaagaaagaaaaagaagagaaaaattatttagctgaggtcaggagttcaagaccagcctggccaacatggtgaaaccccgtctctactaaaaatacagagaaattagctgggcatggtggcatatgcctgtagtcccagctactcgggaggctgaggcaggagaatcacttgaaccgaggaggaggaggtttcagtgagccaagattgcatcactgcactccagcctaggtgacagagcaagactctgccaaaaaaaagaaaaaaatcttgaaaaaaattacattcatttatttgttttagagatggagtcttactctgttgcccaggctgaagtgtagtaatgtgatcatagctcactgcagcctcaaaccctatggctcaagtgatcctctcaccccatcctcccaagtagctggggccacaagtccacaccaccatgccatgctaattaaaaaaatatatttttttgtggagatggggtttcattatgttgcccaggctggtctccaattcttggacctagaaattctcctgtctcggcctccaaaagtgctgggattacaggtgagccaccgcacttggctgaaaaaaattacatgcacggtagcaatgaataacaaagtgcctagggaatcacttaataaaaatgtacaagggatttatggtgaaaagtataaattattctttaagcacataaacaaagatttggtgaaaagagagaaaatatttatcaatgggaaactcatgcttgaatagataagacttctccctcaaataatttataccttcgagtagttctaatccagattcccactctcaatataactatgcctgggtaaattagcacttttcatcttctcttcccagaaattatacaaaagcaaaagcaacaatactcccacgaactccattttcagtaaaactaaaaatatatgtaattcatgaaccagtaaatatttgtaaggactgcaaaaagcagctgagattgggcagatgcaatgtgggaggaagtgaagcatgcaccgtgggagaggaaccattaggggatctcagaaggcaggggcaaaaatatacttctgagggtaaattaagcaatatccagaattaaaaataatcatattttatgatgtagctgctagactctagcatttctacttctaagaatcctagagaagctcacatatggtacaatgagaccagtacaaggatgtttgttgcaacattatgtatgatcaaaaaattaaaagcaatctaaatgtcatttgagaagatagatagcttaaattgtaataaagccttacagtggaagaaggaaactagatctgtatatatcagtacagctaggcttccaaaacaaagatgagtaaaaaaagcaagctgcagaatgaatagctatagtacaataccatgtatgtaaatattaaataaacatcagtactgtgtcttgcttctatagaattcatttttggttcatatttgcttttactagacaggaagtatagtatagtgcacaaaaatacgaggttcagactgccatgtgcaagttacttagccttttagcccttcagtatctttatttgtaaaacaggcgtaattatgtttatgtgatagggatttgttgaagattaaatgcattagaaaagtgcttggcataataaaagtgcttaaatagccaggcatgatggcttatgcctgtaatcccaacactttgggaggctgaagctagcagatcacctgaggtcaggagtttgagatcaccctggccaacatggtgaaaccctgtctctactaaaaatacaaaaaaaaatgagccaggcgtggtggcaggtgcctgtaagtaatcccagctactagggaggctaagacaggagaatcactcgaacctgggaggcagaggttgcagggagccgagatcgtgccattgcactccagcctgggtgacaagagcaagacttcatctcaaaaaaaaaaaaaaaagtgcttggcataataaaaatgcttaagtaatgttaggttttattattattataattcatagacacataaatttgtatataaaatgttaagattgaatagaaaaccacaaattcctttttgtgtttacttggggaaatgggagaagggaatggggctcaatgtggtagttaaaaggtacatcggctttatttataaggtttcaattttttattaaaaaatgtgaagtatatatgacaaaatgtgtacagttgttaagtctgcatatttatggtatgattttcatagttattttttaaattactaaagaaaatgccacgcaagacccaccaaataatatgtagatacatatatatacatatatacacatacatatatgtggtattttgtatacagatttatttacttctttatacatctataaaagtaaaaagatgagctggtggtattactcctcaccaaatgcatcattgtgactgcctctgggaaggtgatcagaatgaggaagcagagtacagaactttagccttctctataataccctaattttattttattttatttttatttatttagtttttgagatggagtctcactctgtcacccaggctggagtgcagtggagtgatcttggctcactgcaacctccgcctctggggttcaagtgattcttctgcctcagcctcccaagtagctgggactacaggcgcccaccaccacgcctggctaacaataccctaatattaaaaacaagagatagtgaattcatatattacttatttgctttttaaaagcataaacattgcaaaagatctgaaataagacacaaatcttaggcatgccctactgtacgtggtagaaatatgacctattacttatttccttagatttttctgtataattatatttttaaatgaaaataaaacaaaggttggcttattgtggttcagtgatcaaacaggaaacttgttccagcctccctttcctttacctgcttttgcaaggccacatttagaggtgctaggcacctaagtgtgctggcatcctcaaaacttgatccagggaggcatacgttggcttaggtctcagccagtgtctcggagctggtcaggagacatatccagtggccacatcctcctgcctgacctacaggtattgtgtctttgaatgcttaaagttgcaggtaagagatagccctaaattttacattcactatggggacaaaacccaaagatggtgaattctcagctagtgattagtgtcttcattttctgttattttttaaaaaagtatgtggccaagtggctcacacctgtaatcccaacactttgggaggctgaggcggaagaattgcttgaaaccaggagtttgagaccagcctgggcaacatggtgaaaccttgtctctacaaaaaaataaaaataaattagccaggtgtggtggcacatgccagtagtcccagctacttgggaggctgaggtggggggatcatttgtgcctgggaggtcaaggccacagtgagctgtaatcacatctctatactccagcctgggcaacagagtgagaccttgattcacaaaaaagaaaaaaaaaaagtatatatttttcacttttatcgaacaaattccttaccccatatttttcccacctcagggctctgaaaatgccttgtatttcagtatataaatttgtttattacagagcattccaaggtgtgattattcagtagtcacttaatattcttcaaatgcattccagcattctacatgcaactaaaatgtcttacggctcaattactagcaagaggcagtggggcacagataacacaagctgtgaggcacatctagaggctgttccctaatgtcatgttatgctgtcatggcccttgaatttggagaagaggaaaggaactgacagggagttaattatatactggggggtgcatgggtcagctcacttgttcctaagctgtgctgctttatcctgcaggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaagtaggttctctatcacccagacaactgttcctgcactggtgggaataatgttaatactttatatctgcaaagcattctcccaaatgtatgggttgaaaagcaatcctcaacctatagagataggaaattgggcatccggttctttcaggagcagtcacatgcttctgatgtggtccagaagctctgtataattttccctccaaaaacattaaaatgtagaatgccctctgtgtgtttgaagaagctcagcatggaacccaggtttgaacaactcctgaagggcatctctgattcttcttttcccttttctctttagtatctatcttaactgtcacagaatcccactaatttctgcaaagcacctttcaaactgtcccttcatgttcattcccagcgccactgtcccagtgcctgggctttcttcataccccttcaaacagccttggcactagtcctagctcttacccaccccccaccccgacccaagacactgggttcacagtcaggatgccttgcgtgctagctagagctgatggggcatttcctagttaaaagacaaattatggaattcttccattaagagatgagtatataacaatatacataaataacaatatgctgaggtacttgtggttgggttttcaattattttaactgatatattttcagtaatggagttgttgctgatatgtggaaatgataagagattatgagaaccaaaaaattataactctctagcaagaacaaaggaagggcgtttgctgagtttgtcctttgtgctaggctgtgctgacgcactttattgctctaagcaatgctaccaaggacccttacacacaagagagggacctagagagttagagtctcagcttggtgctaaatttggaatatgttaaattttttgcaacaccttcagattaagcctgaatctaggctttgtgatgttttgataaaagcttgcaatttagtaaaaaaatagtgtttgggcaaagtaggtgtcaaatacccaatcctgttggcagaaatttaaatttattattgtactttggaaagatatgtgtcttttcaaaaggcattaaaactgttaaaaatgtatctggccagagtgaaaacgtcatctgagaaagcaagtacatttgttaaactgagggcaattttaatacatgtattttgagtcccttttacatgctagactctgtgctgtgagttgggaaaatagggatgaataggaaactgctcttcctgacagagctccttatggtccactggggcagggggagcagggaaggtggacaaggaagggacaaaagatcttagttagatcaacccctctcaggctgtgtctatcaggtgatgtgctgttctgtacaaaaagtgcttggtggaacccaggtgaaagaacagttagttctatttaaagtgggcgatttgagaaagaaaactactaagaggaggtagcttctgagctgggttttgaagggtaggtaagaagccatcaggcagatagtagtatcagacaataatatcagaagctatcaggtagaccaatacttgagaagtgttggtctgagattttttgcaccgtctccttgcccatctgcctgccccttcctgccccagtgaactataaggagctctgtcaataatatcagattgatgatgataatgatgatgatgatgatgatgatgataatgatgatgattagtggactataaggagctctgtcaatatcagataagtgaatggtaaggagctctgtcaataataataatatgataatgatgatgacgagtggactataaggagttctgtcaatgatatcagatgaagaagaagatatctatagagcatggaacacttatagagggcttactatgtgccagatgatgttctaagcatgtagacctcaaagtgtggtccacagaccagcagcatcaacattaccttggaacttggtagcaatgaggtgatcaggccccatcccaggacctactgaatcaggggttgaggcccagcaatctgtgtcagaacctgccctccagattatgctgcactcttaaatttgagactattgttagagcacttcgtgtatacattaactcacgtaatgctcacagcaacttcatgaagagggtactattattatctccactttaccattgaagagattgaggtcagtggtgacatggaaaattgaacctagcatttctgactctaaagagaaaggtgactggggtgtgtggcttagttttaaaaatgcctacctctccatactcatttgtcactacactctcgcccctctcaagtgcattcactctgagaaaccctgccagtgtgacatcttgctgtccctccagtccttttgagttgaacattcagcttcccctgctgaggccctgcttttcctttgtcaatgtagcaaatcccaaccctgagttaacagctcctctaaggaaggcttccccacctgttccctcttttccccctgccctatcctttcttcttccacgaagagttttcactcttctagcctggtatgtatctccttgtgcgggaaatgtcggttcttatgcctattccaccagaacagtgcttgttgagagaaggtgttttatcttgtacatcattgttcctgcctggcatatggtgggcacttaataaatatttgacaaatgaataagtgaataaattcaggtatgaatttctaagcaggagtaaaatgtatgttcaaatctctgttttaggaaggaaaaccttgacagctgggtggagcaaagattagaaggaggacagactagcagctaggagtccactttaggagtgatatgaccagacatgagccagggaatacaagaagcattgccgaggagagatccttagcagcgggaagaaggtgtaagagggtcagacttctgggggaacaaatgagtagggttttgttttgtttttttaattgtcaagtggtgactggagattcaaatagatggaaattctggttcagaaatatctaagctgggctggacatggtggctcacgcttgtaatcccagcactttgggaagccaaggtgggatcacttgaggccaggggttcgagaccagcctggccaatgtagtgaaactccatctctaccaaaactacaaaaattagccaggtgtggtggtgggtgcctgtagtcccagctactcgggaggctgacccatgaaaactgcttgaacccgggaggcagaggctgcagtgagcttagatcaggctactgcactccagcctgggcaacagagcgagactctgtctcaaaaaaaaaaaaagaaagaaaaaagaaatatctaagctggaggtacagataacagtcatctgtgcattgttggatgcacatgagcaaggtagcccaaggagaacaagttgaaggtaggaggaaaggaaacaaacatttgttgagtacctattatatgccaggaactggcattttcacctcactccttaggatagcatgccagaaccgcatttcctcttcactccccctattatgtaaccctccaggaataccactcaacctggcactgtgcacaaacctcttactgttcctttaggcccacctgcctagagagcccttcttttaccccatctgcctggcataatcttcttcatccttgagaactacacccatatatattcctattatatagagagtctctattgagttgcctcccccacgccctcaattcatctgtcatacttttgccagagtggtcttttggcaatacatgaatatgatagcagcccacagagaagagcctgtctgtggcagctgttcccttgccctctgtttgagatgccatatgcttctttatgttttgtaatttacttgaagactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaagtaatggtgtagtatgaacaatgaagacggtggaaaagtgggctttgctttggatctttgaccaaacctgacttaactatgatataattctgttttggtcctgggaatcacataggtaagggctaagagatgagttatttcttaaaggtagaagaatggaggaaattcccttactaagaaaatcaagtgatggtgtcctaacaggtagtcgagttactgagatagtgtgtgtgtgtgtgtgtgtgtgtgtgtgtgtgtgtgtgtgtgtgtgtggtgggataagtgttgggttccccatattcatggtccacagccctggataaagagccctgtttcttaccctttcttcattttgcccttaaaggagacattttagacatcctttttcctaatcaccttgctacaagaaattttaataccgcagatataacatatatatgtttatgtactatatgtatatgtattctgtactttatacatgaaaagaggaagtatatggtttattatttttattcactgcaagattaataatgactgaattaaagattcaagttaaatttatatttgaaaaatttaaggccgagagaggtagctcacacctgtaatcccagcactttgggaggctgaggtgggaggattgcttaaggctagaagttcaagaccagcctgagcagcatagtgagaccacgtctctacaaattttttttaaaaacagcctgatgtaatggtacacatctgtagtcatagctacttggaggctgaggtgggaggatggcttgagcccaggagctcaaggctacagtgagttgtgatagcaccactgcactccagcctgggtgacagagaccttgtctcaaaataaataaataaatagtatcaattacatgtgcagactatttatatatgtactcattcacaatataatcacattttaaaaaatcattcaaaacttatttttccaacaaaaacaaaacaatcacaaaaacaaattattgcttaaaattatgtttagtgaacttaaatttaaaatttttctttttgagaaaagagcacttaactgctagatatttatttagatacaatcaacatttgtttcagtacttggcataactaatgatagatctgactaatttttgtaggtgaataataacatttaaatcatttttacttaattctaaaacccaagtcacacccagaagtgctgagaatcaaacataaacaatatccccaagacagcagtggcacacaggccccctcttgcagcatgacgtcacgatcttgtataagatttttacccccattgaaaacgcacaatgcagagccgccaaaaggtcttgggtctgtgatgggatttgagagaaaaggagcacaggaggtggcgagcatgactctttagatgagtatactcctgatgtgcacagttgagcctttccctctgactgccaaacagttcagaaagctgtaagctgagacagtctttggtttattttggtgttaaccaagatgaacctgtagtctttgcttttgattatccttgtaggggagaataattccctagttccccactgaacatgtattttccagttgctttgagtttcattcatttaacaaacttttactgaatacctcttcttggcctggagcttgaaatgcagttataaaagatttttgacgagtaccgattgaggacactagctgattctgcttctgtcactcctgcctgtctcatgacaatctgggccacacagatggcagatctctgtttttaatgttacattctggctgtcgtgagtcatcaggaaattcattcatttcaatagcttctctgtgaataacactagcattggcttactcttctgcatttgtaattcagaacaatattttagagatagtcatggaggtatgttttatttcagcaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggtaagcaatttacataattagaaatccagtataagaaggttgtctcagaaatatgattaaatatataaaatgtagaaatttagattaaaagctaagcaataaaaatatttgcaataaacactgatgatacaaaccaataaaaactactaagacccaaataaataaatggacacactatagaacagttcagcaaggaccaaattcaattagctagtaaatgttaaaaaaatgtttaatgtcactaataatcaaagttatttaacaatgaaattgagaaaagttttattccaggtttatgaagccaacaagaaatatgtataatgaaatcaaccttttataaagaaatgtcaaaaaactagtgggcaagaggatggagaaccaggtgataagttcacggagaggactatacctcttatgaagttcaaaagaggcttatttagttatttaatttcactgacaaattgaagtatcacatggccaagatcatgagttgctggttacactgctgaacttgtagctctggctggccatctccagagcaaaatgtaataaattggtgaacgtctactttagaagggtggcaccacatatcatagaatcattaattttctgttgattattattgtggaattgctacttttttgtagggcaatattttcactttagaatgcatttctcattgtacagtctaagtcactgacaacatgagttaattatatggaaatgtgctattacatttcagggacacttcattctattatatgagatacaccctctcaacaattctaatgaaactgcttggcaaacagctacaaaagttaacaatataccttaaaaataataaacgtaagcactggatactaaaaacatgtgcttccttcccataggattagtggaacttgagtcatgtctcccagattttgtgacacaaccccaaatcagagctccaaaacctaaagtcattaccaccaaagctggttttctgaagagggcagcaaggttggactatgagttggcagaggttcataaggtataatcattatctggaggacaaaatgcttctagtatgatttttgcagataaatgctacactccaaaaattgcagcaatgtccagtgggtcaaacatagacctacattctctgctctgcacttttctgaggttgcccatgctgtgctgaaccaatgtgtatttcccctcatttcacatttcaggagacttcttggagatttttttccccatttgcagaggtcatattactttctgaaagcgttttccacttggatctctatataaaatttgacgctatactaaggtgtagcaagtttctattgttggtgttaatagctataataggcccgattttctcccttttgtgttcatgtgatcagggcatatgaagaaaaagagtcatgttcaacacctttctcatgtagttaaagctctaaaggctctagttaaagccttcaccaagactcacagtacgtcatccaccagctgggctttcccttttggtagctggactataggtgtatagaatctgtggtttatgctggtggttctcattctttcctgtgcatcagaatctcatggaggacttgttaagacacatgcagctgggctccatccccaaagtttccgattcagtaggtctgaggtggggctggagcatttgccttttttataagtttcccggtgatgctgctgctgctggtccaggaaccacacctcgaggcccactgttttataatacactctcatcactggcccatgcatgcttgtttgttcagttgattttagtagttaataaaaattgatgggaacctatcctcaaaacaggaccttaacagtaatttatgtatatcgaggtggttctttcccacctcatccccacgcccccatctcctttcacccatcctgaatgctgtgttcatcattctgtcactttctgttaagatttttttatagattctttttattaggttacggaagttctcttcttaatttactaaagcctttaatcatgtgtttatgttgaattttatcaaatgtttatcacacaatttttgtatattttttaattattgtagtaacatttataattgtttataaatattaatctatccttgcatacctgggatgaacctgccttggtcagagcatacagcttattttcaataccttgttggatttgatttactcatatgttgattaggattttgcttctacattcatgagtgaaatgaccttcttgtttttctttctcattttgactatgtatggggttggtgttataattacgcaggtctcctgaagtgaacttgagaatattccttcctttttctttttttgagaagagtttaaataagattgggatgatttgttccttcactttggtagaatatgcatataaaattatctgggacaaatgttttcttcataggaaaaattttaaccactactgcaatttctttacaacttatagaactcttctgcattatttttggtaaatttttttttataaattccatttcacctaccttttccatttttttggcatatgattgttgatagtattgttttataatcttttaaatgtttgttttatcttattcatgtctactcttttcacttacaatattgtttatttatgccttaactcttttccttaatcaagtttactgaaggcttgcttattttcttagtatttatgtttccaaacaatgaacttttgattttgttgattttctgtgttatatttttaatcacattaatttatactcctatatttattctatatttctttctacttttttagggtttgtttcacaggtcttaccttaaattgcacatgtagctcatcagtttcaggcattcatctgttttatataagtattttaggttaaacatttccttcaaaatactgacttttggtacatttcattagttttgatatgtagtatttgtcattcttaatttctaatatcaaaaaacccattatgattttttaatctgtgagtatttaatagtgtgttttaaaatttccaaatatgcaggaattttaactcattttctcattaacctctaactcaattgcattgtgatcagaggtcatagtctgtgtgatacctatcctttgaaatttcatgaggcttgctttgtggaccagtatatgattatacatgtaaaataataaaagtacatcttcaaatcacactgtgccacttgatgggtagagcaggcaccttagagcagattattcccaactccttcttcccttccctgtgatattcctgtcattcatttcactcgtccaagtgctatatataatcagccaatacttttttacttttattgctttagttaacagttatcttttagattaaaaataagaacaacaatatattttatttattccttctcttctgctcttcttatacttatatcgatctaagtttttgatctataacatttttctcctgcctgaagaacttttttttttttataatttcttgcagggaatgtctgctggccatgaattccttcagtttttgtttgcccctttattttggggagcggggggaatgtaattcgcacacaataaaatcaccctttaaaaatatataattcagtagtttttagcatatttacaaatctgtgcaaccatcaccactatctaattccagaatatttttgtcatccccaaaacaaaccccatgcctaatagtgctcacttccaattcccccttcccctcagcccctggcaaccactattctactttctttctattgtttttttttttttttttttttgagttggaatctcactctgtttgtcaggctggagggcagtggtgcgatctccgctcactgcaagctctgcctcccaggttgacgccattctcctgcctcagcctcctgagtagctgggactacaggcgcccaccaccacgcctggctaatttttttttttgtatttttagtagagacggggtttcaccgtgttagccaggatggtcttgatctcctgacctcgtgatccaccctcctcggcctcccaaagtgctgggatcgcaggcgtgagccaccgcgcccggcctattctactttctttttatggatttgcctattctggacatttcatatacatggagtcatgcagtatatggccttttgcgtctggcttctttcacttagcatagtatttttaaggttcatccaggttttaacacatctcagtacttcattctttttttatgattgtgtaacattccattgtgtggatataccacattttatttatctactcatcatttgatgaatacaccaagaatataaccatgtctagtcagtggttaacttttttttttgttttttgagatgaagttttgctcttgttgcccaggctggagtgcaatggtgcaatctcagctcactgcaatttctgcctcccaggttcaggtgattctcctgcctcagcctcccgagtagctgggattacaggcatgcaccaccatgcccggctaattttgtatttttagtagagatggggtttctctatgttggtcatcaggctggtcggttaatatatttttaggaatatcatagcacgtcttgagagatacacacattcttgttagtgtttctcaagctgacctagcatcaccatagagaatattaatattctgattaatatttatatctgtgacctagatctggtaatgaaggaaaatatagggtacaatatacattattcaggtgatgggtatgctaaaagcctagatttcaccattatgtaatacattcatgtaaaaaactgcacttttacctcttaaatttatgcaaatttttgttaaaaaaagagattatattaattggcattatttcaggcactgttggataagaagaataaagttcttgaagtaaagaaaccccctcgcttccttcaaagaaacccaatacctcaacctcggcttccaactccaaccttggaaatgacgtccaatgtaagttggaaactttttagttgaaatgctaaattcaatatcattgtcagcttattcttaggatagtttagcttaaagcaaatctaatttagcagtgttagtttcccaagctctgacttaaatattgtctttattcttatgtatcaaacatcagacacagaaaaacaaacgagatgaaatgaaatctaaacccagtccttctcaaaaataaaaacacaatttaaaaaatctttccatgaaaaatcagcatcagaaggtagtgctcatgtatatgaaatagaaaaagaagattgagtgatgatcagctaccatagctatcttcccacatggagagatggctgatgactgttggagtcgaagaggaatgaaatgccagaggtgtcatcaagacggacttgcttctggggtgggaatgactcaaagagccctgcccagggccacatctcaccagactcaatttgagcaaagtatcagagttggttaggatttagagggctgactcagactaaacaaatccacaggaaactgttagagatgccatgatgcaaatttattactttacagagagaactataactgcctactggatcaggctgttcctcttggctggtcagcacattatctctcagtatgggacagtcctcacaagaagccagattgtattcagaaggctgatgtgtttcttggctgagggcaggtgttggtgggagaccatgctaacacctgttactacctctgatgagtggctcctgcagagggaccagaaagctcccaccagccagcggggatgtgctgctggataacattctcttttctagactttgtgcagggctttggttgacatattgtcttttttttttttttttttttttttttttttttttgagacagaatctcgttctgtcacccaggctgaagtgcagtggtgcaaccttggctcactgcaacctctgcctcctgggttcaagcgattctcctgcgtcagccttatgagtagctggaactacaggcatgtgtcaccacacccagctaatttttatagttttagtagagatggggtgttgccatgttggccaggcttgtctcaaactcttgacctcaggtgatccacctgccctggcctcccaaagtgctaggattacaggcatgagccactgtgcccagcctgacaacacatcgtctttcatgtgtgttaatgtcatcgattagactgctgttttctttttacattcaaaggaatcttaattcgatttccagaccctgctttttctgctttggacacagagtttttaagatgatttttatagatggctaaccttgtctcttatattctgattttatcagcatagctaaattcttgtgagaagtaccttactctgacatagactagctgtatttgtgtctactgatgatcaaacatgaaaaatcctattgcaaaatgatgttatatgcaatacttgttgctttaagaaatattttgctggaaaggaatatagggaaatgaaagtggtttcatttgtagggatagcatggcagggagtgaattttttgcttgtaatatgatttgttaatgatgaaaaataatgaattctaatgtaagtaacattaaaatactatatgttcaataagggcagggaccatcttttatttctctttaaatctttttggcatctagcacagtctgttttgcttgaaataagtcttcaaaagaatatttgatgcttggactactgcagttctcaagctgcttggttctccctttgttcttttaggaagaagaagaaatggaaatggctgtgatctaccttcaaaagttactccggggcagagtcgttcagaacatggtgtgtaggtccaaccgctggccctgcatttctcttttgagaataaattttttagaatgcatatgtgcttggttccttggagtgaatcccttttgcaccctgctatcctattcagctaaactcttgagttgcctacccatttccttctggtgacccatttccttctaatggcatcatttgtccaggtgggtggcacagtgtcaaggagagagacagggaggacctacctgctatttgccatggttgtaactaaggcagtatgaaactcacttcttccttggaattgttaaatccatacattttctcacctgaattttggctatttaagcattatcaaccaggtggattccctaattttccacagtcataatacaattatttgagtttgcatatgtctggcaatccctacattataaatgaaagagctaaataataaattatggttttgaacctttactatatgcccacactatttattctttgctctacatatgttgtctcatttttttttcctatccataatctcattttacaggcaagtaatctgagtctgagggagatttagttatctgccagcaaattcagctctggtcttcccgagtgtaaagccttagccagattatttgtgttgctggagcaggcacacttcacttaaaaaatggactgatataaagccccagttaattttttttcccagatagctataactcataagagattcagatatgatgagtaaatcatctggatgaacaacttgtgtttagcactgttctttactcttctttcagtattttcccaagagaaatgccacagttaaattcagacaacagattattacaaaccagggacagatttattggaaaaaaacatatggccatgaaaaatgccatcctcaggtttattagggaaggagcacaggaaatgaggggaaggttctggtttcttcagatgaccctggagttgtcatcttgtccttgagaggcattctcagaaattaagcacagctcactgaaaactaagcccattttctgcctgagaagctgaaggcacagaaaagagggctgagctctagctctgtgggacacatctgctctgtggaacccaaaaggcaggacagaacccactgttcacaagtgtctcacaagtcactgcgtgtgactcctagtgcttggcacaaagggatggtaacttgcaggtctgtctttgatttgatttgatacagatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggttttcctttttttgttttcttgttactttcttgttaaattttctcccttgattttatcatcacacagcaccattataataaaaattaatgaaatgatgaaaaagaaacagccccacaatcccatcactctgtcagcatttgtgtgtgtgtgtgtgtgtgtgtgtgtgtgtgtgtgtgtgatggagtttcactctatcgcccaggctgaagtgcagtgatgcagtcgtggctcactgcaacctctgcctcacgggttcaaatgattctcctgcttcagtctcccaagctgggactacaggcatgcaccaccatgcttggctaatttccgtattcttagtagagatggggtttcgccatattggccaggctggtctcgaactcctgacctcaggtgatccgcctgcctcagcttcccaaagttctggaattcttaaataatgctgctgtagtccttaatttgattggggatgtgcccttactgatttgaatatggtgctattttttctttatttgcaaaacaataacaacaaaacaagaagaatgcattcttttcaactttaagatttttttccttccatttttttccccaaatatccagtgactattgtatttcagttagtgagggctttgtagactgaataaataacaaaagcaacatgaaaaaagtgagaaataagatttatcttaaaatattagcatttattttggagttttagagctgtcatagctcatgctggttaaactgcatattaaatgtgttactgtttcatgatatgtggtgactttcgtcatgacctcccagctgtgtgccgcctgacacagctaagaattacagctccaaaccaacaactgtaaatatttttcctattttcttccaatgtttgtctatatatgtatacacacttttaaatgttattgacatagtatagctatgctttattttactccctctcccacttttctgtaagtcaatctgaaaaagaatcaatttgcacagaatttagtgttatagggaagtaatacttaaagttaatatgaccccccctttagcaacatacataactcttgtgttatgtgggagtcgggcacaaatggtaagcagcctggaaatgaccacaactttgtttctttcacatgacagcagcaccatggatgtttgctgagcttggggaacttttggggggtgaggcagaatggggaggaagcaagccacaggctgtgagatccaacagaggaaccagagaaggaagaggagaatgtcaacactggagtccctgaatctagaagtcctagagtcctggaaaagctcagataaggagcagaatgccctggaagcgctaggccctgagactgtggatgaaaaaatgccctccttggccctttcagtttctgatcatgactttagtgggtatagctaagctaacccaggcttttcagctcatttattccatttagtggatatacatgtgagtgaaatcgtgtccgcctacagctaagggaggagttaatgggcaaagctgtcacttagccaaggactcactctgcttaccttcagctgtacttggatacaccctggatatatgcagggatctgagggagtgagcacctcatgtatagatgcagcaatgctggtctgcccccttcccccttctcttatatttctgtggaaaacagtccagaaaatgcacaacccccaattacgtaacacagtactttctgtgactacagtggagtcccctccctaaacatttcccttaatttcaaattagatggtactgcctgtgcctacccagatttcttgctgagagaagaggctaaacatgaacaggatttctagccacctcaggattttcaaggttgcacctgaccctgagtgagggagcttatgctccctggagacaaggagagaatctatttgtgatctctgggctgagtatctactgtttatgaatggaaggagtagtgagatgctcttagctttgccctttttttccatctctccctattatataagtaaagttgaactttgtggttagaaagtgtgtgtgggctaggaggcaggtgaggatgaagatgggtggtgttggggccaacaaccacacttgactgatgcttttacccatagccccatggcctctgagaactgagtattccctcctttcatacagaaaccaggaaggaagctgagcatagagggagaactgtcactgagaaggtggcatgtgactggaagatgaacccttttcccttacaagcaaggataggagaggaaaggggatgaagttgcaaagtcatcttaaacacttttcttctccatatgtcaaagccaggacacagggattcataaataggcactgtagctgacttctggcagagagcacaatgggtccctaattttgcctcagtgattagatggacatttggtctgtttcctgtgctttttttttttttttttctgagatggagtctcactctgtcacccaggctggagtgcagtggcgccctctgcctcctgggcgcaggcaattctcctgcctcaggctcccgagtagctgggattacaggcacgcaccaccacgactggctaatttttgtatttttagtaaagacggggtttctccatattggccaggctggtctcgaactcctgacctcaggtgatccacccgcctcagcctcccaaagtgctgggattacaggcctgagccaccatgcccagccattcctgtgctatttcgaatattgttgttaatgacttcaaagttattaaaaaagtaaaaagtaccaaggttttctactttcacgttattcaagatcttaactcctaacttgtgtgaaaggaaagatattgaaaaattaactgatatcatgagtgaatttctaggagattcaatttgattaaactccaatattatctttaataaaaaacttgacatttcccttcatatctgagaagacacactttaccttgttgataaaattgaaagaaaaaaaacccattctccatggtcactaacagaaacgtcttgctaaatcctcttgcttatttgagggctgtggtccatcagtgactgaccagacaatcgactttctcgtgcctcagttttcctcataagaacttgggttggagccaattgagaggtaatattcccagtaaaaattaaatgcattctgaaagtgaattgactgccaagagttttgagtaatccagcacttcttctaataatcaccactcataatggaatttgtgtccttaaagttatgttattcttttcaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggcaagtaggggcagctgggtgtgtggaagctgcctagaaggagccaagtcaaaccaaaggaagctcatgacataaaatggcatttggcttttgtttatgcattgagttcctactgtatgccaggcactctacagaggcactgtgggaaactttggaggaaaaaacccagacacgatcccgtctctcctaaagcttaaataacacataatacgcacgtgtatagaattagaaactgtaatgagttccatgaaggaaacaaatagggcccagagacacattttaagccagttacttcacttgctgtgtggagcacaggctggagggaggacagagggggaacaaggcggccaggaaggagctgttgaagtagtgaaggccagagtgagagacaggaagtcgagtattacatccagtttcgggcttaagcagctggaagatgatggtattatttcgtgaggtaggaaagttgagagaggaataagcttaggggcaggggaggaatcaggaaatcagtttatatttcgtttgggacatctaagcagaggtattgtttcagtagatggatctacaagatggaatttagaaatgagggtttggccgaagatgtaaatttggaagttggtgaccagcttctagcctcctactaatctcaacacacttttcttcaaaaacagtgactgagatttagaaattattggcaaatcagaacttgccatcctttacctaatatcactaaggaagaaccagctggggatgagaataagaagaaatggaacagaggagctactatacacaaaagcagagaaaggaaaaagctggtaaaaaagcttcttaggaagataccttctaaatgggaatgatgtcagaaaacatcagctctgtctagcaagggcaagaaagggttaatatagcctttctagcctgatttaagaaccacttaggtaaaaaatgtactcagctatggacccacagattcaaatatcatccatatgttaattctcaaccttcctaattaaaatatagtgactattttccatcctacttccccagcctccattcagattctcttgaagagaaatatgcttgcacataaattataaaccagaaatgtaatatttaataaatttccaaaatatgcatctagatagtgagaaacacagatataaagtcatcgactcatctttaaatacatataaattttgcaggcacatacatgaggacatatttacaaatataatctggtgtgcacaacattagcaagacatagaggaacacacatagccacacttttccttattcacatacatacacgcacaaacgtctccagaaatttacacatttataaagatatacataaacacacaggtacatatacagctatggatggaccatagtaaactttccacctctctactattacgtgactgagctaattgatccatatagatccaacttgcttcctgaataagagggtgggctctatgagagcatgaatattgtatattccctttgtgccttgcacaacacagtgtagatccctgtaactaataggcattcagcagatatattttggttggttagttgtttggttgatactgtattaaactggccattgagactctcccatagagaaggcatagggattgaaggttgatgttttacacataggtgtacagtatcatatactcagaattgtgccaaagtgccaatccacaaacaggtactgaattgttactgagtcccaggcattatctcagatacaaagctatatttagacatgaaacagaaaaatgccctacctctaaaaagctgataatctgttgaggagacagcatacatatacaggcaaaactaagtatgccacagttgatgcttaatctttctatatacatacacctgtaaagcgggcaaaactaaactactttgtttatggttacatacctaggtagcaaaattatagagaaaagaaagtgtttactatgaaagtgggaaggtgctgtggtaaaggaagaaaccatggtggccttctgagatactggcagttactataatacatggcttctgactttaccctaattcattacactgtacatttatgtgctctgtactttttattttgttttatttttctaatctctgagtttgcttgcaatgcacttttaaaatctgtatcctatttcatgatttcaagtaaactttaaaaagaagcagtcaagggctggtatgatagttcaataaattcattagagacccaggatccttctagctttctgctcttctgctcctaggtcgtaggccttctggcaatttaagatgattgctggtattccagcattatgtcctcatgaaaggagaaatgaagagagaaaaaaggaagccaggtctttccctttaagaatcctttctttggtcagaacgtggtcatatgggcaatccagctcctgtgggtgctgggaaatgtagtctttattctaggcacctgtttccctagctaaaatccaggggttctattatgtaagaggaaggagagaaaggacactgcagaatacctcctagtctgtgctacagttagatagtttgaccaagtcacgttgctggtaagaacaaagccaggatttgaaccagcgttattgactctgaagcccataatccttcagcagtgctgtcttgcctgcctgcccaataagatccataattctgaaatgggctaaatgggtgtgggctgcccagagtgagtaggtaggtggatgagaaacagactgatgagatgctaaagaaaatgaatgattagtgaagggactgttgacttattaaatgaaatatatgagctagaaaaagttaaccaatgtttgtgtatttttcttgtgttgtttacaacagcatacctgttttagtgagggtattattgttttttgcaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccggtgtgtatcaagagaacagattgtagaatggacagcccatttgctggtactcatatatattttttcaagagcttacaatttcaccaccaagtagaaacaaataactcatacttcagcgtccattgttttattaacattaactcttgagaagccaatatgtgtatgcctccgtatgtattctcagttatcctctgcaatctggattactctcattacttactttaagaatactcggaagcatgaaaacaatgtgaatacgtgtgtgcaacattactgggacttcatcccaaggttgctggcttctatgtataagctgtgtttccaacattcccttcctggcaggcagggtaactgaaggacagggtcaaatccaaatttttttgtggagttaaacaaacttgccaggaatgtgatatttcagatcacttaatcaaggaaaaggtgatggtggggtttgaatggagttgcttacacagcaggaaagcataaatcagcagctcaagtgaaaaaaccaaagaaataattcaatttgttttatattttttagccgaacctatcttcagtcagaggagattgttgctgagttggtttatagttttctgatcccagaggtgcaaaaatactttgtcaaagaaaaaggtaagccaatgtaaatgctttactttaggattttttaaagatgtaaattattttcaatatcccagagatttaaaattaaacagagggatgaggaaatttctaaaggaggatcactgagttttcttatttcagagcttgtcaggttctcttcatgctgcctgattctagaatataatcaactctagtacagatgggttgtagttctaataagagtgacagtatcaaaatccaaaccttgtttaaaaggatgttcccaagttttcagaagagctgtatttttttatttatttttttaaaaagcataaaacagatattgagcatataaaagattttcacattgtagcagcctttcagaggcaggacacgtgaaccgtgaatgttaaaaaggaagggtgctagaaaggtctaagtctaccctgctgctctgcctgtaccccaaatagcttatttctgctggaactccatccaagtataaatatcctaatttatcatttgtcaccggtggcatgtttttaaagattgatgcttttagtcaatagagaaagagaaaatactatcttaaacagaaaaataagattcttccatagctctgaggctgctgatggcaggcttgatcctagacagaggggtgcaaccaggagaagaccagtatttaagtgaaatagcagctcagaagtattgaaaattataccggggaattccagatgggcttaagcagaaaaatgcttaacatttcaatttgctcaatcagggataaagaaatggtggagttctaacacatttggagaggacaaagaaatacctgatttttccattgcatggttgtagtgtaatttttaaaccagtaccccctaaggataagcatttagtttgtttccagtttgttttcctgttactaacagtgcttcaatcaatatattttacacatatcctgaccatgcttctgagagtacattcttaacagtgcaattgctgggatataaggtatatgtattttacattttgatagatagtaccaaatttccttacaaaaagattgttctaccaatttgatattaccaaattgccccacaaaatgattgttgacttgcatcaatagtgtatgatagtgcttatacaaaaaattaattttcagatcaagtaatatatttctgtgtcacattatgttataaaaggaccttatgttttctaggaccttaagaaaatatgcaactctgttccacttctcctgagttcaaagtgaggccagcctgcttcaaagccattacacccttggttgaattccaccctaggattgaaagagaggaggaaaactgggtttaatatttactagtttgtggccaggtgcagtggctgaagtctgtaatcccagcactttgggagtctggggcgggaagatcacttgaatccaggagttgagaccagcctgggtaacacagggagacccagttactacaaaaaatattttaaaattagctaggtgtggtggtatgcacctgtagtcccaactactcaggagactgaagtgggaggatcacttgagtgcaggaggtggaggctgcagtgagccgagattgtgccactgcattccagcctgaacacagaatgagaccctgtctaaaaaaaaaaagaaaatttactagtttgtgatcccctctcccatgttgggagtctgagttgaggatttggaggaagacttgagctaacggaatccagtggaacttatctatgggcaagttgaatgagtccttagcctcttccctttatatttttgccaaatcaaaaaagccatatgaacagggagcacactaggacctttttctctctgttcaaatgagaaccatatgtattatatatacactctttacccaaaattaagatgataatatatacagacgattttgaggtatatcactttttgaaaagccaatggatcagaaagaccttaaagatacctgtatatagatataaagtaatagtaactgccaaattttaaatgcatgctaagttccaagaagttcactgaacatttttaaatgtacactatctcaatttctttcaagagttgtaggtatattctcatttttcacttaatggaaattagctcttagagacatatgacttgcaaatttgaaccatggtctatgtgactccaaagcccccactttttcaaccatattactgtgaagtgctaaaaactgctgagtgaattaccctatctaaactacctgatacccaaacagcaaagaatccacagtacttcttgcggtcctttactagctatttgactttatgtaaattacctaatatctctgtgtccatgtttcttcttctgagaatgcggatattaaaatactatcttctaggaggattaaatgaataattacatgtgaactgcttaaaacagtacctggcacaaagtaaggacaaatgctaactgttaacatcatcatcatcactactcctttccaagggcttaggtgcttaccctgatagtgaatattcttagaatttggagctaggactatgttctaaagccatgagctcataaactcatcatcaatcagtaagtcccttccacattaagaactaaggctcaaagagaagtataagactaggtctttatatttgtaagttacttacactctagatatcaaacgaaatgtaactcacatgaagtgcttcaatgctgaataggttggtacaaactcaagtgcggtaagtggtaaatctgggctgatgtagtcagaggagacttcctggaggatcttggacatgagctttccaggttttagagtgcaggcattccagatgagggaaactgctgaggagtggaatggaggcaagcctggtggaaaggagtatgactgggctgaaccagagagtgggaacagagggagcagaaagaaattagatttgggttgggttttacctttaatttgcaaaattatttctatcatgactctcttgaaacatttgggaatggttttgttcagactttcagaatgaaaatttttctattactttggcacagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaaggtgagtttgattttccaccaggaaaaaaagcagagaaaggaagaaaagcggcattgttcagctttgtgctgtgctcaaacaatcataatgtgaagattgctgtttaagaaatggaggacttccacttaaattggcacatttcctctagtttatgttatctactgttgagattattagaaaattagagttgatattacagcaattagactcttgtgatacaaaaaagaggactctaaattatttttatgggttcttttagcatgtgtgtacctcgtcaaatgaagctatagaatgtgtcagtgttacatataaacaatcttgttcttatggaagtagacaaggtatgccctaatgcattgtgctagctgtaagcatggcatgagacacagagcctgcccaattctagctcagacaccttctgcagtgcccacaaggggttggtcttgggctcaactaaaggctgtcatactcatgagactaatacagaccatatttggcatgaatgtacttagaaaaatataagacaggaaacagcttccagcaaggcaacatcagacatttctcttcctgtaggagcccttgccatacccatgcagaacacatagctgttttctttagtccttagtttacggagtgcagatacaatacaaggaaaagaggttcacaccgggtgggtacaggagctgccctggcgtaaaacttcacaccccaggggctggaatctcttgtaataattccataggcatagcttccagggtccccaccatggatttgcccagctacaaaagtcaacatactcacagaaactcaaagctgtggttttctattaggtatacattcctcccagttcagatggaatttaccaatcaggggtcatttttaagtagttcaaattgcttagtaacacagttgacacatatcaccttatcaagttactaggagaatagagctagggagtcaactgaaagtaaaattctcatgagaaggggaatggagtgaactttttgcttatactttctccctcaacccttttgtggtagaggcacatctgctgctgttttgccctgaaggtataccaaccatcaggttggggagagtactggggctagggagaaattttagtttggcattcagaagttttgtatattgtccagctctgccaccaattgtataatcttacacaaataatttctctacttcagtccttggtccaatagaatggaatcttaagtctcaatcaaaaggaatcatggaaggagggttgagatgagagggaaggtaagaaatattgcagagagaaagctaataagtgactcttaaatatcaaactgtggctgtaaattacagcagaaaaacttttgactttaatagtaaaataacctctgaaataattgaaaatataaaacatctattacatgtaatgttatatattgtctataaaatgtaaattcaaggaccaaagcatttggctaccttattattgtgataaaagcaagccttaaggttggggtagtcatttttctgacatgcaaatttaataagattaataatttacacaatttgcattgaatgcatctgcctttacttctgattatggtacctactctatgacatccatagtgacctgtgaaatcaagccagaggagaaaaaaatcatcttctatttatacttagtgaaagtaaaatatatttcattaaagcctatgtaaagcatatatgataattataaaatctagttgcagaaaagtctagttgtcaggctaactacagacactcaacaaagatgaccaaccaataaattaaatggttggaacatgaagctaagctgtccccaaagtatatcctccctcttccttcttgcagagggaagcagagaatgacagatgtgagattattcaatgatgtctagggaaaggggcagtagtcatgggccactgatttaaaatacatatttaaaaatacatatttttaattagcttgaacagagagctaataaagtagtgaagaatttctgggccaagatctaggagaagatagaaatttagagggttgggtctggcatttggagctacttttttcctggaagaatatgacaattctagaaaatgtggctgaaaggctgaggagtatttttaaaagctttgcaaaacaagggggacaaaaaacttgagtcaaggttggggccctggtaaaccttcttcatttgggtagggactctaaaagtctatgccctagtggtaagggttaactggaagtaaactatccctggcatatgatatagtttagcttctaatcatctgagtgattttaaaaatctcaatcccagaaattgaacttaacgagatccttggtttctattgcttcaaggaacctgccagaaataaaatgtaaattctctttacagaaagttaacattattctagacctctattttcacaatttctagaacacaatcaagaatattcaggtacgtgaggagacatgacagtctgaacaagtggcaaaacaatagatgatagaaacagacctaaaaggatctaaaatattggaatcgttagacccagactttattttttccataagttattggggtataggtggtatttggttgcatgagtaagttctttagtggtgatttgtgagattttggtacacccatcaccagagcagtatacactgcaccatatttatagtcttttatccctcatccccttcccactcttccccccaagtccgcacagtccattgtatcattcttatgcctttgtgattagacacagtctttaaaataactatgttgactactgtggacttctatcctccagaactatgggaaaatacatttctgttgtttaagccatctagtctatggtgtttggttatggcagccccagctgactaagccagattttggtaccaggagttgggtactactgtaacaaatacctaaacatgtgggagtggccttgccactggttatgggtagaagctggaagagttttgaggtacatactatatatatggacattgagggtgattctggtgagttgtcaggtggaaatatggaatatgttattagaaactagaggaaaggtgacccttattataaaatggcaaagaccttgactgaactgtgttctagtgttttatggaaggaagaacttgcaagcaatgaaattggatatttagctgaggatatttctaagcaaagtgttaaaggagcaacttggttcctcctgactgcttatcataaaatgtgaatggcaagagatgaattgaagaaggaaatgttaagcaaaaagaaatcagaatgtgaagatttggaaaattcttagcctatttatattggaaaaaacgagaaagctctttccaatgtgaatgctaagggtgggttaacagacatttgataagtgtatgggatcatatgagcagaaacattgcaggatgaagttaaggaagcctattgattggacttcttgaattagacaggatgggatgatagaactattcagctgcaaacatgcactattcttcaagaagaaggaaaaatgattccacaggagatccagagatcatcagggccattgtcccagtttcaacagccaggtggctttcaccatgagctttggaagaaggaccacccagtggaccccagctcagcagagctatggggtgggaccctgggtcagcagagctacagggacaggacacttacctagagccatggggatggggcattgtagagtcaaaggggcagagccatgggaatgatgttgccaccccagtgggcttagaaagcaagacactaagccaaagaagactatactcaagaattaagatccagtggaatttgccttgccaggtcgtggacttgcttaggatccatcacccatttttttcttctgatttttcccttttggaaggaaatatgtctcctatgcctctcccaccatagcattttggaagcacatagtgtggctggtttcacaggctcatagctggagaataattttgcctcaggacaagtcatatcttgagtctcacccgtacttcatttggataatatttatgagactttgaactttagactttagagttgacatgggaatgagttaagatttttggtattgttggtatagaatgaatgtactttgcatgcaagaagaacatgaattctacctggggtagaatgcttgtggattgaaatgtgtccttgaaaatgcgtatgttgaagctataacccccaatgtggtatttggagacaggaccttagggagagaattaggtttagagaaggtaatgagggaagaaccctcatgatggggttattgcttttatgagaagagacatcacagtgcttctcctctccttcttccactccccctctgccattctccctctctctctcttcctttctccctctcttcctccatcttcaatgtgaagacacagtaagaaggtggccatctagatgacaggaagagaactctcaaccaaaactaaccatgctgtcaccttgatcttggacttgtagcctctagaactgtgagaaaagaaatttctgctgtaagctatccaatctatggtattttgttatgacagcctgagctaagacacttactctgttcacagggtaaatgccaatattgaaaatttcaagagaactggacataataaaaatgatatagcagatttgaagaaaatagaaattccagaatttaaaaatacagtagcaaaagtgagaaactcagtgaatctctcctgagagatatttagaaagaagcacagaaagacaaaaggatagaaattacagaagagagagaaggatagatttagaatagcttaatgatttagaaaaggagaaagagtgagtaggcatggaccactgattgaagaaatttcactactaaaggaaggaataatatgttgggagatcatatggaatacgaattttccaaaaacgataaaagacttgttttcaagaagacttcttaaccctaagcagaataaataaaaagaaaacgatacctagatacaccttagaatactaatactgctgaaagccaaaaagaaaaagaaaaacctttaaaagcattcagagaaaaacgataaattaccttcataagagcaataattaagctgacagttgacttctcatcagaaacaatgaaagccaaaaagatggaatgatatgttcaatatattgaaatagtaaaataaagtaggattctaggcaaacatattcttcatgcaaacatattcttcaagaatggcaacgaaagacattttcagacaaatgaaactaataaaatttgtcactaggagatctgcaacacaagaaattattaaagggtactttttaagcagaagaaaaattatcccagttggaaggttggaaataaatttaaggacaggtatgtggattggcttattgactgcataaaaaaattataagaaacagcaataataggagcaatgcagttataaaacaaaagagtaatatataagtcagaagagggctaaatggattaaatttttctaaggcacttgcattgtttaggaggaggataaaagtataagttgacattgataactcaatgatccatgacaactcaaggatacattttgtaacctctagggtaactctgaaaggataataaagagatatatgacatctaagctaacagaagaaaatgggactaaattttcaaaacactcaatacaaaaagtggatagaaaggagaaaaaaggaaacagaaccaatagaaagcactgaataaaatggtagatgcaaaccaaattttatcactgactacattaaatgtaaatagacaaaatattccaagtaaagtcagaatttaccagactgaataaaaatcatactaaattatatgctgcttgcaggaagcctatataaaatctaaatatacaaatggttgtaagttaaaagattgaaaaagataccataaaaacaccacccatagaaaagcagatatagcaatattcatatcaaagaaaactttaaggcagaaagtattagagaaaaagagggacatgccataaagataaaggtctaatttattgggaagatataatgtcacaatttaaatatacttaatagcacggcctccccctaaatgtagcaaaatttaacagaactgcctggagaaatagacaaatccacaataattctgggaaattttaatctttatcaggaactaacaagcaagtggagagaaaaaacatttaaaaatgaaatatttggctgggtgcagtggctcacgtctgtaatcccagcaatttgggaggccgaggcaggtggaccagttcagctcaggagttcgcaaccagcctggacaacatggtgaagccgtgtctctaccaaaaattaaaaaaaaattagccaggcatggtggtgtgtgcctgtagtcccagctattcgggaagctgaggcaggaggattgcttgagcccaggaggcagaggttgcagtgagctgagatcatgccactgcacaccagcctgagtgacagagcaagaccttgtctcaataataataaaaataaaattaaaatggaatattttagatacataatttttaaaaacttggcctaatggacatttatagaatattacgcccaacaactacagaatgcatattcttgccaagggcagagggacattaccaggggaaagagaaaccagaggagctgtgtgggctggcctgatggattggggtacagaggagcccccagagtaaggccaaattttcccatataatgttagctttaggttttcggtagatactgtttttctgcttgagaaatgtttgaatatctcttgttatttaatgagttatgtcagtaataaaattcactcagttccatggacttaaccattgacacttctataattttttgttttttatgggtttttatatatgtgtgtagtttgtttgtttggttggttggttggtttttggtcagaaagagatgctgaatattctgacttgcaccatcatactgacattcagtgattcagagtggtaaagtttcagtgtgacttttttccagctcagggccaagattgagatttttctaagtaagaacaccatcctcagctactgttacagaacactgaatggctttggaaattggctattgctgcagacttggtaatattttttaatgaatctatcctaatgttgcaaggcaagcaaaacttacatgcagagcttatgctatagtaaagtcccttcattggcaactaacattatttgaatcccaaataatgtatttcctatgctatgaaaagttaaaacaagaaggaagatctccattcctacatatatttgcattggatatattttctgagcctaaactacttttctagtagcatttttggaccttgaaacaagtgcaaaggaaatttcaaaattatttatctgcaatggaagcatgttcatcttaccttcaagtggaagtagttaatctgtattgtaatgacctgctaaaaagaaaatatcaagagaagaatctaatagaattctataaatgccttccaagcaataaatatggatatttatataaaagtatataattgtggatggataccagtattggccatactgttctgaatgaaaagacattttcaaagatgagatagggatgagatgagatagggaaaaatctcattttcaaagatgaaatgagaaagaggaaaatctaattacacatcactattaataaatgaacatttgcaatcaatttcaatgacttgaaccgaaattaagcaaaatgttattcccccaaataagaattccattcctttcattaagataactatattacagaaaactatagtcaattattagtagtgtattttgaattttataaaaaatgttgtgaaaatttgttttctcttttgttaaatgagtatccttgattttgtcatttggctcacaaaacctaaaatatttactattaagcccttttcagaaaaagtttatcattccttactctacagcaattacaataaagtagaactaaatataacacatggaagaatctcacaaatatgataagtaccataataagccaaatccaaaaataatccacagtatgaatttatttatataaagttcaaaaccaacagcattaaactatagtgtttaggaatgcatacttagaaagttaaggtgtaacaaaatgcaagaaagtgactactgtaaaaataaaataaaaatcagaatagtgattacctttaggaggtaaagagaggattgtgattgggaaggggtaaatgggagcttatggaatactatttcctgacctgtgtgatatttacacagatgagtactgtacattaatttattaggctgcacattgcttttaggtactttcctatatgtgtcatattctacagttgaaagtaatacaaaaacatatgaaagtataaaactcattggtaaaagtaagtacacggtcaaattcagaatattctaatactgtaatgatggtgtgtaaatcactttttagtatgaaggttaaaagacaaaactattaaaaataatatctacaataatttgttaagggatacacagcataaaaagatgtaaattatgaaattgaaaacacacgtgttgaggagggtggataaaaagtgtagagttcttgcatgcaatcaaatttaagttgttgccagtttaaaatagcctattgtaactataaggtgttttatatattcctcatggtaagtacaaaacaaaaaacctatattaaatacacaaaaggtgaagagtaagaaatcaaggcatggcgctagagaaagtcacctaattacaaaggaatacagcaagagaggaagaaaggaataaggacctacaaaacaaccataaaacaatgaaccagatgatagtagtaagtctttatcaataattaccttgaatgtaattagattaaattctccaattcaaagacatagagtggctgagtggataaaaacaaacaaatgagacctaactatgtccagcctacaagagtctcacttcacagtttaaggactcacatagactgaaagtgaaaggatgaaaaaagatactcaatgcaaatggaaaccaaaatagaacaagtgtagctaaacttacatcagataaaataggttttaagtaaaaaactataaaatgagaccaaaaaggtcattgtgtggtgataaaggggtcgattcatcaagaggctttaacaattataaatatatgtgcactcaacattggagcccctaaatatataaaacaaatattaatagatatggagggagagctagactgtaatacagtaatagtggggacctccagtatcccactttcagcaatgaacagaacatctagacaaaaaatcaatagagaaacatcagacttacactacaccttagaccaaatggacctaacagacatatatagaatattccatccagcagcagcagaatacacattcttctcaaatacacacagaacattctccaagactgatgactgataataagcctaacaaacttaagaagattgaaattatagccagtattttttccaaccactgtggtatataaaatagaaatcagtaacaggagggatttcagaaaattcagaattacatggaaattaaacaacatggtcctgaacaacaagaagtcaaagaagaaatgaaaagggaaattaaaaaaaaaaccttgaggcaaatgaaaatggaaacacaagacatagttatgggatgcaacaaaagcagttctaagagggaaatttatagcaatatgtgcttgcatcgaaaaagaagaaagatctcaagtaaacaacgtaatattacacctcaaagaactaaaaaaagaacaacaaatgaaacccaaaattagtagaaggaaagaaataataaagattagaccagaaataagtgaaatagaaactagaaaaataatagaaaagatcaacaaaactaaaattcggtattttgaaaagataaaattgacaaacctttaactagactacttaaggccaaagagggaagacttaaggaaaatcagaagtgaaagaggagacattacaactgataccacagaaatgcaaaagataagactactataaacaattatataccaacaatttggacaatctagaagaaatggatgtctagacacatgcaacctatcaagattgaaccatgaagaaaatagaaaatcagaatagaccaataataagtaagaagattgaatcagtaatgaaaagactctcatcaaagaaaatcccaggcaggacccaatggcttcactgctgaatcctaccaaatgtttaaatttcagtcttccaaaaaaattgaagaggagggaatacttccaaactcattttacaaggttagcattactcttgtttcaaaactagacaaggatactacaagaaagaaaaattacaggccaatatccctgattaacgtggatgcaaaaattctcaaaaaaagtaacaaactaaattcaacaaattaaaaggatctttcactatgatcaagtgggattcatcctacagatgcaagaatggctcaacatacacaaatctataaatgtgatataccatattaacagaataaaggacaaaaatcacatgatcttatcaatagattcagaaaaaaaatttgacaaattcaatattctttcatgacaaaaaaaactcttaacagattcattatagaacaaatgtacctcaacatagtaaagtccatatatgacaaacccacaactaacatcattctcaacagtaaaaagttgaagccttttcttctatgatcagaaacagacaaggatgctccactcttgctacttctattcaacatagtactggaagtctcagccagcacagttgggcaagagaaagaaataaaaggcacccaaattggaaaggaagaagttaaattgtttttctttgcaggtgacatggtcttatatatagaaaaccctaaagactccaacaaaaaaactaatagaaatgataaagtaattaatttacgggtacaaaatcaacatacaaaaatcagtagcatttctatacattaacaacaaactatacaaaaaagaaatcaagaaaacaatcccatttataatagctacaaggaaaaaaataaaatacttacttaggagtaaattgaatcaaggagacctgtacattgaaaactatcaaacattgatgaaagaaattaaagaagacacaattaaatgaaaagatatcctgtgttcatggattggaagaattaatattgtttaaacatccatgctacttaaagcaatctacagattcaatgcaatctctatcaaaattccaatgacatttttcacagaaatagaaaaggcaatcctaaaattcatatggaaccatgaaagaccccaaatagctaaaacaatcttgaagcaaaaagaacaaagccatcacactacctgacttaaaaatctactgcaaagctatgctaatcaaaacagcatggtactacacacacagaccaatggaatgtaatagagagcccagaaatgcacccacagatttgtggtcaattgatttttgacagaggtgccaagaacacacaatgggaaaaggacagtcttttcaataaatgatgctgagaaaactggatatctacatacagaagaatgaaattagaaccttttctccacaccatattcaaaacccaactcaaaatggattaaatacttaagcataagtcctgatactgtaaaactgcgagaagaaaacataagggaaaagctcctaacattggtctggatggtgatcttttggatatgactcaaaagcacaggcaacaaaagtgaaaatagacaaaagagattacatctaactaaaaagtttcagcacagcaaaaaacaataaacagagtgaagagacaacctgctaagtgggagaaaatatgtacaaaccatacatctggtaagaggttaatattcaaaatatgtgaggaactcaaacaactcattagcaagaaaataaataacccaattaaaaaatgggcaaaggacctgaatagacatttctcaaaagaagacacatacaaatggccaacagatacatgaaaaaaatgcccaacattactaatcgttcgagaaatgcaaacaaaagccacaatgtgatatcacctcatactgttagaatggctattatcaaaaagacaaaaagtaagtgttgaggaggatgtgaagaaaagagaaccgttgcacattgttggtgggaatgtaaattagtacagccattgtggaaaacattatggaggtcctcaaaaaataaaaaatagaactaccatatgatccagcaattccacaactgggtgtatatccaaaggtaatgaaatcagtgtgtgaaagagatatctgcactcccatgttcactgcagcattaatcacaatagccaagatttgaaatcaacctaagtgtccaccaacagatgatggtatacacacaattgaatactattcagccttaaaaaaaaaaagaaggaaatcctgtcatttgcagcaacatgtctgaacctggagggcattatgctaggtgaaataagccaggcacagaaataccagcataatgccatgaaccaggtgtaatgcatccacacacatacacatatgctatcacttgcatgtagagtagaaaaaagttgaattcatagaagtaaagagtagaatgttggttgccagaagctagtgtggtagggagatgttggtcaaaggatacaaaatttctgttaggaagagtaagttcaagggatgcattgtaaaaccgtggtgactatatttaataacaatgtgttatattttgaaaatagcaaagagagattttaagcaccctttccacaaaaaatgaaaagtatatgaagtagtgcatatgttaattagcttgactgagccattctacaacgtgcacgtatttcaaaccatcatgctgtacctgacaaatatatataatctttctttgtcagtttaaagtaaataaatgaaatagtaaaggatgttggcagtaagtcaaagtaaaatggaaagagaatcagaaacggtatttatgacctccagtgtctacatatcaacttttcccaaacaattgttccatggataactgctcttcaggacattcataagcagggctgctcctggtatttgcaagacccaggtcaagaggatgaattgaagcatcatatcatatgaaaatatataaagttgtaaattaggctaacatactgttatataaaatttattctacccacctactttcacaaacatatctttgagatgataacattgaaaaacgggtaagcagctatgggctttatgtaattgaaagatggcaagaaccaaagatggtaagcttagttattattgtacatgtctgactattctgtttatggtccagtaatatttgggcaagtaatgaaataaaggcatacatggttttttaaaagttagaaatacatatgtatatatacaaacaaatacatatatatatatacattatgcctgcagtatacagagaatatttctggaaaggtcaataagaagttggtaggtagctgttgccaggcatggaaactggggactggagttcacaccaggggaaaagagatttacctttctcatgttgacattcttttgtatttttatttttttatgatgtatgtatacaacccagttaatgtacagatttttttaagtgctagaatttggaaactgacacactgtgaagtaagaaacatctggatccataaggcttataaatagcagagctgggatatgtgtggggctgtctgagttcaaagctagggctcagacacactgtatcacaggaattttttgcatgtattgatctgataatgtttctaaaagatgacataatcataaacatttgttttgctcttttttacagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagccaagtggtcatagtgactggagccatgtagtgaattggggctagactagtacgatcaatagcgatacaaaatcacaatgaactgtctgaggcagaaaactttttgtatggatgcgtaatcagatatagtgaatcattgtaaagagaggcagtgctttagcttgaggcaaggtaaaatccaaaaggaaagtgtgcagtgtgggtaaaggatctctttaggatgcgaaactgttagcacaaaattgttgggaattctaagttcctgaagtgcagaactcccagacaaattatgttagagcctgattgttagttcaggaggagcttccactgctaactcccatcctcctactcagttctaggccactggtacccacttgagggtagagttgtatttacaaatacttggagtgattttatgcaacaaactgcacagaggattatagactcagttaataggggagtggagaatgccagcaagcccctgagttagagtgaatggccttcaactgtgcttaccaattgtggaacaaaagccagctagaaccctagcaatatagtagggttatgggatctttggagtgttgcttttctggctggatacctccgtggacagtggggcctttgcctgagttcttgtcctgtgtccaggaagaatgaggtatgcagacaagtggagggtgagcaagatgaagagaagctttattgagtgttacaacagctcagaggagacccacagtgggtggcttctctttgtaggcaggtcatctggtcgagtgttcagctctcagcaaaaaggaggcaatggagtgggtggctcctctctgcaggcaggtcatcaggatgagtattcagctctcagcagagaaggtagcgcctctctgcaactggtcattcagacatctcctctgctctggctgagtccatggttttttgatcttcagagaggggaagtgcatgctgattggtccatgggtagccatgggcaggcccaggaaaaagggatataagctccccctccaggcagcaggactggcagcccggcgcccaggcttcaggccttcttggcatgaaggtgggacttcactgaggccctgcccccttctgcccaggagctgtctgcctcccctgtcattcatggcacccaggctcttcctgcaaaggggtgcctgcaggccagtgctgagctgccctcagcaccccctcagcttccctcctgtgctcttcagtgcccaaagacaggagggggccaaggcagcagggggctggcatgtcagcactgccctgaacgtgcgcccaccctgctggcctgtgacagtgccctggctcggccccaaccttgctccacaatcagaacatgcaccaggagtggggagaagccaggcagcaggagcaggcacttgcaagcctgttagggtagggggacattccagggcccccaagagttcagggatgcctgagtctgcagccacagtttgggcagctgcagctgtgcccagcagcaggctcctgcctgctcccagtcccccaagagcaaagggaggctcacatctgcagccacggttgggtggctgaagccctgctgggagggcaaggctcctgcctgctctgtggagtgggaggccagggtctacagccatggtttgggtggctgcagtggcaccgggggagctcccaccccaactcagaaggggcggggctcctgcttgtccctagctcccaccagctccatggagggtgcagccttggctgcacctccctgctgcagccagtgtgatggcagtggcagaccgtctgatgtggccactgccatcagtagcatggaagttaagagagcaggctctggacccagactgtccggattgaaatcacagtccaagttcagtgtgtcagacaggttatttaatccctgggttatttaagccttagcctcctcatgtgtaaaatggtataaccataggttgtacctcatgaggttgatgtcgggatgtaatgaatcaatttatataaaaagcttagcaggcaacacacggtaaatacccaataagcaccagttagctaattttactatcacaaagggataaaggacaaaagagaaataggtggagcatgtttcctgcttataaggaaaacgaccacacctaccactgtataggcagtggcgcagtggatatcagtctctaacccatcagatgagtttctcggtctcatttggggaacaataagagacagagagaatatggatgtgctatcatctgcccctcccctaacccctccagcaagaaagggataggaatgagtacctcatgttctgtagaaacttgaggtgttgagaataagggctccctccctaccagatattagtgcagtagaaggaagccataagtattgcgcagaagaacttcccagaaaacttagctgcaatcttgaaggaggcaccttttatgataggtggcacatgaggaaactggaagtgaggactacagtggttcttggctgtggctgcatgcgaaaaccacctgagtactttaaaaaaaaagtgcttcttgggtttcacctcgggccaattaagatagaatctttagaaggggagcccaagcaaacggattttttttttaaagtttcccaagtgatttaatgtacattccaaattgagaatagatgacgtgtttcccaaggaaattgtccctctccaagcatttaccattcagacttactacagaagatatgtcttcagtccaggttctaattatattttctttgtaaagcataaagaatttcaaagaaaaaaaatgtgtgagaaaacattgatactggacatagtcataacacttggtacttcctcaataacacacttgatagtaatttcctgcgtaatcgtctctctcactggcgtgtgagggcagggcagcagctgtacctagtgagttcatttgttttcatttgcagtgcttagccagtccagtctctggcacctatcaatcccttagtaggtatttattgaatgaaattctacatacttaatgtttgtaaaagtaaacatgtgtgtggttttagagatcatttattatgtcttggcatattacggtatgaaatgagtttcaaggacataattctaatttataacattcattccttataaacgtttaactttttgtgattcaacttgtgaatgttattatcaaggaaccaagtaagtcataaaggaagggagaggccttctgtatgacatcctaaaaggaatttatcccatttatccttgtacaaaagacattcgacagcttaagaaacctccaacagaagtttcagagaagaagcaaaaatgttcttttcactgtttcttttatttttaataaaaattaaagatattttattaaaacatatctataaaatcagctttcaattatgtcagaatgaagaggtcagcaatactcctccactaaaaaaaaaaaccatacaactggacaaaattgacaaaagcatccagggaactagaaatctactagagatgggcagcaagttgaaaagctcctagagattcaaggagaaacagcagaaggctaattctttcccccacctcccatcaagctcaatcagcaagaatcgtagttttccagtttggagttggccaaaaacccagtggctcttctgccagaggagaaatacttataaagttttaaatttcaatatttagggtcgagaagtggcatgaaattttgtgactttgcatatactaaaagtagcaaactcagaaatgaatagggaaaggccacagctttgttagcccaaggatgcagtcccagttggggtgagcagcaaaccaaccagagtgctaatggggagatcctggaagggttgagacaagttttccacatacccctggctgactgagaatacgaaaaaactaacccagaaaaaggaaaaaaaaggagaaacataagactaaaatcaagttgggacaaatagaaaataaatcacaaaatgatacacctcaactcaactttaacatgcattaaatattagtgtattaaacactccaaataaaaggcacaggtgtcaaaatggttttttgttttgttttttttttcttaaaattgttttgaagaaaagcaaaaccaagcatatgatttacaagagacacttttaaatataaaaacagtgataatgaaagtaaataggtggaaaatgatacaacaggaaaatatttagcataagaaaactagactggttctattactacagctggcaaaaaaaaaatttcaaagcaggcagtattaccaaagataaagtaggatatctcataaaaataataaatgaaaaccaaatagtcttatccatttatgcccctaataactgagcttcaaaattcacaaagcaaaactaacaaaaaaagaagtaaacaaatctccaaagttgaagacttaacaccttcttttcaatagcatagaacaattagacaagaaatcagtaaagtttagaagattttaacaaaactacatacctttgcttaacactaatcagaacactatacccaaccacagcagaatacatattcttttcaagtgtacatggaacatttatcaagataagccatattttgagccacaaaacatctttatatgtttcaaacaatggaaatcttataaaatatgttatctgaccacagaaacaactaacttagaaatcaggaacagatacatatttttagaaaatccccaaacatttggaagttaaacagtgtatctctaaataacctttggatcaaagaagaaataacatgtgaacgattgagaaaatacaacttcaaaatttgtaggatgtagcaaaagcagtgcttacagagaaatggtagctatatgcactcatgttagaaaagaggcttaaaaccagttatctaagttcccacttaaggaagatgcagaagaaaggcaaagtaaaaccaaagtaagtagtaggagagatgttttaagatacacaagagcagaaattaatgaaacagaaagcttaaaatgatagagaaaattgacaagaacaaaattttattctttgaagagactggtcaaaaaggagaaatcacaaattatcaacatcacgaacaagaggggtatcactatagtggaagagggaatgtcactatagatcttacaggcattaaaaggataataaaggaatttttgaaaactttatgacaataaatatgatagcttagatgaaatggaaaaagtccttgaagcagaatttaccaaaaaatatacaatgataaatagaaaatctatataaccttgtatctattaagtaaattgaatttgttatcaaaaacattcccataaagaaacatccaggcccagatggtttcagtggtgaattccatcaaacatttaaggaagagataatgccaatcttatacaaactctttcagaaaatatagaggaagcagtttgcatcacattttaagagaccagtataatcatatcatctgacagagataagaaaataaagttacaggtctatatcatgattacaattgcagcattggtggtatagtggtgagcatagctgctttcaatgattatgaatgcaaaagtcgttaatgaaatatgaccaaaacaaatcagaattccaaaaaagagagagacagagtattattctggacaaagcacatttattccaaagatgcagggttagtacagcattagaaatatcaatgtaattcaacatgttaatagaaaaaagataaaaagcatatgatcttaactgaaaaattaacacaattctacactcattcacgtttagaaattctcaaaaaactaggataaaaaggaacttcctcaacttgacaaaagcatctataaaggtgacagctagcatcatagctaatggtgaaatattgaatgtcccccacaaggatatctacccccaccacaatgctatttaatactgtattaatcgttccaactaatgcaataaggaaagaaaaaaagcataaagatcagaaaagaagaaaacagtctttctttgcagaaaacataattatttacattgaacatcctcagtaatactaaggaataactactagaactatttaataaagtcacagttatatctcatcaatataaatatatatacatacaaatatattttctatatactagcagcaaacaattagaacagcggtgtttttttttaaattgacttagtatccaaaaaacgtaaaacacttaagaataaacttaacaaaagacatggaaggcctctgcactaaaaactacaaaacactgctgagaaaaataaatgatctaaattgagagttatgccatgttcacatgttggaacactcaatgttgttttgtagtcagttctcctcaaatcgatctggcaattcaatgcaatcacaatcaatatactaacaggcattttaataacttttcaaagttgattctaaaatttatacggtaaagcaaagaatacaggaatagccaaaatggctgggcacagtggctcacacctgtaatcctagcactttgtaggggtggtgtgggggctgaggcaggaggatcacttgaggccaggagtttgataccaatctgggcgacaaagtgacaccccatctctacaaaaacattttttttgaaattatctgggcctcgtaatgcacacctagctactcaggaggctgaggcaggaggatcacttgagcccaggagtttgaggctgcagtgagtcatgatcacaccactgcactccagactgagtaacagagtgaaaaaatgtcagaaagaaggaaagaaagagagagggagagagagaaagaaagaaagaagggaaagaaaaggaaagaaggaaagaaagaaaagaaagaaggaaggaaggaagggccaaaataatcttgataaagggcaaagttgaaaggctcatgctacctacttcaagacttgctataaagcctcagtgatcaagacagtgtgatattggcataaggatagataaatagacatatattgcagaatagggaatccagacatcatctcatacatgtatggttaacatacgttttttttactaaagttgcagagctaaataatggggaaaagagagcctttacaacaaatagtgctggaataacagaataaatgaaagaaggaaaaatagatcttgacatctacaacacaccaaacacaaaaattaatttgagatgggtttcagaattaagttaaaaacttaacaaatatctagaaaaaaaaaaaacagaatgtctttatgacttatctacaggactccaaagacactggtcatttaaaaatgacttacagatgcctgcagctcattctggggaaaggtcattcattgttatgaccaatgtggatacaaagcctaacacaaaaaggtcttgaacttttggattaggttgttcttgtattgatcactgttctcaaaaggaaagcctcaacacaagctgtctacctatatcatccccttgtacaaagaagggaactgaaacataaagaagaaacaagtcgtccactagcattggtgacatcagcaaaattgtagaataggcagctccaaactcccgtccctctacagaaatactgaaaaacaagaagcaactgtcagagccaactttgctagaactctggaaaagagtcagaagtttacagcaattaagaaagtgctgaaccaagaaaaagcaacttaaaaatgataggacatttgccagttttttaaattggggggaaaatgataggaaaactttgtggcatttttacttgtccttgccacatcccctctttgtctcagcagcagtcttaaagacagcatcccgtgttcccagtatgggaccctgaaccctggttctggagggagcagagcaggcttcaattgcaaattactggagtttgtttgtctgttctaacctattcgggagctaactgaagaacttatatgaggtatgcatctcgttttgcctaactgagaacccgtgaagagggagaagtgacaatcattgctcagaaacattgtaaggtgaatacaaaacctgcagccacctgggggcaaaagattaaggttcagacatacaatagaatgtctgaggtctgggagcaaaagccaggaagagagttcctttgggaaattagggcaattcaaaactgccagtgtgtattcgggagtttagaaagcaacatgcatgccaggacaggacgcatgttcagaaaagacctgagaagaccctaaccactggctgatctctgggctcagtacaagtagaaagtaaaggctcatgggaatatatatatatatatgtgtatatatatatgtgtgtgtgtatatatatatatatatatattttttttttttttttttttgagacagagtctcgctctgtcacccaggctagagtacagtgatgtgatctcagctcactacaacctctgcctcttgggttcaaatgattctcctgcctcagcttcctgagtagctgggattacaggtgcctgccaccacacctggctaatttttgtatttttagtagagacaggattttgccatgctggccaggctggtctcaaactcctgacctcaggtgatccgcctcccttggcctcccaaaatgctgggattacaggtgtgagccaccatgcccggcctcatggggaattttaaatggcctaccaaagtgttaatagtgccccaagacagagccaatccacaaagactagaagaggagggggttttacttgttttgttttacttagctcctggcaatcaaggacagctctatcaaaaacactggctgaacacaagctaagccttcagcaatcaagacaagcaaaccgtaaggaactggaagaatctgacttccagagttaaaacactgtaatatttgaatgttcaatttttaaaaatcacaaggcatacaaagaaacaggaaaggataatgcattcaaaggaaaaaaaataaactgacaaaactgtccatgagaaagctcaaacattgaaattattaggcaaagactttaaaaacaactgtcttaaatgtattcaaaaaactaaaagaaatcatggaaacgaagaaaggaaaccaggaaaataatatatgaacaaaacgagaatatcaatacagagatagaaattataatgaggaatcaaatagaaattatgaaggtgagaagtatgataactgaaatgagaaatttcactagaggagttcaacagcaggtttgatcaggcagaagaatgatttaacaaacttgaagataggacaattgaaattatccattctgagaagcagaatgaaagagtgaagaaaagtgaacaaagactaagatacctgtggaacaccatcaagtggaccaacatatgcattatgagagtctcagaaggacaagggagagagagagacagaaattatatgtgaatggccaaaagtgtcccaaatgtgataaaagacatgagtctacatatccaggaagctcaacaaagcccaagcaaaataaacacgaagagatacaccaagatacagtataggcagattgtcagaagacaaagagaatcttgagaacagtgagagagaggcaactcatcctgtacaagggagccttaataagattaacagttgatttcgcatcagaaaccatggaggcctgaaaacaggaggcctgatgccacttcacacctactaggatggatataattttttttaatggaaaataacaaggagaggatgttggagaggacatgaagaaattggg

SEQ ID NO: 414 - DNA, 156642 bp, Homo sapiens
gtctgtcacagaggtttgactctaatcttgtgtgccatggatgacaagtggcacataaaggagcagctgcgtaagtgtgcaagtgattagtctgtgtttctagatcacctctactgttatcttcatttactattattttttttggctggaggatacagtgccagcttggcaccacactctcccaaacgccttctttcagccagtttacaggggagtgttttggagaaaaactgccaatgcttccttttcccttctcagattaaatacattacatctgcttaacatatgcagtctctgttggcccaggaaaccagacaaaagctctctggatgattatctcattagtattttgccttctaaaaatgttttcagtcaggagggagggcacaaaatccttgctctttctgggttgcgtcttgagctcaaatactggctccaccacttgccgtgtgaccctgagaaagtcacttaattttttccggtatcaattttcttctctgtaaattgaagacaatacttaaccttatagagttgtggtaaatactaaatgacctctgatttactttttgtatttaatgaaatactagccaaaaccccaccggggttttcccttttctcatggggcgaagtagtgatacttgtcaaactaatcttgaaagattctctaggaaagtaaatgagtaagaataatcaagaaaattttgaaaataaatgaggagtcttgccttacctagtcaaaacaactgtaaatgtgacactgaaagaaaatacatcaattaacaagagaacagagaaaacgtttgtatttagtatatgagtgagttattttaaattagtagtgacagggtatattgttcaataaagagattgggacatctaatctccacttgtttgttctttcttttattctaggacttcttagtaatttcctcctttgtgaaacatggatccccaaatttcaagggcccatttcctgtaaaataatgcgttgttgaagttaaagtctttttttttcccccagacggagtatcactctgtcgcccaggctggagtgcagtggcgcgatcttggctcactgcaagctctgcctcctgggttcaagccattctcctgcctcagcctcccgagtagctgggactacaggcagccgccaccacgcctggctaattttttgtatttttagtagagacagggtttcaccatgttagccaggatggtctcgatctcctgggctcgtgatccacctgcctgactcccgaagtcctgagattacaggcatcagccaccgcgcccagcctattgcagttaaagtcttaagatttatccacacaggtgatagatgaaggcatgagagtggactagatcattaaagacgcgtacaaagaggtctgtgattgaaatattgggaaacacctacgtccaggatgcagatgaaggaaaagggactcaaggtggattgcaatatgataatgtcaatgacaaactttcatttttttaaaacaccaaatccacgggaggcaaatgtttaaatagttagagaaaagtcaaatgaaaagggatcaagatgataactgcagacttgaaagagcctaataggtttgacaaatggggcgagagcagctctcctgaagaaagaattttcctgcttcaaagattcagccaggttcagttaggagacagcaggcactgactaacagaggctgtgctatataagaagagagaggccaggcacagtggcttacacttataatcccagcacttcgggaggctgaggtggaaggattgcttgagcccaggagtttgagagcaggctgcacaacatggcgagagcccatcactacagaaaatttacagattagctaggcgtggtggtgtgcacctgtggtcctggccactcaggagggtgaggcaggaggattgcttgagcccaagagatcaaggctacagtgagcaccactgcactccagcctaggtgacagagcaagaccctgtctcaaaacaaaaacaaaaacaaaaacaacaaaaaaaccccaaaaacaaacaaaacaaacaaaaaaactccagcatgaacaggaaagaactggggaaaaccttccagaatcgactgaattttgaatttgctactaagctgtgttatattccactacctgccagacactgagctagatgtcatcaattttcacaacaaagctgcaaggtcttgttttcttcatttcacagatgaggatgtttaagccaacattatgtcagactgcctactaactagtttgggcaagttatttaacttgtctaaggcagttttcttaaatgaagtaatgctacctacctcataattgttctgaagattaaatgcttataaatatacatgtatgtatatatgtacatccaaaaacatactaacatagtgtagcatttagtaggagcttaataaatatttctagtaccatccaagcaagaaaaagaattcctaagatatggtgatggtgacataactgaatttaagttcagaatttcttttatgtatacatagctttattttgagcagtcatctttgatacacaagcttcttctcttcctcttttgtaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacagaattcactaacttcatatatcgttatacacaaaacattgaaaatacataaaacattgaatatatggcttctggttattcagatttaaagggcaggaaaggggactagggagaaggaaaacaggtaaattttaaaaagaataggaatttagtatagacaaaccttaagagtatttggacagttctgaacagtgaaaattgatattgacaattgatatttacaatgaagacagcttctttaaatggtttaagccatctaaactaaattttaaaaatgccttaccaaggcaggaaaatgaactccagtatttcagaaaacttttcaacaaggacttaagtattcagctatattaatttttctacttgggacatgaattttctctctagcagttttacctagtaaaactattaaaatctatttgtattcccaggccctacatccaaccaatgaaagggaaaagctctaaaaataagcttgcccaactaataatagcctgaaaggtagcctgaaactacccttatttctgtatatatttctaacaattcatataaaacaaatcagcatatattaaacccctcctaagtgatctttataatgtaatattcattaatattacagaactgaactcagaattttaaaaagttttaccaggttcagacacatcctttacagctatagccaagagtagtacaaaaacataacatctcttccctaaaagggaaaaaacctagataacttataattagatccttttattcaaggttatcaataatagaaataagaattctattaaactatggtcatatgagccaaatttcactgaaactattcaaatatacattttcgatttaagtgaactacactatagtaattcatcttccatttccatttttactcttcaaaattaaaggctatattgtatttgtaatgtaaattattatactaatgtgaatttctataggaaggtcatgagacttgcaaacatttaaatatcacttcaatattttactttaaaagaggaaacaaaacacagtaccaaacagatgataacagatattcttggtgttaaaggaaaagccagcaaagatgtgaatttctaaaataatctgtacaatgcaataacacttcttagatccttaaaaacaaaatagcaattaggtaatgactagggtacttttcatactttttccttcatattttcttcacactttaaccacatgtacatcaaactctttcagctaccacagcatctgaaaacctaactttccatagttttaccacaaagtataaaaacatcagtaataagatagaaattattacttctggtaacatggctcatttttactttagcttccaaacagtgaatctgttataaaaaggaagttttcaataatcaagggcacaatgtaagttacatatatacttttattattatatataattttatcatatgcacaaataactcataaatatgtatataaaactaaaatgtccacaatttttctaaaagcacaattcacaaatgcaatgaattggatagccattggcacatcaaaaattttaataagtataaactggtcaattccaaccatttggtaatttacaatgcaggttatcacagtatcaaaatacaccttattaaatttgtaaagaatatgctatgttgctagcttcccaaaccaactgtttctaaccaaataaagcatattatttatattggcatactatactcttgcctgacaggcaatatttttaactctaagaggggtaggtaaaagatcagttttttggaaaataaaagatttatataaaaagtctggataaaaaagcagtggtttagtacagatgattcaacttttggtgaggtttctgtatctatttaccttttagacatggggagacatgagtgctatgataacatacggtttggggaaggcagatttctaaaggcttttcctaactgtagaagcttgtcaaatttttatataacatacaatttttaactgtcaaagattctgtgaaagtacacagaagcaggtccgtgtaattatttaagaacaaggtagtttaaaaaatgtgttgtaaagcatggaagaaaataataataggtaaggaaaacccacaaacatctgactcacaaatattttcttatacagatgctgaggtagaaaaagtcaaatatgcttaagaagaaaacatacgaaggataggtaaagatatacaagttttaaactatgaaattcctctaatgcaaatgaactcaatactgaatgacttttccacagtcctccatgcttccttccttgccatggaaacgttctaattaaattgaaatttaaatcataaccaaatccaaatgcctaataaagtcctttcatcactctgttgtccttcagttgtcttttatactctatctggtattttatagatattatttgactggaatactcatgtatccaaatgtatattttaattttcttcctatttaagtgtcttcaatttctataggaaagaggtcctatacagtttccatgctgtaaactgaatgaggctgagtgtaggatgaacatggcaatcagagaaagctgctaaatgagcctcttgtttggaaagagataagcttgaagataaaggtacagtcagataggtggcagaaagtctccagactgaagggtttgaacatcaccttataaacaatggtaagttactggaagtcctcgagcagaaaagtaacaagaggaaaacagtattttaggaatacacatttcagaacataagctgtaggagaagaaaccagaggtaaggaaataagtagtgcccaacagaaaaaacaaacaaccagtggatgcaaggcactgcaaaaagataaaaagaagcctaagatcctgtaatggtaatcaactgaaagtgggagaaacatgaagaacctaaaatgcctctgacatttcaaggctaaataacttaggacaatagtgtattccctgggtagaaaatgaaagcaggaggtagtctgagatttcaggagactccaactacagaggtttagagatgaattagcactaggtggctcatcacgcctgtaatcccagcactttgggaggccgaggcgggcggatcatgaggtcaggagatcgagcccaacatggtgaaaccccgtctctactaaaaatacaaaaaaaattagccgggcgtggtggcgggcacctgtagtcccagctacttgggaggctgaggcaggagaatggcgtgaacccgggaggcagagcttgcagtgagccgagatcgtgccactgcactccagcctgggcgacagagcaagactctgcctcaaaacaacaacaacaacaacaacaaaaaaaaaaaaaaaaaaaaaaagagagagaaaagctggagttatcagttcaccactaacagaatgttgagacaaagcagatgaagggtcgtatcttacgactggggacaggaaagaagaccatgaaggtgctctcaagatacagtggtcatttttggtctggggactggttccaggatcccctgtgcataccataatctgcacttactcaagtcctgcagttaaccctgaggaacctgcctctacaaaaagttggtcctccatatactcagattttgcatcccacaaatactgtattttagatccacatataagtggacctgcacagttcaaacttgtgttgctcaagggtcaactgtatatgtaggaaggagcagtaccattgtggaaatgatgggaagataaaagaaaatacaattgtcacagagaggacaaagaacatgagaaaggagaacaaactcagatttgaccaaaagacaatggcttgtattacactggtagaagcagcagcctcagaaattacagggtatttagggaaagtggctattaaagaagcaggtataagggactccaagtctgggaatgaaagagggcaagattgtagtaataagtgaaggatcagtgaagattttaaaaaaaaggaactgagccataaattttcttcttttttcaatttaaaaaaaagctttaaaaaaagttacttatacataaatacaaaacatataatacacacacatattgttacacactttgttgttaccattcttaagtacaaattttagttattcttagtatctatagatatatgtcctaaagcatgattcagtagcagcttttcctatcctttaaacgttttcatactctaaggagcaagattctcaaaggtatctttatcaatctcctttggaaaaaaaaaacccacacacacacacacacacacacacacacacacacacacacaaaaacacatatacacataaataacctctttaaaggcatcaccttaaatagataaaactccttagtgactgctggaactttccaagccatacattatttgtttagtaagtcactatcatgatgaaaagaaattcagtgttatgaagtctattaaacagccttaagctttcatttattccctttgatgaagctgatttgagagaaggaccatttatatgttatgaaaataacagacactcctttggatttcacagattataattaagagaacgctattaactacagaatactgattgcaaagtatttcatttttaaagatactccttgagccagagaagggttgaaatgttttcttgaaggaagagtagaaccatgataaagactataatcccaagaaggaaacaaagtacttcaaagttagaaaacatgatgtaagaaaacattggaaagtgggatcattcatctgggacatatcattagagaaagataaaattgagaggtgttctttgccttaattgtgcacgagtaataaactaatcgtgtctgtacatttcccaacagaatttgggccaccaaatattttcacgtacattatcccattgattctcacaacaacactgtcaaatagtaaagggattcttcttttcttctccatgaagaaactagactgagaaaggttacgtaactagctcaagatcataaagcaaagctgagtttgagacccaggtgggttcccaaaactaggactggagctctttcaaccaaataatgctcaataggaaaaggagtcaaggacaagctccaactggtaaaacaatctggatgagttaagagttcaaaagttgagaaacaatgttgttaaaggaaactaaacaggtttcttggataaaatgctaagttataagaagctctggctaaagagcaagaagatggatcagctgacttctcagaccactactattgttacttttctagaatatttttatttactctcctcttaaagtctcctttatttcctcctcctgatatgattttttttttaatgacaactccaaaagaaaggatgaataaaaaaaaaatttggcaactcttggaacctaaatataaaccctgttggcatgtttacacttctttttggatatcagctgtataatcctttagccagattcagtctcattcctaacacagttaagtgtgctttgtaagggttttctttgttaacttgcctcacacatataaaaaagaaaaacaaatacacagtcacatttcccaacacctttcccccaccaaaaacacagtatagggtagccaggtactttgaaaaagtatcattttaaaacataactattattgtaaaaataaaaaataaacatgacaaatcagtcacaaggcagggaggcaggaagtcatactacaacaaaaagtctatggatgaagtatctgcttaatactcacacacagaaaacactctcagaaaatgtttctttaatttagtttaactaaaatttcatcaaggtagaatgcagttttgtaaaaagttccaaggatcctattacacagttgctaattaaccttcagttccttatttatacattttttacttacagatataaaaggaaaaaaaatcctagaaattattttaaacagaacattatacaattaattaaaagtaggaattagagtggaacaatgtggctttagatactgataattaatagacaggatgaatcacaaaatatattaagtattatcattttccagtctctgcatctcatcttgtcccatctgtccaaggtgagacaaaagtttgctataggcttccctgtttaagaaaaaagaaaagaaagcaaatatattaacattttcattatttttcatttcagtatttacaaattaagtctgcccatcatccatccatccatctattcagccatccatccagcaggcttagcacaacacttcttaaaaagtaatgctttatatctattgtgagtaaacctagatgttaagatgtattaaagtatgatttttatatataaaatgtgtgctaaaaatgacatgtaaaagttcattaaccttccgaaatattataatgctcacgggtaataaaatgcattcatggaatattatttaaggacaatgatggtatgattacaatgggaagacttgtatcacaagcgtaagtattaaaacaaaaattctgtaaccataaaatagacctgtgtagcaatttcagtatatatcccattttcttcttttaacttcttataagtaacaaagtttgaaaataaaatattgtttctcctcctacattctctagtacttccctgtatttggaaggtgttttagatgatttattgtgcctagtagttatctcactagtctaaatacctgttctgttcagaatctttagaaccaaacttcttatgggcctgcataaccacacaaggtagtaggccagaatatttgttttaacaacatactgcattagggtggttcacacacagcctctctagttttttcactcaaatttgaagactgctcagagaagccagatgtgagacatgtctgtgcatgagcttgttttgtgacatgacaataaacaccatttcttcaagctacaatttgaagtgattcaatcttctctccttagaaaaccacaggaggctagccaagtcaccatgcagaagaaaggagatgttccattctggcatacaaaagctttacaaggatgatctctccagtccgcaccccctgccttttatatgaaatggcattgaaaaaatggattccattagttagctaaagctataatcaacatagtcatgtcttcaagaaagatctcatatattgtttaataaaaaatttttgtctaaaaattggaatatgcatattcattagagtgtgtatttgtacagataaacagacacacatgcatatgattatagtcatgcactacattaaaaacattttggtcaatgatgggctgcattttggtcaatgatggatcccattaagattataatggtactgaaaaattcctaatgcctggtgatgttgtagccattgtaatgtcttagtgtaatgccttactcgtgttgtttgtggtgatgcaggtataaacaaacctattgtactgtcagtcatataaaagtctagcacacacaactatacatagtatataatacttgataataagaaagaatgttactggtttatgtatttactatactttactttttattgttattttagagtgtactcctctttatacttataaaaataaaagttaactgtaaaacagactcaggcaggtccttcaggaggtattccagaagaaggcttccttattgcaggagacgacagctccatgtgcgttactgaccctgaagaccttccagtgaagtaagatgtagaggtggaagacagtgatgttgatcatcctgaccctgtgtaggctcaggctaatgcgtgtgtgtcttcattttttacaaaatagtttaaaaataaaaaataatttaaaaatagaaaaaagcttattcaagaatataaagaaagaaaatatttttgtacagctatacaatgtgtgtgttaagcttttttacaagagtaaaaaagttaaaaaaagaaaaagtttaaaaggtaaaaaagagtaagctaaggttaatgtattattgaaaaactaaaaattttagaaataactaatgtactctaaatgtattatgtttataatgtctactacaatagtgtacagtaatggcctaggccttcacatttatcaccactcactcgccgacccacccagagcaactactagtcctgcaagctgcactcacggtaagtgccctatataggtataccattttaaaatctttgctaccatataattactgtactatgttttcatatatttagatacacaaatacttaccataagttacaactgtctatagtattcactacagtaacatgttatacaagtttgtagcctaggagcaataggccacaccacattgcctaggtgtgtggtataggctattccatctaggtttgtgtaaatatactctatttgatgttcacaaatgatgaaatcgcctaactacacatttcttagaacttatccctgtcgttaagcaacacataactgtattttgattctttaataacctttaggacacaaaaattccactgtgagtactgactactctaaaacaatttctttaagaaataaatataggcttattcccacaatgttgagactctaaatagtccagcactattttcagttgagttatgagcctattaaaaaaaagtcttatttcctatttttgaccaaaacctatactgtctaattgggtcacttattcactagatacacatgatacagttgactaaataaatcaagcatccctcaaacggttatgatttgccaccataaattttattaaaaaacaagacatccaaggctatgaagtccacttcccaatgaggaacactgaaatgcgttttgagcaacagcagcactgctgaaatatacagctttctaaagcggtcactttgaaaggaaaaacatgcaaatttatgtattgattttgctaagtttgctgatgagccatgctacttctattcacactttgtaaaactgataatcacagtactgaaacatttttcatctcaaaagaacatacccaaattttggggaataagaaaataaatcatttctataaaatgaaatataaattttataatcactgccccccccaatgtaattaaattatcaaacatacctttgtgctatattcctgccaaggccccatttctgctctgaatccttcagagactgagtaagggtagaaatcaagtggatgacaacctgctggtccaatgttgctactgtttctaaaatgctgtaaacctggtaatagtacctcataccataatcctggataaactgcctgaaagtaaaacaggtttatttaggattactcctggggcaattccttgtgttggtatctacgtggcaatcaactatgaactgaacataacaaagatcatttcataaaagtttactgtaagaatctggatgcaatatgaaaactatttaaaacactttaaaataaagaattgaagtggcttatttaagttgagccatgaccagagtgaaagcactgtggggaggagcagggaagggaagagttggaagcttgggagggagaagaaggggtaaaaatctaatcccgggacttttttgcaatattctacatattgaatctgagtggaaaggatatgggagacagtaacagaaaaaagtcagatttcctagttattttttagttctttgtagctctatataagtcaaacaatatttttatgaggaaagcaagttattcctaatatattttatgttccttaactgaataaaagactttagacccatagaaggtctttataaataaaaattctatatttagccttaaaacctctaccctccactaccaatcaacaaaatgaaaagccacctcgcttagtaaattatagataacattcaatctttgatcatagaaaatccttttctcccctcctagggcttcacaattttcacaaatccattgttactgactgatcacaatttaaataaactataaacacttgacaggcactaattatgtgatgagaaaaatggaggtatcaaagatccaacatagaatgaaggaaacgaacgcaaattatttctcatggtagtggtaaggcagagataggaataataaaggtgaactggaagaaatcttcagaaagaaatacaaaaacgtattgccctaacagcacaagactctaaagggaacaagacagggaagaaaaagaaaatatgcctcaagttgcactgttattcttatgaacaatagatctacttctataaagtccatgcttcacaaattaaacataacggagctttctgaagctacagttagtatactaaagcaagtcagaaaagcagtgacatgtacttctacaatggatccagcggaacatgtttagcaaggtctgaaggcctgtgtacctgtcatcatgactcacatttcccactttactctctcaaacccagtctaggaccacgtaatgacatttcagtcaatgacagatagcatgtacaatggtagttcagtacaataagattaaaatactgcatttttactgtaccttttctatgtttggatacatttagatacacaaatatttaccactgtgttacaactgcctacagcattcagtgcagagacatgttatactgatttgcagcctaggaccattaggccataccatatagcttaggtgcagagtgggctatagcacctaggtttgtataagtacactctatttgatggtcacacaatggtgaaactggctaactatacatttctcagaacttatccctatcgttaagagacacatgactgttcatgcaagattcttcctcactaaattcacaggtaattttaagtcccctcacttatctttttcactggcacttttatttttcaataaaacatcacagtgtaacaaaactactgccaaaaatacaataattgaaatactataaacaagtagtaacacattatgttttggataattagttatttaaaaaacatgttggctgtcaaatggctggcaatagtttccttgccaggtggcatattttccagttacctaaacacagaagtcagctgggaggaaggttcttcttctgaccccacttggcaggcttttaccatgtattgcaggttctctgtggccagccttttaactagaaggaaaaattacagcattaggcactgtgtctgaattgaccatctggatcctcatttttatgaacactcttgatttagaaaaatatgttgttttcttaaagtatgtacatcctttttctatttttcaaaatgaaatagttctaagtttttgttttattctaaagtatacctatcttccattttaagaaaatataaaagtttaaaagtctactttttagtctgaaataatacatgaagacctatttttctcttagaaaggtgcccatattcaaaaaagttacaccatcctaatcctacaaacagtaacataccgacaaaagaaagcctttacaaattcagctgatttacagacaggcagattgattttttaaaaattcataagcatattcctcccaccccctcacaaacatgtaagtagcaaactagataccgtgaacaatttcttttcacttaaaattagccaaatatgtatgcaaaatgttgtttgtgatgctatcttcctttcaaaggataataaagtataaaaagaatacttacattctttaaatatttaactaaatcctttaaaattgtgtgcttgtacacaaaaataatgcaaaaataccaagaaaggatgtagaaaacccaatatgttctgaatgctactaaattcttatgttgtttttgacacattaaatataagaaaccagagaaaaaagtgctttttccaagaataaaaaaaagttcagaaactgtaaccctaaattatagcaggagcacaaaatatatgatgaacatgaacataatgaatattaggtagtagagaatgttttccatgcgatgaggctcgtggctaaggaacacacagcatccttgccttttacttgaaaactttttacaactttttaaaataacttctcattttagatgcagtttcttttttctttaactgaactacctttttttttttaaaaaaaatgagtattttcttttttttttttttaagaggcagagtcttgctctgtcacccaggctagagaagtggtgtgatgatagctcactctaacttccatctcctgggctcaagccatcctcccacctcagcctctcaagtagctaggactacaggtgcatgccagcatgcctggctaattttttaaaaaagctttttgtagagatggaggtctcgctatgttgcccaggctggcctcgaactcctagtctcaagtgatcctcccaccttggcgtcccaaagcactgggattacatgtgtgagccaccacacctggcctttttatttcttaaaagaagagctttattgtcatataattcacatactatatagtttacccatttaaagtatactgttcgatggcttttagtatattcagagttgtacaaccatcatcacaattttacaatattttcaatatcttgaaaagaaattccacactctttagctatcccgattccttctaagcaatcccttaacctactttctgtctctacagatctttttttttttttttttttttttttgagacggactctccctctgttgcccaggctggagtgcagtggcatgatctcagctcattgcaacctctgcctcccgggttcaagcaattctcctgcctcagcctcccgagtaactgggattacaagtgcatgccaccacgcccggctaattttgtatttttagaaaagatgtggtttcaccgtattggccaggcaggtctcgaaatcctgacctcaagtgattcacctgcctcagcctcccaaattgcaggaattacaggcgtaagccaccatgcctagacctgtctctatagatttaactattctggatatttcaaataaatgaaataatatgtgacttttgtgactggcttctttcactgagaataatgttttcaagattcatcaatgttatagcatgtttcagtacttcatgcttttttatagccaaacaatattccattgtataaatatatcaaaatttttaaattgatccatcaaacgatgagtattctactttttggctataataaacaatactgctataaaaattaatttacaagtttctgtgtggacatatttgttcatttctcttaaatatatatatatatctaggggtgaaattgctgggtcatacagtaactccatatttaaccgcttgaggaactactggactattatccaaagtagcaacatgattttacattcccaatggcattaaatgagagttccaatttctccacatcttccccaatctttttcattatctgactccctcattatagccaaccttgtgggtatgaagtgatatctcggggtagttttgatatgcatttccctggtgactaatgatgttgaacaccttttctggtgcttattggccgtttattttctttgtagaaatgcctattcagattcattgccaatttttaaattcagttatttgtccacttattcttaagagttatttatatattatagatgcacactccttatcacatataatttacaagtattttttcccattttgtgggttgtcttttcactttcttaacagtgtcctttgaaacacaaaagctcctaattcttgatgaagtccaatttatctcttctgtggttcatgcttttagtgccatagctaagaatctgttgccaaattcgaggtcatgaagatttttttcctatattttcttcaatgacttttacaattttagctctgacacttaggtctatggttcattttaggttagttttcgtatgtggtaggaaacaagggtccaacttcattctttcgcatgtggctatctgacctagcaaaatttgttgaaaagactacttttccccaattaaattgtcttggcactcttgtcaacaaacaaaaaaaccccagttgaccataaacatgggtttatctctgaacgcttaattctattctattgacctacatatctatctttatgccactatcacactgtcttgattactgttgctttgtaacatgttttgaaatcaagaagtatgcgttttccagctttcttcttctttttccaagattgatttggctattctgggtcccctgtaattccatataaattagtaattcatatggagctattagtatagtcacttaagctttctgtggttgctgtttgcacaactatcttttcccatccttttactttcaatctatttatatctgtgaatctatagtgtttcctgtaaataccatatgggtagatcttgtttttttaagaatccattgtgatcatctctgccttttcattggactggtcaatcctttcacatggtattattactgatatagtttgatttacatcagcaattttactttttgttttcttaatgactcgtgtttgtttctttaatctcctttactgttttcttactacattaagtgaatattttttaacgtagtcttccaaatttttaaattgttattattactataagttctggggtacatgtgcacaacgtgcaggtttgttacatatgtatacatgtgccatgttggtttgctgcacccattaacttgtcatttacattaggcatttctcctaatgctctccctcccccagtcccccacctcctgacaggccccggtgtgtgatgttcccctccctgtgtccatgtgtactcattgttcaactcccacttataagtgagaacacgcggtgtttggttttctcttcttgtgttagtttgctgagaatgatggtttccagtttcacccacgtccctgcaaaggacatgaactcatccttttttatggctgcatagtattccatggtgtatatatgtcacattttctttattcagtctatcattgatgggcatttgggttggttccaagtattgatgacttcacaatagacttcgctattgtaaacagtactgcaataaacatatgtgtacatgtgtctttttagtagaatgatttataatcctttgggtatatacccagtaatgagattgttgcatcaaatggtatttctagttctagatccttgaggaattgccacactgtcttccacaatggttgaactaattcacactcccaacagtgtgaaagtgttcctatttctccacatcctctccagcatctgttgtttcctgactttttaatgatcaccattctaactggtgtgagatggtatctcattgtggttttgatttgcatttctctaatgaccagtgatgatgagcattttttcgtaagttttttggctgcataaatgtcttcttttgagaagtgtctgttcatatccttcgcccattttttgacggggttgtttgtttcttgtaaatttgtttaagttctttgtagattctggatattagccctttgccagatggattgcaaaaattttctctcattctgtaggttgcctgttcactctgctgatagtttcttttgctatgcagaagctctttaattagatcccatttatatatttggcttttgttgccgttgcttttggtgttttagtcatgaagtctttgcccatccccatgtcctgaatgatactgcctagattttattctagggtttttatggttttaggtcttacgtttaagtctttaatccatcttgagttaatttttgtgtaaggtgtaaggaatggatccagtttcagttttctgaatatggctagccagttttcccagcaccatttattcaatagggaatcctttccccattgcttgtgtcaggtttgtcaaagatcagatggttgtagatgtgtgatgttatttctgaggcctctgctctgttccattggtctggacatctgtgttggtaccagtaccatgctgttttgattactgtagccttctagtatcgtttgaagtcaggtagcgtgacaaagtagcctcctgctttgttctttttgcttaggattatctcggctatgcacacttttttttggttccatatgaaatttaaaatagttttttttccagttctgtgaagaaagtcagtggtagcttgatgggaatagcattgaatctatactttggggagtatggccattttcacgatattgattcctcctatccatgagtatggaatgttcttccatttgtttgtgtcctcttttattttattttgttgagcagtggtttgtagttctccttgaagaggtccttcacatcccgtgtaagttagatgcctaggtattttattccctctgtagcaattgtgaatgggagttcactcatgatttgtctctctgtctgttattggtgtataggaatgcttgtgatttctgcacactgattttgtatcctgagactttgctgaagtggcttatcagcttaaggagattttggactgagacgatggggtttcctaaatatacaatcatgtcatctgcaaacaaagacaatttgacttcctcttttcctaactgaatacgctttatggctttctcttgcctgactgtcctggccagaacttccaacactatgttgaagaggagtgatgagagagggtatccttgtcttatgccagttttcaaagggaatgtttccagtttttgtccattcagtacgatattggctgtgggtctgtcataaacagctcttattattttgagacacgttccatcaatacctagtttattgagagttgttagcatgaagtactgttgaattttgttaaaggccttttctgcatctattgagataatcatgtggtttttgtcattggttctgtttatgtgatggattatgtttattgatttgcatatgttgaaccagccttgcatcccagggatgaagccgacttgatcgtggtggataagctttttgatgtgctgctggcttcggtttgccagtattttattgaggatttttgcattgatgttcatcagggatattgatctaaaatttttttttgttgttgtgtctctgccaggttttagtatcaggatgatgctggcttcataaaatgaattagggaggattccctctttttctattgattggaatagtttcacaaggaatgtttccagctcctccttgtaactctggtagaaatcagttgtgaatctgtctggtcctaggctttttttggttggtaggctattaattactgcctcaatttcaatacctgttattggtctattcagatgttcgacttcttcctggtttagtcttgggaggatgtatgtgtctaggaatttatccatttcttctagattttttagtttatttgtgtagagttctttatagtactctccgatggtagtttgtatttctgtgggatcggtggtgataacccctttatcattttttattgcatctatttgattcttctctcttttcttcttaattagtctagctagtggtctatttcgttgatcttttcaaaaaaccagctcctggattcactgatttttttgaaggtttttttgtgtctctatctcctttagttctgctcttagttatttcttgtcttctgctagcttttgaatttgtttgctcttgcttctctagttattttaattgtgatgttagggtgtcaattttagatctttctgctttctcttgtgggcatttagtgctataaatttccctctacacactgctttaaatgtgtcccagagattctggtacgttatatctttgttctcactggtttcaaagaacatctttacttctggcttcattttgttatttatccagtagtcactcgggagcagcttgttcagtttccatgtagttgtgcggttttgagtgagtttcttaatcctgagttccaactggactgcactgtggtctgagagatagtttgttgtgatttctgttcttttacatttgctgaggagtgttttacttccaattatgtggtcatttttagaataagtgcgatgtggtgctgacaagaatgtatattctgttgatctggggtggagagttctgtagatgtctattaggtctgcttggtccagagctgagttcaagttctggatatccttgctaattttctatctcattgatctaatattgacagtggggtgttaaagtctcccactattattgtgtgggagtgtaagtctctttgtaggtctctaagaacttgctttataaatctgggtgctcctgtattgggtgcatatacatttaggacagttagctcttcttgttgcattgatccctttaccattatgtaatggccttgtctcttttgatctttgttggtttaaagtctgttttatcagagactaggactgcaacccctgatttttttttttttgctttccatttgcttggtaaatcttccttaatccctttattttgagcctttgcacattgagatgggtctcttgaatactgcacattgataaatcttgactctttatccaatttgccagcctgtgtcttttaatcggggcatttagcccatttaattattaattatttttgaactatttcctttgtggtcactctaagctaaccatatataccttaacttatcagagcttcaaatttatactaattctagtgaaatacagaaacataaatcctatgcactatatagctctatttatttctctccctttttgtggtattgttatacttattatataatatctacaaatgttaaaacttaaaagtatactgttgtaatttttactttatataaatttatgtctttcaaagaagctaagaaaagagagaacagcaaatacatatcttaacttctgctatataggtccagcattccaaagatccaaaattccaaatgcttccaaatctgaaagtatttgagctgacctgatgccataagtggaaaattccacacctgacttcatgtgacaagttgcatatactatttataaatattgtaaaaaattaccttcaggctacatgtttaaggtatatatgaaacataaatgaatttcatgtttagacttgagtcctgctgctaagatacctcataataaatatgcaaatattcaaaaatccaaaagaatctgatatataaaacacttctgttcccaagcattttggatacggaatactcatcctatattaaccttcttatttatcatttctgttttttttttttttttttttcatttattcccaggtatttgagttgccatgtggagtcctttccttagcctaatactgttttctctcaccacctcctttttattgttattgataaaatactatatttctataagttataggcccaacaatattattttatacaaatgctttttaaaaaccagttaagataataaagatgaaaaaatgtgaatttatactgtcttaataattatatgataatctttactagaattcttttgtgtgttatgtggatccaaattactgcctggggtcagtctcagtctgaaaaacttcctttagcattttgttaaaaggtgggtctgttagcaacaaattctctcagttttaatttatttgagaaggtctgtttcatcttcagttttgaaaggtagctttgctgaaaaaagattcttggttgacaggtccccctctacactcctgctttaattcctgtgaatgctatcccactgtctctggcccccagtttcctctgagaagtcagctgttaatcttactggggtttcttgtagaggatgagtcatttttctctggctacttccaagattttctttgcctttagcttttggcatctttactataatgtatctgtttgtggatctttttgcatttaccttacctggagttagtggaacttcctgaatgtataagttaatattcttgaataaacttgaaaaaattttagaaattatattttattttcaatttttttggctttctctcttcttctggttcacctgttgtatatatggtgcacttaatggtgttccacatttctcaacagctctgttcattttcttcatttttttgtcctctgtgctttagattgtatgatctgtattgatctattttcaagtttgctaattctttcttctgccagttctaatccactaatgggcccctctggtgaaattttcaactcagcaaaatttccatttggttcttttcataaaatttctttccctattgccaccatactttcgttttcttcatttatcacacattcctttagttctatatttataatagttactttgaagtctttgtctgttaaagacaatatctgactgctctcactggcagttcctgtggcctgcttttattctcagtatatggattgtatgtgtctgtttctttgcatgtcctgtaattttttggtgaaaattgggctttttaaataatgaagtccactcctcctcttgccctctcactgccttagatattgcttctgaggtgatgtaacctcaggtacgcccacagtctccatgtgaagacaatggttttggcaggactctctttgactgtccctttccctgatcacactcagctgttaagctccactaattaatttctgggtgattgttttaatgtttttagtaatacactggggcataaattgctttaaggactaatctaatcaaattcaggctcctttgaggtcagtgcttgagatttattctgacctaagagctctatcccaaagtgctgggattacaggtgtgagccattatgccaggccaataaatgttattttaaagcaatcactggaagtaaggctgatgagactgaaaacaaaaggagtagaatcaaaggacccctaccggtttgcctcaaaaatcagcttagatattccagcaaaaacctgaataaaaaaagtatgatgacctctcattacttgatatttaacaaattgcctttaatactgaagtcaaattgaacaaatattctttgagaggttaacaaatctaatcaagggaagtaacccttaaataaactatttgcctcaaggggagaaaaaaagccaaaactaaaatggaccaaaacatctcagtttttaaccattttatcatacctaatctgagctgctagctggagtttattctttaaccatgacccatatcaagagatataaaagaatcacatatattttgtaactatccattaaattgaggggaaacagtagtttcttaacttgtaaaaagaaaatggtaacaaaaataagcttacaaacaaaccttgtggttcactgactaacaccaagcattttaaaatgccagggaggagtagttcaacttcataaatgtctgtgttagtttccttgaagagttggaggatgaaggccagaatggatgctaagcgaggaggaggtgaggaccccttatactcaaggtaggatttcctgaaaagaagcaaaatttgtttattctctgcttaaagcttcaatagagcaagaccaaatggcatataatttaaagatattggcaaaatttaccccccaaattaatacagtgccacttgtataaagtatgtatattttaccatgctatcttcaaacataggattttagaagcaatgactgactgtatatctttctggtgtgttctgagggccaaagcacaatatagtcacaaactaaattgaaagcaaccttgttttaaaatgaactcaaaatccaaatgaaagcctaactgttaatttgcaggttttttttttccctttctaatacaagtctgatctcctccattgggtcctcaatgccgcaacattttctctaatgtcaaatttgcataaagaaatctctcttcatatctatttatttaaggacttggaaggagtcttatttttccaaacaaacagaggactgtcctaggaataagataggacactcaagctttatctccttccttcctccagcaagttaaagactcagagaactaatttaggatttagcattatctctcaagacaagacaaaatttagtactagaactcaagagcgatcataaggataataatttgactcatctttgtatattctcacctcttagaacaggtccgggcccataacaagtgttcagtatacatttattaagtgaataaataaaagttggaattgcttagtttctacaaatgtctagacaatgtgaaaatctgtcaaatacagctaaatataaactagacatccatatatatatatatttgcaaagtaataataaccataaggaagagaaaccactaagtattataaacataaggacaggaactatgtcttagtaattatttctattccctacagtgacttccaacaaatactacatattagaaaattcattctttgaggttttgtccaattttgtttactgctgaattcctaatgcctagaacaaacatatattgggcgccagtggaatgccaggtacatgtctaagaacaagaatataaaattgaataaaatatggtctctgaaagcaagaggcccaccatggagtggagaagttaaatgagaaaaagaaaaagacaattataatatagcataatggtgcttttgacaaagataagcacagaattctcaggaattcagagaaaagagccctaactcagatgagggagtgcaggaatagagaagcatggcatggaagaagtcatagaagacaatctctatatctttcctgagtattaaaaaaaaagccttcaactataaaccacaagaaaaacattttcactgtgtgttaagtaaataggaaagtcaactaattctgggatcctaaacactggggttttaaacagttttacagattcaatttcacttcagcatctgtcatttagtttgtactataattacttatgcaatatctcaaacactgtgttaggttactacaatcctgttggaaattcagatacaagtaaggcaaaactatcataattctgcaaattgagctgtacagggcatatgatttcaaaaaaggaaacatacatggtacactgacatatcaggtgtaggttttataaaggatacgtgggatttagcccaaaaaaatgacattttaatggagaaagcaatttgaataaagctgtgacatagggaggtatgaggcattttggaggggcaatatgaatcttattaggggttgtatgacaccatatgtaatacatttggaaacggtaagtgatggattgcagagagctaaggagcatgaaatttatttcatggacaaaaaagatattgcaggtttaatggcagggaagtttcataatgaaagagtattttaggaaaagtaatctgggggcattgtttagggtggactagaagaaaagactagagatgcagaaagcagtcaggagattctgacaatagtctaggtataatgcactaagggaagagaaataggaaaaggaggacaggattgccaaaggatgggcaaggaaaggaagcaaagaagataaagcttccaaacctgagtaacaggacactaagaactcaaaaaggtgagaggggagacagattttaggcatggaattctatgagaggtaacagatattattgggtcattaaaaaacacagaaaactaatactagataagaataacatacatcaccatagcatcttaaagtttaaaagctaatttcatataaaaataaataatacatgaaggcaatgacaaaacattttttattactgaactttctaatgttaaagttaaaggatatagacttagtagaatatttaagaagttttgtttttcatttgcttaataaaactgagttaagactaaactaacaagacttcagggtgcttcatttccaatattagcattcattttttcacttaattatctttataaaatataattactgtattttatttttttgagatggtgtctcgctctgtcacccaggctatagtacagtggcacaatgtcagcttactgcaacctctgcctcccagattcaagcaattctcctgcctcagcctcctgagtagctgggattagagccatccgctaccatgtccaactaatttttttgtatttttagtacagactgggtttcaccatgatggccaggctggtctcgaactcctgacctctagtaatccacccacctctgcctcccaaagggctgggattataggtgtgagccaccacacccagccaaatataattactgtgttttatacagtataaaatacaaatattgtttatctgatgaaaaactaaaaagcaaaaatatacctttaggacatatataaggaaggtaatagctacatagagaaaagagaaggaatttaaagagcattgtcttaggctgccataagcaaatgtcattttaataaaatcttagataatgcttctcaggaaaacaaaaagcttctgaactactagtatcctaagggttgccaatatgtttgaaatgccactttatcactttaatagagcttaataatttgtacataccacctatatttaatatttagatgtaccttatgacttgcacaatgcatttctttagagatgatattggtggaatagtggctgtgtttctcaatgccagcaaaacaggatgttgtccaagatctgaaacatatggtgaagctggaagaaatcgcccaatatactgctcaataacattccctagcaattgattcaaataggcattcggattttgagattgacaacacacgatacacatgccctacaaggaaaaaaagtaagaaatactaagaggtaaagtttcaaagaacaaacaatatttagaaactcactaatgaagtccccagcattaataatcatgtgagaatataaaaatcaaaaaggatacctcacgtaatccacagataatgtacatacgaattacaaggagttaagcctgggcaatacatatgatatggcatctaactaagcatgtgtgtctgaggtgtggacaaaggaagcaggggagaacagtaggaagacaaaggcagattcttttcctgtaatcatcagaacacttgaacatcttgctcatcaactacatttatgtgtacttacaaagttataaaacacctttaggtcatttttttctaggtactggttattttgtctaagactatacaatttttgctaaaagtcttccatgctaaaaatctgataatcttttttaaagtaataacaaagggcgaggaatatggaaattaagactcggaataacaatttacttagttttcctataacaggcactgtgctgtgtgctttatattcactatttcatttaaatttctcaaagaaccactgagttagtaatattgtatctccattttacagctaggataactaaggtttagaaaagtgaagagtttaatacagtcacacagaactcttgatatctggttgcatgtctgtttatttaatctcttacatttgtatagcagttaacaaaatactttcatatatattacagtatttaatacttaaaccaatactctgagagaaaataatgttttctgctagtattagtaaatattaaatgctactaaatatagataatcaccaacacagcaatacattatattataaaagttaactcttaatttggtacttggtgactcacaacgtattttccaagagaaataatttaaaatgtttgaagtctccattttagttgtaaacgggtacttacccaataagaaattctgaaagtttatttgtaatgaaaaatagcatacagctgttaaaactgtaccaaataaacaactgaaaaaaatcaaacaatgaacccctcccccaacccacccgccaccaccaactctgtttcttgagtagtttaaggaaaagcacattaaatcagaagaagatgaagtaataaatgaatattttctgaaaattccgaagaggagagctgggtaccatgaagaaattaaagacatagctccagttctaccaaacagataatacaccaaacttttaaatttaccacttacgaagcttaagagaattcttattaaatggactgtttgggtttaagaggaccacatggaagaaatattccagactctcctgctgctcaccactcccctctattcatctctccctctgtgggattggcggttcaggctgtggtgtggctgcctcccctttttgtcattctgctagattaacacactaaacttcattttaaatgctattatgaataaaaattagagggaaaatttaaaacttctcaggaatcttaaaactctgttaagaaatacatctttgaaaaaagattgttacataatcaaaatccattttccctttcctcctcagcttcccttgttggacctcaaattaagaagcacttatctttaacatcagacactaatgaataataaagtacacctccagtctcatcctttcctgaatggcagatcaatatttccaactgcctacctcaaactaaagctgctcagaaaccaatccttaccttcatcccgacatctccaggatttcccacgttagtaagtagaactactatctacgcagatagccactctggaatctaggaagcatttcacttctttgagttcctccacaacactcaattagcaagtactcttaatcacagctcccaaatgtttttgaaatctgctgttatgggttttattcccactgccttaggtcaaaaccttctgacaatatgtggattattacaaggaactagttaccactgctttccaaaacctccacaccaattatcttacatatgaccaccagaatcatctttctaaaatgtaaatatcattatgtcacttctacttctctgctccaaattcatcaggtccccatgtaaaagattaagtccaaacttcttaggatggaatataaagccctccattacatggctcctcccatatgactctccagccacaacagaaccattctatattttcttaaagctcatgcccttgtacatgttgctccctctgaaatgaaaagccctccaactcctacccattttgctcttttacctctgatgtcctctacagtgtattctcttatatctcctcacccatagtctaatagatgaggtctgaaaaaaaaaatactgagcacactaccataagtgtctgtgctcatctacctcctctctcaactttaagctcctctgctttttcatttttgtttccaaagccaaacataaaagcaatttaaaatatgttcaataaatgtgccacacaagcatttgagattataatgtacagtttttaaatctgcatttagtaaactatgtttttaaggcaaagtttcaatattttttttttaaacttttaagcaaccacagatactatacctggagatacaaaggaagacttttctgaattgctgacaacataggtgcaggcagttccttctcttgctgtaatactgcatgtggcagcagtaaacaatctatgatccggaatagtaatttttgggctttagaagtggcaaagatttgtgcccatgatttcacaagaattcctaacaaagaagagaagtaacagcatgttgttgttatcctctgaccagaacattttgtcacttaatttaaaaatttgtattgaaagcacatgggaccaaattaaagtagggaataggaagagacatatagtagaagtaacaaatatttatgtcaattcatatatttcactaaagagacaaatttttcatagagttttgggccaaggaaaacatacattttccgagcaactggcatttaatatatacactggttaagtatccctaatctgaaaatataaaatctgaaacgctccaaaatccaaaagtttgtgagtgccaacatgatgatcaaaagaaatgctcattagaccatttcaaatttcacactgttggattaggggtgctcaactggttaagtatactacaagtattccaaaatccaaaaaaatctgaactccaaaatacttctagtcccaagaattttagacaagggctagtcaacctgtttacactcacacatacagtggaatatatttatacattatgtgactacattggctgaatgttgaaattattcaggatttccctttctgctttccctctgagttgctaggatgcccaaatgcaaattaacaatccaccttttaaagaatactgtaggattatacattatggttttatatgcatactaattttccctgggcctcaccatgaaactctatatttatttgttggtacccctatttcttcatattttaatcttacatgtaagtggcctcaatccagtttgcaacagaagtataattaaatttaattgttaatacatggaaagcaggattagctataagctaatcacttaacctccaccaacttcagttaacctccatgaacttcagtttttacacctttccattatttaatataaacaaacaaaattttaattctgaatgaagagaaacagatttctttgctacttgaaatatattatggcttccttggtgctagaagtctgttaattgccacatctgatgataataaagcttaacaaatgagcaccctttgtttaataaagtaattaagagcagatatataattcccattaggatatattattactattgaggtctccttactgaaaaatgaatttaaaaacagattaaatgcttatccaaaaagcacagtggtacatctactgcataaacttttatattttattccatcctagaaagcaaaaacgataaaattcaaagtcatttccatcaaataaagagtttaaaatttaagctctgaaggaaaaccaaaatatgcttatggaaaagtatactgatgttaaagaaaaaaactcaacaaattatcacttttaagaacaaacagcaacattcatcttttgttgtaaaaggaagtacaataatcaatcataaagaaacaatgttcacttagcaaagttttaaataatgctggcttgctcctcatttcttcagttggtggagaatttcagtatgacagcaatattagaagaacttatattctaaaaacattaatatacctgtaaggggaactgctatcatcactggcatatgaaatgattcttattactctcaggtgcaatacaggtatgtttcactttctacagttttagttacccgtgctatagggtaccacatggtatagtttagttaccggtgatatagggtaccacgtggtatagtttagttgcccgtggtataggataccaataagatattttgacgagggggtggggaaggcagtcagagagagacacaaagttcacataacttttattagagtctattgtcacaactgttctattaatactattattagttattatgttaaactcttatgtgccttatttatgaattaaaccttatcataagtatgtatgtataggcaaaaacacagcatacataggattggtactatctgcggtttcaggcatccactagtggtgttgaacatatccctcatgaataaggggaaactactgtatttcattttctgcaacggttgaaacactttgttgaagactgtaagctttaggagttcatataaggtggagatatttgttttactccttgctatcagacacctactttttaggtttcagcaatgaatatttgtgtgtgtgttattaaaaatgcaaaatggaaatataaaaagatttttaaagtaaaaaactgggaaaggtttaaatacatacagtacctttgtaaaaacctaagtttttttttttctttttctggctataaatatattatttattaacaaataaaactgaaaatacaaaaaaatttaatacaatctctccattcaatgataaccactatacaagctcttgagtatttactcattttctatcctctgtattttctatcctatgtattttgcctactttctaccctacgtaaaaattgggatcactacaatatacatttttaaatctttatagttagaaagtaattttgttcatttaagaacattaaaagctgcgtacagcggctcacacctgtaatcccagcactttgggaggctgaggcaggcaggctgcttgagcccaggagttcaagaccagctttggtaacatagtgagatcctgtctgtagtaaaaatacaaaaattaaccaggcatggtggtgcacatctgcagtcccagctactcaggagactgaggcacgagaattgtttaaacccagaggcagaggttgcggtgagctgagatcacgtcactgcacttcagcataggtgacagagggagactctgtctcaaaaacaacaacaacaaagaaaaacaaaaagaacattaaaaaatatatactattgctagattaataaagtcattaaattccataaatatttatatagtatacactatctcctactttggagctctttaactaatgtatccctaactctcaatccagcacctgatacataataattgttcttttttgttcaaaatacatgacaatgggaataaaaaattcaagagatggctactacaagtttgaaatttggtgggggcatgtcaagtacacaagtaattttaacaaatggcaaactataaataatatcatatcacaagaaaaggatagatgaagtgtaatgagagagatgatcaagtctacttggcaatgtgggaaaagtggggaaatttgcacttggcaccaaagggtcatgacttgaatttcaattacaaagcaaaatggggaagaatggccaaagagacagggatgattgaaagctttatacatggaaacagaaaactatcagatatgaagaatgagaaaaacaaaacaaaacaaaatctacagaggagagaagttgatggatccaccatgccttttcagaaataactgagctacaattaagatcacagatgccttctccttaatatgaaaggtgatttcatcaacagttctgtgcctttcactagcagtcttgcaaccttgtaagtgaacagcagaggtgtccccagttaggaactgtcaaggtaaatagagtacagtgtttcagtggttaactccttccctcaaatggttatgctatcccaaccccaacacattttaaaacaccttggagctctccaaagtttatactttgctctttctctgttttattctaatcctttaacatgaagaaatcattaagttacctatcctaattcctaacaaataaatgggcaacactgtagcaatatactcttcctagtctttgaaacctagacaaaaggaaagaatacagatctgcgcatggagacaaaaatcaacaaggcagcaaagcaaagaaagtcttcaatttttcctaagtagaattttgtcccatgtctatatcagacatttatcttggcaaaaatctaaatctggaaacagaaaacttttgtagacactaataaattataagcatgaatgccaatatatttattaatgtgtattttactattaaacttataaattctcacttacatttttctctaaaattaagatgcctgaattgctatagcttttcctgtaatttacatcttctatatttacacattttcacattcgcctttatcttttacaacaaagataaaaggtttcagacaacccgaatcaggcttactcatacattcataagattaaagggaacagataaaaggttttgaccacagagaaataaaggaaaaaaacaaaaaacttaaattctatataaaaacttctaaggaaatctttctcatttacctttatccaattcctagttttggttagcaccatggttttcgtgaaaaaaagatatgttaatcactgacttcctaaagaaagataaactccattgttatagaacgggcatagaaaatgatttctttttgaaaagggaagagtattgtgagaaacaagatttgaagcataaatatttttagtgctgtattaaatcctatctccttcatacagagcagagcatagaaatagatgtaagcgatagttttctgatgtttttaattctaacaatagataagcgtttttttaaaaaaggtccattctagttattcaggtattgaaatgtgactcatgacagactactgaaagcaattggtgccagcatattttctgtattgatcataattttaatattaaaacaatcaaaagtattgaaaagagatagagcaagacagagatacatttgaaggccaacatgaattattttaagctaaatcactgtatttcagattactcttatgattgtatggagggtagtgatttagccaatatatacctatccatcatgatagtataggctcaacctaaggaaatgttactagcaaaataatgccaggaatacatacccatcattccataagtcagctgcagccctgcactgaaaactttttttcccaaataaggcttaatatattttaatacttcaccaaggtattccaaggactttgtgaccatggcagatttatcagaaagtgtctggacgttcccgtaagttacaccaacagcctataaataaagaaaaacattatttaacttcccaaagtttataccataaagatttggaacataaagataatttttctctctttttctacatacgcacccataccctttacatttaagccttcatttgtaaccttccaataaagagacataggaattaaaacacaagtaaaaagaattaagtcttgtcttttattattaaaataaaggttaaaggaagaaatcttaaaaactcaccaataactacttatagaagggccgacttagcaaaatatcagtgaaaaaaaaatgtgaaacttatgtacacataccttgtaactaaatcacatcatgacttccagacaggttggctcaccatatttcccagattactaggaattcaaaatccccaaattcccctacaaggaaaacctacaagtaatgccaaatttttacaagcaaaacctctaaaaagttcagctttattatatgaattcacttttcttcctagaattttatgagccatctgatgccagcttaacttcttggaaaaaaaaaggatgggcagagaaggtagagatggcaaaatggagagtggtagagagaaatgtgaggtgaatcagtaagagaagaacagagacatgagaagaagaggaaaggaaataaatgagagaataaattgaggaaaggttagaataagcaaggggtgaaaggtcacaaaagaatcaagagaagactggctaagagatggattagaaagtttaaggaaagtggccggtgcggtggctcctcacgcctgtaatcccagcagtttgggaggccaaggtgggcagatcatgaggtcaagagatcgagaccatcctggccaacatggtgaaaccccatctctactaaaaatacaaaaattagctgggtgtggtggcgtgtgcctgtagtcatagttacttgggaggctgaggcaggagaatggcttgaacccaggaggtggaggttgcagtgagccaagatcgcaccactgtactccagcctggtgacagagcaagactgtctcaaaaaaaaaataaaaaaaaaaaaaaaataaaaagaaagtttaagtaaactaataaaattttcaaaccatttttgagaacttataatgaattccaatgacccaaattggaccatgaattgcaccaatacaaacagttctgtgatttttcttctgcagcactcagcatgtaagacaaaggaaagagaagaggtggttgcactgagccaaggttgagggtttgtaggtgtgaccaaaagaaaaaagattcaagattgtgagaatgttggtaagagtagctgaagtaaggccctaaggggtctaattatggtgaatagggaaggaagtgaggccttgggagaatgttgtcctaggataacagagaggggaagattacagtgtggtcactcatgagctggaaggacagatgatggtagtcaatgagctttcagatgctccaagagattccactgctccgggtttagtcacggaagtgggtggatgaagtaggggagaagtgaaagactacttctttcactgaaagactgaaagagtactacagaagctttgaaatgaaagcttaatagaagtcatccatggtgacattaaagttggacatgctgacaataaaatgtgaaatgaaaaagataagaaagtcagtgaacctaaatgagtgactgtgagattagcagataagaacaagagatatacttgactaatcccattcctctctatttagctctcttccctttgttttctacacttctttcccttgactagacgttctcaaactctttggtctctgttcccttttgcacacttaaaaatggaggatcttgaagagcttttaattatttgggttatatctattgatatttatgatattagaaaattttatttattaattcattgaaaagtgataatgaacattacatgtaagtaacatattttagtgaaagactatttcccaaacaaaaaacaaatttagtgagaaaagtagtattttttaacatttttacaaatctcttttatgcctgacttaataaaagacagcttgattcttatatctgctcctgtatgatttattgtggtatgctgcagatgaagaaaatacagcttcaaaaatatatgtggctggaagaataagaaatattttgaaagatttttcacataaccatgagaattcctctttgctattataccaaaacttgacaagtggtatttcctacagattagttgtaactaaaccatggtgtctgaaaccatgtcaataaacattttatattctgttaaattaaaagccattggtctatcctgtattttgagtgaatcttttacatccatgaatgctttttaaaaagcctatattcgtcatttggaaaattgtggttcactgagttacacagcttcccaatgttgacacacttcattatttatatcaggaaaaaaaaatcacacctgctaataccaccaccattctcatcagaaaataagtatcgggaagctctcaagatcacgatgacaaatacaagtttctcaaaattctaattttcttgaaagcttgaattatattattagcaacaaatactgtcagttgtttgctttgaagtgacaggctcacttcattcattttttgagaaaatgtctgccaaatagccaagtctgaataaccatactttgtcagttgttcttttaagataaaagcagtcagttcagcttgcaactcaaataatcacacaagtgcttttcatttaggcaaccacattgctttggtatgcagcaaaagtgctttaagtgcactttgcattgtcgttcacggaatactgaaagtacatgtactcaagagtcaaaacgtaataaaataaataattttactgcttcattgaagatattcttaagtgaaactggctttttcttctgtaaatgcatggcagtatcaattataatgaatactagtataatcttgggccgcagtgttgattcatgtaaaagattttacactatttgtgcaaatattaatactgttttgagcaggtggtatcagtaattcccaggggtctatggactacacttttgaacaccagtgccttagacttctcaatattgctctatgcttaggcttaacttccctagcctaaaaaacatgtatttctcggtaccttgataataataacttagatgtcatactatcatttctgtgcagaaaagagttaatacagcagacccaagactgctactcttaaaatgtcctgcttgcaaggctggctcttggctggtatttggggtcttagattttgaaaagcttcctacaattccttgatcctaaactggtctatgcaaataatatggcttatgctgaatacctgctttccttctggaactggaattctctaagtatgaggcaaagagggcatacgtgaccagtccccaataataaccatgggcactgagtcactaaggaacttccctggcaggtagtgtttcacatgtcttgtcacaattccttgctgaaagaattaagcatatcctgtgtaatttcactgggaaaagaatcttggaagctgtccctggtttcttcagacttttcctcatgcatcttttccttttgctgattatgcttcgtatccctctgttaataagtcatagctgtgaatacaactatatgctaagtcctatgaatcacagaaccgagggataatcttggggagacctgacacaacttaaaaatgaataaatttaaaactgaattcctcacctacttctctgtcaccctaaatcatgatgttcctatttctccttaaggtatcatcactcttttagtcaaacacagcatttatttcatatccattcagaaatcccacaaccattcaatctttgattccttctaaacctcattagcttttggccaacagttctctgcacctttaagttatattattgttacttattttcattaaaaaaattatttaaccaaatcatatctacttaaaaacttacaaagccttcacaatcttcacaggataaaatccaaacttcttatactaaaatgctttaaattctttacctactgattgatctgtcaaccaactggcacttagcatataatgccttgtgttactattttagtctttgtgtatgtcttatatccacagagaagtaaaggccacctgagataaagaactacttcttttgatttttcaaatccctacgaagttctagcataatattatctagcattcagcaaaaaactcattttcttagtggtgaaagaacaattaatttgggctagatgaaaactatcaatgaagaacttgatttctagctctatttctgatccattatagctcctagcacaccacaggcatttaattgcaggttcagatccaatcaacaactaaataagggtccaaatggaatgtgtattttacatctgcatttactattatcaaatatttttagagattgcatgacatctctaattgtcatacaattgtactttaacttaatagaaaccaatggaagaattaacatttatggaaagagcttattgattttaattattttcactgcagctaataccaaccactctgtgggaaaataaaccaacttttacaattaatagcttacaaaagacactaatccaaacacattaacaactaggtttgcaaaacaaacactctcacatagataaatttctgtacaattaataattaaaaataaaattttgaatggtactgtttattatggaaacaaaacaaaacaaatggattggattttaatgctccaactatactatcatacgaagtagatggtgcttatgcctacactgttcgctacagggtgataaacactaaggtgggagtatcatggaatgtttacaaggatattcagttcccaagcatctgaacaatgcggttgtccagcaactgtgtcaatattcctacaatttagattagccttagagtaaagcttttttgtggtattctttagttttattattcttcattaatgtaatttttctgctgtccttaagtgtgaattgtactataccttagattcacatttttcttcctccagaactttataatagcaggcaatcaataatatgattcaatttataagaattcattttatagaaaaactttaagaatacttcaggtttttctgaaaattaattgtaattaatctggacaattatactaataaatgacaaatacctcaaagaatcgaacaagtgcttttttagggtcttctgagatggataaatattcaacttgggcctttgagaaaatactctttacttctgagagattaaatagtaatcttgtcagtttgaccaactgtttcatgtactctttttctgttaaaataaaatagtatttgttatatcaatttatataacatactatatacataaccacacatacaacatatatataatgtatatatgagaagtaatacagtattcttcacttatgacatgctttcttttaaaattcaaatttccacacaaggacttcaaattaaatttctctcacttatgaacatccttgccccaaaagttattcatgtaacaccaactaatataataaaatattaaaataaatttggaggatttttttcaggccaaccttcatgaaaataacaagtggccacaaacaatagctttgggaaaagacatgtcctacagacaacagaactgcatgggacattttttaaaaagtacagatatcactcaatgactacttgtaaagcagaagaaaggcaaaatatctaatataaaatgggagagaattattcataattgggtatttttctttttagggtgttcacagtgtgatatctggttactcgcttcagagttctacttttttcgtgatcagtttctttaaaaaaatagcttgtcacctgagaagcaaatttctgtccttggcttccaaggaaacaagttcttttatcttttatagcagagaagtttgtcatatatagtaacaggaaaataaaaacaaaacaaaacaaaaaaacggaaacaggctacaaaaggaaattaagttctgcttgtattcatacccaattacgaatattttgtatattttctattaattacataacaaatgatctagacagcaaatagctttccatagatacccccatcctccccaaaaaacgtacacttacttaccaactgcctcttccagatttttatctatgagcaaatcatcaggcccagagaggtttttaatatacatttgcaaaacacaacgaatccatgatcttacggttaaggcttgaaaagatacatagcctgaatgagaaagtgcttcacataatgtgctgtagaaacaaattgacaaatatttttaaaacaaaaacgtttcctgagtatagagattaagaagtaaagaaaaacattctaacatccctgcaactccttggcctcattgatttttcagacaaacacactaacgtaggcatgcattgttgaaaatgaatactacagataaacccaaaaagatgttaaacaaatatccttcttttcatttttaatgttataattttcaattttcctttttccactgatggcatatgtgtaggtttatgttaaggaagaagacaagaaagaatgtggctaccaaggaaaaagcaagggcttattataactagctaggtgagataataatgaaggaagtggcaagtagaataaatatcagtgtccgttagaataagtaaacagagaagtagtcatgaacgtatgctctctcactatacggagagttgttactaaaaattacctcacaaagaattccaaaaccatttgccagatttaaaaaataattatttatatgaagacaatgggctggctaaacttggttttttttttctcttttttttttgagacggagtctcgctctgttgcccaggctggagtgcagtggtgcaatcttggctcactgcaagctctgcctcccgggttcacgccattctcctgcctcagcctcccaagtggctgggactacaggcacccgccaccatgcccggctaattttttgtatttttagtagagacagcgtttcaccgtgttagccaggatggtctcgatctcctgaccttatgatccgcctgccttgtccttccaaggtgctgggattacaggcatgagccaccgtgcttggccactaaacctgatttctaacccattcattagtcagggtagagaggatggggatggtcttaacctaaatataaaatgttatgtaatgtccaaaatttttaaaattcatacaaaccacaaatctaaaaatgttttgaaatacctcgaatataagttgtcataaaaaaggacacaatgaagaagaacacagactggttatttattaccttataactttcccaaagctatatagcacctttgcatttcagtttcttcaaatgttactaatacgctaacaatatcattttttaagtagaaattatttcaaattatttcagcaaaagtctttaatgcataatataaatgttcattactattaaagaattcccaaactggaagggattgtaaaagtaatccaactgaatttgaactctcttaccttacaactgaaagcccaatgaaaaaatgtatacttaatgatactgcttattgaagcttccttaggaaaagacttagctcaccaactacatctctcttcatttccactgatgggcagcttggacaaaaactacgttaagatgagggaaaataaaataaatacacaggcctaagaggactaagatctcataaacctacacatatgccatgtgtacacacgacgtatgtgtaggtttatgctaaggacgaagacaggaaagactatggctaccaagagaaaagcaagggcttattataactagctatgtgagatagtaatgaagaaagtggcaagtagaataaaaataaaaaccctagaaaaaataaacagagaagtggtcatgaatatgctctctcactctacaagcagttgttactaaaaagaggactaagacctcttaggcttgtatatttattttattttctctcatcttgatgttcttattcaagtcttcctgaccactctacactatttctattgtaactttattcattctatttttttttccaatgaggttcctcagatctcttgtgtaatgtggcaggaaatacttatagataaggaagacattgttcaggtgaagtatcttgttcatgatctcatgagttaagagtgaaaactcatgatctcatgagttaagagtgagttaacagttaaaaatctagcagcaaaaaggaaagctatcattaaaacgaagactgtaataaataccagtatcttacagattcagtaataataaatgtgtaatttctttcacagtgggatgtgtagaaaggtcacttcagtatgatgataaggcagtcttacaaaaacagttttgaaagggcttaacaaacaactttttttttttaaagcaggccacaaaatataagttagtgttcttactattactactgtcgaaaggctgatatatctgaaagcaaaaacctgacaaagtgagagtatatgtagtagagatcagtcctcatttgtgaaaattcttagcttcctaggatactgatctgtcacaggtttgcattaatgtgtatgcctgaaataaaagcacgtacctattttgtaggacatgacttaaatatcttgctacaacttgagggcagatgatatcatcccaaccaaaaagttgaataattgatataactggctgaggctgaaaatctgatggagctgtgcttggcatgtccattgctagcaaagtaaagtctagattcaaaatgagagaaacttaaagtcaggaatctttaaaaaccatttctgacccacacacccctggccaattataacaagtgttttttttttttttaagtaacaaataataaaatgttctacttagaaatgtagagcaaacaaaaagctaaaactgaacaaattcatgttgtcatagaaatttctgtagcatctagatctccaagaaaggcctagaagaatttatctctgcattatcattacagatctataatggctccctctaattacaaattctatgcctgaggttttggctaatgtgcctccaccattcaaaagacctatttataaaatatgtccagcatctagtcttctaaggaagcaaatttgcctgtcatctgccacaggtgaacagttccttctcaccttagacactggacattctcttctattaaacagagatctcctacaatcaatgacactccacttcctttagaacccacaaagtctaggaactagaattccttagttaaccatgctaaacaaatatgttttattttgtgatttttcttgggaacccataaactcattttgtatgatattaatttgtttgccaatacattatttattaagaactcctatgcagctttctgaaacggggtggctgtctattttcccactccccgtataccacttgatctaccaacagggtgagattactccttggtccacattgctgcttctagactattctcccctcttcctccctaaaattgctagctttgaatttcatatcatcaggttatatcagtcactatctttgttgcatttacctactacttcctagttcacctcctcctctcattctttgtagactgtagctcactatcatgctctccaacagcactcctgccataatcttttgtgattatttttctccagtgtcatggactcttgatttcttgaactcctctgatttaatgaatctatcttccattctacgtcagccattcactcccatgctgatacccagcgaccttggcattaccagtaactacaatctcagtaatttcaattgtaaagtaccccaatttttgactccaaactagctttccaactttcctcttctcccccaactccaacaattctttgattccatcaggacctaaaatccactgatcctacaaccatttcctcatccctccttgtctccatgccttccctgtccctttttaggacacttgattgcatggtccattattatactcattcatttatactaccaactcttgctcctttcttgatttgtgtactcgcctggaaaaatcatcacctgtttaattcaaactcttggccttttccccacatgtaccagtattaaatggctgaagaagaaccatgctgactgataccactttacatttatgactacagacttcaagtaggctcttagaattggccagcattcctatgacatttccctagtccattcagtcttttattctcttagggtacaattgcatatcttctcttcactcttcatcaacagccagcaccttctgccccttcctcattttcagctgatggactgacttaatacttcacagagaaacaagaaacatcagaagagaactatcacaagctgctaccacatttacgcagttgccttcatctgggctcacttattctgccttctcttctgctactagagatgaactgaggccaagttctctataagatcccattttatctgggcactaaaacaaaagtgactttgtttgtaccatgcaattttccttcactttggagcattcctgtcagcattttaaatatactgaaatgtctcccatgttatttaaaaaccaaacaaaaacaaaccttcctctttgacccctctagctactatccccatttttctacttctcttaaacagtgatattcaaaaagattaatctaaatttgcagtctggaattgctcttttcaccttttctctggaatcatcttctatcaggcctttgcctctccactacatacaaactgctctttcaggtcaccagtgacttccctcttattaaatccaatgactaattctcagaccttatctcacttgatccatctatagaaactgagctgttgatcactttcctctctttgggctccacggcaccacacttccctgctttttcttaacttaccttcattcctctccagtctcctttcttgtttctcctgaccctacaaatctgaacaaaggaataccctaaggcccagtcctcaaacttttcttttcatccatacttgctctatgggtgatctcatccagtttcatggttttaaagaattatttatatatggatgctttccaacttcaaatctctagcttggacctcttcctgaactctaggatcattatctaagtgcctacttaacatgcctacttggatttaatgaacatcttaaaaaaaattaccaaaaatgttaatcttccctcataaaatctgttctagcctcaatcttcctcatctcagcaaatggctatagttacccttaattcctctctttatctatttggttaccgtatcttacccacttagcaaattctgtcatctctaccttgaaaatactttcttcagatgggaaacctgaccacttctcaccacctctactgccaccactctagccacagctgctcatttttgggttattacaatagttccctaactgccttcctgcttttccccttgcctagtcttcctataagtctagcctcaacctagcagccagaggactcttatcactcctctgctcaaaacttttcaacagcttccaatctcagagtaaaaccaaaagtctttataaccacttacaaggcagaacacaaactagctctccattacctcttgatccatctcttagttctctttccctttctcattccacatgagcctttgctgcttccctatagtttctcaaacacaccagacatgttcttgccttcagacttctgcaaagcatggtctctcatctccttcagttctttgcacaaatattacttacttgggccttcctgaccactctatttaaaatcacaactgcctctggccttctgtattcctatcctatattccactctttcccacagcatttatcaccacacattacactatttactcatttagtggtcttcctatgccccaacactagattatgagctccatcagaacaagtatttttgtccttcttctccattagtatctctccaatgcctattaaactaggtattcagtaactttttttaaatgaagaaaatcattctctcctaaactatcaagtctttatttcaaatcaaagccaaagtacacatattttgctttctatttatataccatttatcttcagcatctaagacagcactgactgaactgatgcattattatttttgttgactggcagttgggatgatgcatgtacacaagttatatcatctattaatgactgcttaaactggctgaatatcaatatttattttcatagacattacagtagttggaaaattgttgtcctgtcacaattctttaatctatcatcgtaaagtcctaattatagaagtgttatcagaattcaaaatcttttcaaatttaaatcattagtcttttacacagcactttaagctcagttttcctcgtatacactaggataaatattggtttaaatcttaggtttttaaaactattatttaaaaataaattaaatacctttaaatggacttcattcaagtacatggagttaccatactaatcactgtctattccaatacttcttaacatattttgagcaaaatacccccttgagaagacaatggcctcttcttagaaatgatatatatgcgcatatattcaaattcttacctataatttcatgagatccagagtcccttaaagcctaaggacatgtctttaggttaataatcaaattaagtaaaaattacaacttaaagtagaatctagtagaagtcagaacaataacatcctatatattcagtgtcattctgatctcatcttcttgggattgaagtggtatttattttatattcttttgctctttacacaaattaacttcatcttatacctatgtatctgctcatacaatttgaaaataaactacttgaatcacacgtaatcaaatgctagtttaccttccaaaatattacatgcataagaaaagcttatgtatattcaatattttcaggatagaaaattatcttatttttagtaaataatcatttaatttttagcaataaataagccaaaggatcccaatttattaatatgtaatttgtttcatctttctggctgacaaaatgtttgctatacaagagtttgttactaagaaaataaaggaaaatactgacaaagagtctgcaaaaagagaaattagcaaattaataattaatgctgacctgcagctgcatccgcaagttgtgagaaaggcactacctgtgacattctctgactcttcaaaaatgaaaagaaatgtctccacagtgcactggcaactgcagcaaggtggcgctctttagccgataatgaagactgtacaaataggtccacattgtccctttgaagttcctgacacaattgttgatgcatactcctaaaaagaaataaaaatacagctaacacccttaataaatgcttacaaaaatcttcttaaagtacattttgagctttttccatttatatcatatgagaaacattttatataattaaaacctttatgccaagacattatgcatttctggttgtttgatggatgaatgatggcatattaagcatcataaagttaatgttaactactaatgtcaaccattaattatatgctttttaatatgtcagatccaaatgagaaagaggcagcttcagaatgaaggtctgcattttgcaactcacacatgacaagtgatttttacttaaaatctagacatgaaaacaatttttaaaacaattttctcctgagggctttaggacatggatgtaccaagaggaaggtaagtacaactggcttatgcgtggtattttaaattaaaatactttccttgtttagaagacacaggccttgtgtagtagacaaaactatgctagatacaatcttactactttggtcccaaaagattcataatcattctcacttggtaggcaataatatacaataacaagttgctcttcataaaataataaaacataattcgatactgcctcaaattttgattaatcatttactcacctttgctgattaattcaatcgaaaatttagatatctctagaccttaatagaaacgtgcaggaaattgaggttaccaaagagagggaaataagagatcttcttagtgatgtggaacagaaggcatttatgttgtgcacccactgataatatgattatttaaaactaaatgtacaaccatgctattattcctgtttctgtttatattactgccagatcaactgagtagacataaatgcatggatacatttacatttgcatttttttttcaattatacagaaagcagcaaaaaataaccaatggaaattatggagaagacttcctttaatagagatagcattccactaagaaaaataattaagtactttaaaaaagatgtttgatgtttttaaacagtttaggggaagtggataacatgaaagaactatacaaaacacagaactagcatgtgtatctaaagcaatcccacaaaaagatcaagctggttataagatcacatcttagaatatttcgcataactacccaagagtgagtaaaaattctaagtataaactgtataacattagggccttgagcccctttacattggaattcctggaaaattatgggatattacttaatactacaggaaatattcaaaaaacaagtgaacaaatggctggggaaagagtatacagtaaacaattctcataaaagctaaccaaatatctgctatgtcctctctgtaaaaacttcttgagatgctttcaacttgaactagtggctagagaaccatttcagttcctttatcttagagtgagataaataacaaaccactaaaatctatctggcaactaactcaactgcctatatcaacatagcaaagttcacagtacatttctacacagtggaatccatgtaaaataataccaccatttctactgccctttatagctttttcaaagtatattggtttcaaaagacaataaataacttatggtacttgagtaggatggattttgctcaccatatctaaaaaagccattttatttactaactaaaacctattccctaggaaggagtaacatttctgatcgacctctatatatgtgctagaaattccttaaattaattaaattcttttaaaatcggaacaactctatgagataggtatcattaatcctctttatagatgacgaagctaacagtaggaaagctaaatatgcccaaaggtcacatggctagaaagggctggccccatcatctgaacttaaatctgactctgaagcccacttttctttttacacactaagacatgcacccttatgcgcctacacatacacaagttttaagtgaattaaacattgataaattatcttctctttctacttaggttaaagaaatttcatcccagcactttgggaggccagggtgggtggatcactcgaggccagcagttcaagaccaacctgaccaacatggtgaaatcccctccctaataaaaatacaaaaaaattagccgggcatgatggtacacgcttgtaatcccagcaactcaggaggctgaggtaggagaattgcttgaacccaggaggtggaggttgcagtgagccgagattgtgccactgcactccaacttgggtgacagagcaagactttctcaaaataatttaaaaataataataataataaataaaataaaggaatttcagaaagcttaagaaaaggggctggaaaagccacatgtagctgtgtcttttgaagggccaggagcaacatcagaattctaacattaggaaagactataagaagagatgctagaaaacatgtattcaaggcaataatgagaaaggccaacaaatgtgaaccacctttgacctctccacaacaaaacgttgaggtaccagggagtataagtatgagctaacgtggggataggactcaaagttctgaatccattaggtttaaaaaaaaaaaaaaagccgagtgcagtggcttatacctctaatcccagcattttgggaggctgaggtgggtggattgcctgagctcaggatttcaagaccagcctgggcaacatagtgaaaccccatctctattaaaaatacaaaaaattagccgggcgtggtgacatgtgcctgtagtcctagcttcttgggaggcttaggctggaggattgcttgaggcagaggttgcagtgagctgagattgcaccactgcactccagcctgggcaacagcgagactctgtctccaaaaaaaaaaaaaaaaaaaaaaaaaaaagaataattaattaaaaaaaaaaaaccattgtgaggtaaaaaattttaaagctatagattacatcctccaaggttgagttaaaacagctaagacaagtttcaactaagggtaagacactgaccccaaaccacacttgtgttggaaatgtgcacccactttgtgtttttggatttgaaaagcagctaatatccccgggaatatgcaaaatgtttcctgctcaatagtttgaaagttcaagctttttcagtctggataagaagaaatgattacctgctattttaaaccagaacctagttgtttaagaccttataataataatttatttaagcataaagaaatcagtgagtgacaaatacaggaaatgccaagagtgcactgtaatagaagtctgaaggaagaaccaaatttttgcactatagccaaatagctagaaatactccttgcagacactggtaattttttaaaatcacatgtttgaaccagaaaactaattatacagactactgaaaaataaattatattagatgtgaccactgcatatctgctgaaggtacatttacaaaaatgcaaagaagaagctctgtcactagaggtaacaatgtaaaagaaaacacaaaacatacataaaatattataaagaatgtaatatagttctaggtgatggctgttttatgaggcattatttaccttcttcaacacaaacagtagaaatatgtaagtagattttttgcataaaaggaaaaatatgtgatttctggtcagaaactgaaagacataacacaaggatgtaggatctcccaacacttggcaattgttttatttgagtaaagacagatttcacattaagatcagtttggaaatacaagatcagataaggaaatacacacatgtaaccagctctcttacattataaaagatacaatacagtatagtagaaaataaatttgctgaatgtcaagttattcaaattgcagctctcatggtggaaataacagcaacatccagcatttactggtatttactatgagaccagcaccatgcaaagtgttttataagcatcgtttctcaccctatgaggtaggcataattattattcaaatcttatatatgagaaaattgagacaaaaggagtaattatgctgcgtaataaacatggttattagcatagctatccagagcagtgtggctttggaaaaacaagtaacctcccaactcgctgttttctttagagtcaagaacaggaacaattgttgctatatccacctaacagggttattgtgaagaccacaggaaataacattctgaaaagtttagaagcctatcattacactatataaacacccacactttcacataccaattatccaggtgttcctacgcttctattttagctcagttaccctgcctcctttagctttcctcattatcttcaagtattttcctgattctttcatctgactgctcttttgccccactttccaagatttcctgtttttatttgtctgctacttcttgctttgatttcatgtttacttatccattttgcccccacctctctactcccacacagataccttatccccacagacacacaaatttattgaggcatctatcatatgagacgcatggaaccctgtacctgaaacttctacctgccagtctggtctctcagtttctgctcctccctagtaacttaggcaggcttctgggaacacttactggaccactgcttatagttttcgcctctaatcttggcataccattgtttctcctataactgttatagaataaggtatgacatcctatataccactttcctggtattcacagttgtatattaattatttctaatacatgatgcctcaaagtttaaggaaaattaaaattgtctattgatggacttttcatcacatggaaaaagcataatataataaatatgactggtaaggattaacagcaataattgaattcttttaactctactgcaaacatggtaactttaaaaaaatctttattagtgaaaaatataatggaaaattttaagtcaaaaagttgttccaaaccactatgagtaattattccaagtatcttattgatctgatggaaaactaaatgggaatcaggacactctataaccatttttagcttcagctaaactcactaaaaaatcttagacactgaatcctctcatcatacttgcttgtatctgtgaaacagggcttactctgccttattatccaggaagaatataacataactaaggtaatggcattatcagaaaaacaaaaaatccctgaaatttaaacagtggaagttatccaaaaaatcatcaatccaatcttgtcttcaaaaaatgagaaaaaacaatagacaacttctaggtatgaagagacttttacaaagcctcaatttgagataatggtagtttcaatcctgagtcccaatcctgtgcatgcccaaattgtcagggagaaaccaggctggcaagtagcattcaagcacactttgcaatgcctccatgtaacagacaccccagtacatctgtgtgtctgtgcatatgtggaggagggggtaagtaggtggtagacggatggatggatggatggatggatggatggatggatggatggatgaatgaatgaatgaatatgtgaaatcaaagcaagagtttattgactgttttgatgataaagcacagcagtggcaatgatgcttaccgtcacatataattacagagaaaaataagggctccttgagatgcaaggagaattcttcaaatgagctcttgtctaagacagaaaagatcagcttgtgactctggaaaactactaagcctcagtttttcatctgttaaatggaaataaggccctactgtcctctatggagctgctaaagcattaaagtcacagcatttaggtaaaaatactttgtagacaaggcaaaataatatgcactttcatagactgtaaggcaagacaatatgcactactgcttctaaatcctaataaacatgttcttagaggcattcgaacatcactagaaagatacaagctttggagacagacatactaaagtatacatcctattttgccaattagcagttggatggtcatttcctcatctgctgcaagaattaaataagacatattcaataaagagtaactattagggttggccagagaattaaaaactgtttaatgataatatatgtactagccctattctaagtgtttgaccttttataactaatttaatctgtaggtactttattgtcctcattttatagacaaggaatctcagtacagaaaggataagtaatttgcttgggtcatgctcttagtaagcagcagagccaggatttgaacccaaacagtctagcttcaataccccaattcataatcactatgctacagctgcctcaaataccattttactacacaaataaataatacatgctccaaatgtcgcattgctgtattcactcattcatatgtaagttcttaataaaggtagttataaagtagtataacagctaatcccaggtgatataccagatgcatacatgttaaaagtttaatacttctggggagtgccaggctctatagggattccaaaggtcaacgatgtgtgataatttacaattttcctatgctccaaaattgacttagtttgcaagactgggaaagaacaacaaatcaggaatccagtgatgaacctagcaaaccaagcatgcctataataatgctgtcttacatacaataaaaggggtgaagtgcctaaaatgaagttgcttgcctgtgtcccaaaaacagtaactagcactggtatgaaaacataccagtaagaagtcatcatttttagaatttaccctcatattttcattagtcttgactttgtagatgattatgagtataaaattacttaagtttttcagttacgtttcactgtattttataacacagtagtaacaaggatccacttccttgttattattgtaagtagttcccaatgttgactaccaccaaaattatctgtatatctttctacaaatttactaatgtcttggcctcactaaagatctttctgcaacttcagcattgggcccaatcataatatttactatttgtttttaattcctgacgcagttggtctgacagtctacatttcatttgtttattttatttatttatttattttttgagacggagtctcgctctgtcacccaggctggagtgcagtggcaagatctcggctcactgcaagctccgcctcctgggttcacaccattctcctgcctcagcttctcgagtagctgggactacaggcgcccgccaccacgcccagctaatgtttttgtatttttagtagagacggggtttcaccgtgttagccaggatggtctcgatctcctgacctcgtgatctgcccaccttggcctcccaaagtgctgggattacaggcgtgagccaccgtgcctggcctcatttgtttatttttgagacagagtctcgctctggtgccaggctggagcgcagtggcgccatctcagctcactgcaacctccacctcctgggttcaagcaattctcctgcctcagcctcccgagtagctggaactacaggtgcgtgccaccatgctccgctaatttttgcatatttagtaaagacggggtttcatcatgttggccacgatggtcttgatatcttgaccttgagatccgctcaccttggcctcccaaagtgctgggattctaggcgttagccaccatgcccggccgagggtctacatttctaccaggcagatgctgctatcctatggtgcaccatgctgtgggcagtcaccttcttggctttcctcatctaaaaaaaaagggataataatagtacctacagaattacattaataaaggccaaacacttagaatagatctggcatatatattttcaataaacaatctttgattttctgatcaataattatttcatttattgaataggccttatttaattcctgcaacagataaggcaatgaccatgcaactagcagttcatagactaagtaacaagatcatacataatcctgtcatggaggaggattgaaaatactcctttactctataggtataagtgcaaaacaaagtataagattgttttaccaactcagaggagaaaaacctttggggggaagcacaagaaaatgggcgtggaagagattctcaaaggataggtaaggagtgtttaggtgaaaaggaggaaagtaaaaacacaaaggtatataaaatcaaatcacttactctctaattcaacatatacagcatacgttctaagcagtagggtacaaaactagcaaacagacaaagtctctgccctctggaacttatattctaatgagagacagataattaaacatacaaccatgtaatacctgaacttgtggtgagctttatgtataaaaaagaaatcacagtatggggatgatgattgatagaactttgtacaataacattgtacttgtacaatgatcaggaaacatcttttaagaaggtgacatttgagcaaagaactaaataagtaagggagggaaacacacaggtatatggggaagaatattccagtgagaagaaaaagtgcaaaggtgctgggcctggcacagtttcacagactcaaggaacaacaaccaggagtccaaagtggctgaagcacaatgggtgacagatgaacagcagatgaactggagaggtggcagggttccagaccatgtaagatcttgtgagccatgtaaggactttggataaaatccaagtggataacaagccagaaaagcagaagtgtaatataatttacatcttaaaaggaatatataaaagaacaaggtgtttgaagaatgaaaaaaacgtaaccactttgattataatagagaatttttatagtagcattggaaggcaataaatttaagaatacaaatggtgttccatttgttcagtcatatgttttcttcattcacttcagaagaagttactcagtgctagtcactatgtctgatgctagagatacaaaaatggttaatcctgctgttaaaagaaaaatcaagacttcattcttaaagtggtaagaagacactgaaggattctgaactggagggtgatataatgaaaaaagtgctttgggaaagattaatcaggtaatggcaaacagaatgggtcagaacaagaactgactaaagataaaagaaactaattaagaagcttctgtaaacatccaggtaagagctaatgtgcattttcagttactttatgaaggaaaaagccaacactaattatttcgcattttgtgagggaaaggaaggagcagcctgtcattgccaaattttgggggagaaaaactgaaagttacgagggacagttaattataacaggaggatataatttgatatgaaaagagaaaattgaagtaacactatcgaaaatatttttggaaatctggacctagagtcgaagagtacaatcagactcaggaatcattctacctaatagttcagatcatcttaatgaacacgtcaatgtctgttaattacatgagccattgtactagatgttatcaaatatagtccttcctttcaaagaatgtacagttaagtgccgagacagaggtatgtaaagagtaaaaaacaggattcaaagaagacttcctggagaagacatgccattacctgttacagaagtcatattagttaattaaaaaaataatagagttgcagaaagttaaaataacatgagtaaagcatagtgacatgaaattgcatggtacatgaagggattcacaaacagtgtggtattactagtagacggtattacctttagtcaagtgccagtaactatagtattgataaggaactgtagtactgataagaacaatgtaactatacatttgtataatgtaactatagtattgataaggaacaggtcatagaggatcatgtcatctcaaaaagttagagccaaaagtaaagtctttaaggtagctggaaatgagagaaaaccaacttatatacccaacatatatattcctcatggtttgttcccagataatctaatgcttattaaggattgcctaatatatttatacatttaaacatcctctttaactgcactgtgctaatgttacaatgctagttgtctctgaaatattttcattaaaaaaacccaacctgatgagtatgtgcagtgtgactttgcacatatacgaatctatattactcattacaacatactacacatatatagatacataattatatctatacatttgtatatctatatctatacattttgccaatgcttaagcgttatcttatgctctcatctaataaaagtgagcatgggcagagctacccataagcttcggtgctgacccataagcatcagcttcacctataagcatcattatgaccaacaagttatagtcctgaagttaacacacacaaaaaaaataaaaattttcacgctggatgttaaaatttaagttttacagcatcacaagatgccttcaaggaaatggttgagggtaaaggccacaattaaggcttgggtacatcctttggcattataactataaggaactacagacgtcatcgtaggttagtaatttctaaaagaagagcagaatgatcatcatctgattgtgacaacttgcactgcttgtattcagttagggctcccatttccaggaactcatcctccaaatttaatagcaagtgtgtgggtacaacgtaatgaacgaaagtaaaagagggggagattatggctgaatatgaagctagtcagtctccaagttttctactaccagagtatcacgtgggtaggaccactagttaaggtccaggatctttgtccttggggttaaaggcactcagaggtgagatcatctctgaaaataatctcacaacaaaatgtacatgccttataaaatatgtgaagttgttatactggtttttgggatttcaaatacaattatcttcctcttcaaatgtaaatggatagggtataactgtgcaagcacacatgcactagatcttatccaaaatgttatgtattgaattctcatagaagaaaaaagaatgagctcaggccggggggcagttaggaattggtgactaaaaaagaaagttagaatacaagcaacagtgtgaacaaaatatttatggaatatgccctcattttcattttggaagagaccaccaatctatctaacttagcagcactggagccaataattactatgatattaagaacacctcacaatctttaattttcttcctcctcccaatcctcccccaccctgcatctctatctctgtcttgctttggctattccactgtttgctgaaaaacgtgtaatttttaaaatatggccacaattctttgacacttcttgattctgagagatcctgtgactgatttgaccaaagagcacagcagacatgacattatgtggctataaggtttggtaataaaaggccataaagcttctgccttgtttgctgggaatactcacttttagagccctgaaatgcaatgtaggaagtccaatgaccctgagaataccctgttcgagaggccacagacagcactcaggtcaacagttccagctaagcttgtccaccagccattctagcttagaaactagatgtattactgaagaagaagccatctaggaactggatcctccagcttcagctgttctagtctcggcctttagttactcacagacattgaattagagttacttccagacattgaatcatcctagctgaggctccagacgtggtagagcagataagagctgcccttggcttttcaaagtcctgacctacagaatctgtaagcataataaaaggattgctgttgtggtgttttacccactatgttattacatagtatattatgctctaaagggcatataagaagcactatgtaggaattagagattcaaagatgaaaaagatgcagacctgacctaaaggaattcacacttgggaagcttggggtgggaggtgggaggaacaaagaattttattagaaatataaccacagggtagtatctacaatagtacaaaggcagacttagacaaaatagctgttttaagtctcctagaagccgttcccaacaatctaagaaattctggactggtttcaggacaaatgaatttcagagataagggtaattttaagaaaaactactttatttttctacctatccagcacagaacacctatatgaaacatatgctgagacattttatgtatattatcatatttcctctcaataaactttattcagttcttgctgctttcaaaagtttcattttagttttccctagatgtaaggtattatgtttatgaacctatggagaccaccttttaaagctaattaataaaactatcctctaaaaactagcttagctctcaccatcccagcagtctttttcgaaaacagtagtacatagtcactgctaccctctaatgacaactgcaatcattctaccacattttacatgtggttagtggctatatgctatgtgggggagcgtgcattgcttcaaaaaagaaatttggagtcattttattaaaagtaaagagccaaagatttttgaggtcaactattccacagtaagtaagctagggctgaagtccatttgtgagcatttttcctaattgttggtaataaatttttataaataaagggtctaatggtaatgttgactgattattaactacatcaacccaaatgttcccgtcacagtgaaatttgctttataatttaccttaacggactatgtatcaataaatattgaaaatgtccagtctcttccccccacctccatttaaatcaaatccaattctatgtgaacagattgtaccaatgtataattacaatagctaatgcactggaaaagtagtgttctttgataaataatttttctaaaacctcttaagcattctgcatcctcaacacttctctcacactcaaaaaatgcagtaaattatacaaccagaaactagtgaccattgccaattgtgttaatggatctacaaacctcatcatcagctccaatagtgacttgtttttttttttctttttggatttcaaaactcagtcaagtaagagtcaaaaagtacctagggatattttttaaagtgtttattcatcaaaagtataaccaaaccctaatggaaataacagtctagtcaccattgtaatatagtgctaaacctgcagtacatatataatctttagaaatctgcaaactccttgaaattatgtgtaaagttttgtgtatacataaatgtgtataagccccatcccctttcttctgctttctaccactttataaacacttctaagtacaagctgaatgcctcctctcaatttctctccctgactcctcttctgccttattttgatctcctcactctgtgcctctgttgtagtcaacaatccaactgtaacctcatgtacaaaatgcactaacttaggaggaatgtttaatatgaattctatgtagaaaaagcagtgactaatacatgtttaagatcaattatgaaaatcatcaaaaagtataagctcgtttagaataatatcatatttagcagtaaataaatttcttaattttaaattatggttttccagatatgtagtttcataccacatacattccctatagagatgctatttaccacttttactgtagttctttaaaagggaggaaaagatagaggaggggaaaaagtttcctaaaagattatccattgagtcaatgatctgtggggtttattataaagctccattattagggctgagagcctcaaaggcgtttattatagcactaatttctttttgcaaggcttcagcaaatgaaccgatttatctggtatctgcatgcttagggcttgatacatgctatttgtacatgacaggtttcatctgcgtagcaccattgataacatttatctgcacatcaaaaaagctcatctcctgatgaaaaaaaaatccatgcatatgctgggataagaaatgttaaagtggtgagtaaaagacctgtgatatctcataaaatggaacaaaactacaaaaagatcaccgattcagtatgaatgtgcaacagtgctataggagcagatataatgtcaaacaaggaagaaatggaaagatacttgcttacactgataaaagagtagggctttgttaccatcctgtgaattttaactagaaattggaaaaaaaaattactttcaaataagacaaagtttcataaagctttaagaacaatgcaaaagtagttcaaaataaatcttaagacagtacccattgtttgtaactgccagtagaaattaacccctgaaagttactcttatgggaataagatgtttagattgactgttgctgtagttcaaaattaaaaatctttgataaagcttaaagtccttataagaaagtaactttaaaaaacacacagaaaaaaatgtaaccaaaatgtaaacctgctttcctttcagaaacaataatcagcttacaacatctgtgtaaaagattgtgaaaggtggacacagcctacatatttgaataataatgtaataataaagtatttccaacagataatatataatatattcttttgagaaaaatcagtgtttttctttataaagaaggtatacactgagttaaagagcttgttcctataattcatgatctttcagaacatgtggttacgttaggcttcaatcacctcttactcttactcttcccagcatttggtaatatagacagtggagctaattttctgtcattcaggaagaactgctggatcactaaacttgtatcatcatcatctctgaaacacagtaaaaatcactgttagacccaatagtttattagatcgaacccaccatcaacaatgtcaactctgcctggtcgtgttaacaggaaaatgttttacgagttccaccactgggcatcaatttaacttccagcaccagctatgctgtaaaaccgtgaatgtaatttatatggtgacccgcgtgtgtgggaagcaatatctaggtgaaacttctcacagtctgacaaaatgctttgatttgcaccattcagatgattgagcaaaaagagtttaagcaatcaccaccaatagcctttatctccaaattcactaaaaatttattactctatgagtgcaatctattgctttagagcctagattgacagaatagaaatgactggataaatattacattttcaactggtacacatcttgtccattaggtttaaatattggacaagctatgtgtttaagataaatatcagtcttagcttattccctcgaacaatacttttagaaagcctacaaatgtttccacagtaacatttttgtgcttacatatagcagaggacacatgttcactgccaattaggagaaagtaaaccaagagaccactgtattcttcttataacaacatacctttgtcttttacttagcacttaacacagatgacaatatttacatatattttgctgtgtactaaacaactgagtaatcactcaagctggaaaggacataaatagagctcacccacctatcctaaataacagtttactattcaggccttcctaggaattttaaactagcatagatttcatacagatggctttccaagtagctactcctgtgcactaacagaagggtgtttacctggcaacctctctatccacttgcctgagatcatatacctttaaatatggcaatggatgtttcagatctatatatatagagcaaagctgcgaagatcgctgcaacacaacttttaaatatcctttctagcattatgggagggatcctatgcatataatcttcaatgactttgggttcctgagctattaccttagcgttgactaacctgattaactcagtactactttctagtattttctaatttggttttttagatactgtaaagtaaataatatcatctacagtttggtgatgaaaaaatggactcagaggttaaataacttgaccactaagtaacagaaatggaattataacccaggtgtatctgactccaaagcatttttcactataaaccatctttgttcaagatttaactgtaataattaaactcttacacttgaaggtttaaaagagtacctaatagtaaaataagactaaagcacacacagaattatttataagaggtgtatctttataatactcttaatcaccaacatttattcattaaagaactatactactaatcaagggatgatcaggttaagatgactactggtcattaatgttggcagttgagttcttttccttaaggtttccagccttgtttttatgcattttgtttgccacatcaaaaaaaataattgctttgtacaaaaaggatataaaacaaaaacttactacttagaaacacatcacccatattccacatacaaagctttttgttattgcactactagaagagacttaagcatttaacttggaatgcctagcaagatcttttaagctgtttttcttatcttgttcttcaaaattcgaaactagaaaatcccacttgactaaaaaggcaaaaaaaggaggttgtcccttctagggttaacagatgctttttgtaagattttaggtaagattaaccttttgctcacaacaggactggttatttatttatttattttttttactgtctttaactcaggtaaaaatcaatatacagcgagacaaagggctctagagggtctggctacaccagcttttggtttggctcctgcacaattctacaacatgctgaggctgggaaggattagcctgcttgtgttgagtaaaccgatgatactcaataaacagtttctgttgtaaaccccttaggacgtgcaaagccacactagttggcaatagaccagataagctgcagaaccagctgtaatctcatttagacctgagctgatcctcctgtcctttcattccacaggatcaaagcaaaccactgaggaggcagctgtattatagcagctctgcttgctggatgcagcaaacatttcataaattccactccttgaagcaagtctctacctaatctacccagagctgggacaatcaatgaatttctgaattcattagaccgattattacagggtaaccattttttctttggagaaatataatgattgtatgccaactttacaaagcagctgtttctgaccatctctttcttctggaaggggctaaattttcccccacaatattgaataaaagtggtttaaaagtacttagctcattatatttaatgcatattaacaagtaaacaatatatgatgctaaatttctccagcagtagtagctgactaccacttaaaggcagccaaactttaacagtggcccatactttccatgttcaatgacacagtgaggaatgccaaaccctactgtaacacagcagcatagattaactgatgctccgaaaaaatttatagaaaaagttgttgttgtttattaaacaatattatttggcatgtatttgtatttttttataaaacaggataaaattttcaaagtgttccaaactgacattgttaagtgtttcaaagtcagtcaagcatttcatccccatgcctccccttcaatagaactgacatcttagtatctattactaggaattcctttcagtagaaacctaaatttcaagttatgaatcttcagaaaatttaccatcctcatggttaagataacattaactggatgtataatggacactgaagaggcaggtattaggcatgacatcacagatcactctaaacagtgaacgtgaaagaaatgaaacccaaaacaaatgcatagagctataaaacattagcattttaaaagaatcaactagggctggccacagtggctcatgcttgtaatcccaacactttgggaggccaaggcaggaggatcacttgagcccaggagttcgagactagcctgggcaataagtgagacccaacctctaaaaatattaggcgggggtagggggtgggcatggtggcatgcacctgtagtcccagctactcgggagcctgaagtgaaaggaccacttgagccagggagatttaggctgcagtgagccatgatcgtgccattgcactccagcctaggctatgaagtgagactcagtgtcaaaaaaaaaaaaaaaaaaatcaactataattataatttaatactgaatgtcaattgagaggagccttagagaacatctagccagagagctggcaatttttttttttttttaatatttgtgctttgagggccatgtacagtgtcttttttttttttttttttttttttgagatggagtctcactctgctgccctggctggagtgcaatggcgcgatcacagctcactgcaagctccgcctcccaggttcacaccattctcctgccttagcctccggagtagctgggactacaggtgtgcgccaccatgcccagctaattttttgtacttttagtagagacgggttttcaccatgttagccaggatggtctcaatctcctgacctcgtgatctgcccatctcggcctcccaaagtgctgggattacaggcatgagccaccatactcggccacgtatttttttttttaagagacagggttaagcatttaagtctccctatgttgcccagactaagttgctgtgcctacagatgcaatgtctagctcacatattcttcctgttgttttacaattctttaaaaatgtaaaaaatatcctaagttctatggctacacaataatgggctatggacaagatctgaccaacagtgccttagttttccaatcctttctagtctaaactactcatttttcagatgacgcgacaaactttcagggacatgaattgttctgcataactaagcagcaagtgtcagcatcagaatttagatctcctgagacccactgtgtctctctactgtttcctaacatttaacccaacactacttttcttagaaaatggtgtgaagattctactataattcagaaacacttgaaaaagcaacaatgaaaagcacaaaacagttttaagaatgcctgtgacacgtcaatgcagacagcatgcaaaaatgaccacacattagctgacccaatcatttccaagctaacaaatgctacatttaataatgattcaccttccctccaatcccttcttcagacataaaatggtcccatttaagataatcacctaataacagcaaaagtgagaaatatggaaaccgtaactcttctatttgcaaaatccagatctttgtaataataactccacaataggaaactgcaaaactgtgtaattatactttaattgtattgtgaggcatgcattaatcacaaagtttaagcaccaaggatagaattataataattctgtaaaacaaattccagctagctaagtaggtcagaaccactaacatgcaacaggagacctctgggaatttatcagttaatggctatttatgtgcaaatgagtgccctccaaccctccaaaatcctgtgtagctgaagggtatttctgttaaccaggagcactgcttaactgcagaggcataaattaaagcattttattgaaatgatttttaatttctctactttccttttccacattccttcctacctctttcaagaagcacaatttatagcacacatttaacaaggaaaaaaaaaaaaggctgctggagaatattcaaaactgatttctcctgaacctcgcatgtacacacacacacacacacacacacacactagaccttcagtaaaattaaaggaaaacatgtctcacattaaatttaaaaacttcaatataagcactaaattaacatgctttttataatgaactatataataaaacaaaattctgttttatgttcttatattcttatcctacagaaaacaaagaaattcaatggtgtttgtatctatcataattcttgtcctaacagtcaaacaatatacctatcaaaagtacacttggagaagtggggaaagacttttttgttaaaaagaaagtctctaagatgttttttgaaaggggtaaaaagaaaggcagaatacaaattttcaataccatctaaacatggctaaaagagacactaaacgcccatcataaggaccatatcaaatttactcagtacaaagttggcataaaactaagtactgtccaatgtttagattttaggtagaataacagttatctaaaattactgtttttaatgatttaatatagtggcaatttaaaagttttaagttatgttaacactaccttggagctctttctttcccatcattaactgaaataaaatataacctaaccctaagttaaagacaagtaaaggccaaattaatcatataatatctttaaaattataatactttttaatgtagtgaaacttcagcactttaagctacagtcaaaaaactaaaatgttcgtgagaattctctattttaaatatataggcaatacaactttgtggtaaactctttctcaaaaagattttaatgttccactcatttttccataattgagttttccagagttgtaagtaaattatagcagagcaaatgattctatcaagtttgcttctgattagtttgctccatatcactcctggattcagagggcaataattgaaggaatcaagtgctcctctggtcaattgtgtttgtatatgaaatagggaacagaagtctctggcctaatgctgtgtgttatacttcaatgtacaaaacatgtaagtcataggaattaagatatatttctggcctaaaaacataatttcattacaactatttgctttaaaaaaaattatcacataaatgtaaccatctgttaaaggtcatcaccctatttcaaaagggaactctcagaagctgtaaagcaagggctcacttgaggctctcctctctctttggtcaggggaaatactgtggtcacaccagtcttccagtcacaggaagattctaagtcagatctctgtgtaccaagcactgcactaaggcttaattaaccctgttcagaaaaaataagaccttctcttaactgaagagacaacaaatacatagtcaacttgctgaaggagtacaattaagaggtatgtctcatatttggactatcccctccaaaatctcttaacattacacatgaaaagaactatacaggcatatggaaatcattgaaaatttccaacctctgcatttatatggctgaaactgaagaaaaaatgagatgatattaaagtgttttgatatccttagggtgataaggtcaagagcaccaatgagagaaatcttggaccacaggaacagtgaaacattttatcagtagttaaacataagtaaaagatgtatttaagtataagaagctattaggtttgtctaagtcataattcctaaaatttcctaattactgaaaatgttggttaaatattattgcctgactacatacaggaccaacctgagtcatcagatcattcctttcctttattccctttatcactcaatcccagtcatgacttcaaaactaatgtactctcctacctttatgtatttttaaaaattactttggcatttttgtattattagcctttattaccacaatgatttcctacctagtttccttgcttaaagtttgcttaaagttctctttcaattcattgggcatattactgccagaaccatctatataatcaccattcaacagacacgtcatgcacttttagctggatacctaagtgctgaagttataattatgaataagacaaattcccggccctcaataagtatcagtctagtgaaggagatatttcaagtggtaaatgttctgggtgatacaaatatgaacagggcaaacaagaaggacaacacttgcctcttggggaacctggaaacccttaataggggaaactgtatatttcacttacacccgaaaggaaataaactttccaggcagaaaagaaatcaaggagcatttcaagcagacggattaagggaaagaaacaggtaaggtctttctgtcaaggatcttatgattcagggagacagaacagcatatgaagggtataaagaactgctctcatcacacccctctacttaaaacctatagtctttgatttcctcctcacccaggtctacactctggccctaacttcaaagtccttcataatctggtataactttctactggagcatgtatcctctgcattcatcagactagtttgtatcgctacctaaaaaacatttaacccgtcccaacttccagttcttaagtcactctcctgttttagcatttttttcctcacttctcttcttcaacaacttaggtaattgccactcacatccaacctctttcaagaggctctccctacccctcctccttccttatcacaggtataaatcctacttcttgaatacccagttcaaaggccatctatttcaaaatatctttcctaatcctttctttccaccctttttcttccttctcctactgatgaatcccccaaatatcttcaagtgttcattactcattaattttcactttacactagttatacacatgtacggtttactaaaaaataatttccccaagaacagaatctaatccttatttttgcacacaaaccaaaaagcattttgcactaatagcactcaaaagcgttactgaattactacagtatcccactactactttttaatattctgtgtgctatcatatactccaactagagaatatcttgtgcttttctcatatcctatctagtaccggtaagagagtaagtccatacaaagcacccaagaaatacttgcctgggtactcttctaccttcactgacctcaagctatctacaattacaaccaatttattagtaattttctcttcaaatctctcctcaacccaaagcaaaagataatgagaactcaaactgcttaaggtctctgacatacaaaaggccctaagcaaatatgctgtttagtaatcaactatgacatagttattatgtctctatcgaaaaagatttcttgaataacacagctatctcagtattttttgactaaattatttaactaatacatatctaaaaatcactcaaagtaaatatttgataatatttgtagcactataaattgatgcttaagaaaagtctttcctatgtcattctttttttgtaattttattttatgcatgctacataaagtgagaaaaagcagctctatataagcagaaaactaaataatggtaatttagtaaaatttaatttaatcgtgctggcagtgtaaatcacatttccatttcctatatcaactttaaagagaaaagcaaatttgcttaaaaatgttaaaatattcaatatataattgatataattagaaacactaaagtaatctaatccaatcctttatccttcagatgaaagaaataaaatatggggacctgcctgaggtcccagagttagagctgaattaggtacaaaaggctctttccatcacttcatatccaaccttttgctttttcctaaaaatcttatatatccttaaaccagtagttcttgctcctaaaataaatgtagatactgtattaatgaataaccaaggagatataaaaagtgcttaatatgcaagataataagtgaacagaatcaggtatcaattttaacctatccccttcactttgaatctttgtattaaacataaagaaaagaactaaagcagacaacagggtgaagaaaggattctctaacttcagggtttccaaaataaatgccataaaaaacagtaagagaaaagattcatttatgtatatgaaatttaatctgactcattctcccacaatcattattccaatgagaataaatacatctgtccaacatgtaaacaagttcatatatttaagttattcaagttcctggtgcccactagtacattctaaatgacaaattcagaacagcataccaaaagacaagacatgactgtattagtctatatagaaatcatggaaagattgaactgtgttgtattagtccatatagaaatcatggaaagactgaactgtgttgaatctctaaattaggcaaaatacacttgccttctgggaaacaagggatattttggttacacgttctcacaaaacttctactgtaatataattctgaaatagctggaccattaattcaacctaatatatgtaatttcttatattccagaggccacttaccatcttccatgagtagtctgcagaatgtaagagattccatattttgtatcaaattaatggtccaaccatttcagaatttaaaaaggaatgaccatggagacataaaaacttggtggcattaaatggcatgatagtataaatgctttctactatactataagctctacaagtgcaggaacattttcatgtacacaagagtacttactagcacagttctgggacacagaagcattcaaaaaacatttgctgaattacattggaattcctcttaggaaaccacaattaaaaaactgttagctgtttacttttgtgtgtgtgtatataattttttaagattatgacatttatatataaaaatcccttaaaacttttacacatccaaaaaaatacataaaatgcaaatttcaagtggggccaatatatttgcaacatacgtaatgtatagaagattgatgtatttaatacaattttgtggcaaattaatattaaaagaaaaaatagattacttaataagagggtatcagaacaatccacattctgtgttataggcttttcaaagcaaacatatcaaaagatttcttcttcttgacttaatctttcatttccctaatgtaaaatcttcatcttctagtagtatacctcaaaagtgtaatgcattagaaaaaaaggaagttgcacagctctatgtagcatccgtgttgttagcatgtacataaactttttaaaatgcacaaagcaatactacattggttttagaatctattttttcatattaaaatattcttctgacatctatttttcttctattcccattctctgacacctaatgtcagaagtagaaaagtagatgtcagaagaaagaaatgcggcaaagtgtatcaataacacagtgctataataacaattcactcaagaccttaaatatgtgtacaagtagcaaagttaattatttttattattaatggaatgtgtgaaagatgtcaggaaaaactttaaaaacttttgaactgctatctaaataaacacaaacttctaaagacttaaaattcctcccttctaatatttgccacctatcatctatatgacatagtgtagctgacttactgccacataatctaatcacatgctttattttatgtagggcaatctcagagaaaattctgtaagtgacatggaagttttaagaaaagtctccaacatctgtctattattctatccatcacagtgtatttcatttatttgtttatatgtctacctcactacactgtggggcacttaagagcagcattctgattttatgcatctctactttctccaataccagcacaaagtctgtcatggcaggtacttgatgggcactcaataagtgtactggctggaaaatacagacatttctgtttcatgcataagcacaaaattaatacagcagaattttctccaaagacataagaaaaataaaaggggacagagatgtgaccaagaaagcaatttatgtacttaaagcataaatagtattcttttcatggaatacctatcattgtactgattcagaatggagccctaaaaaatcttaatttagaatggaaaactctgtctaataaaccattctctcactttacttctctgaaaccaacacacagtaatgattataaaagcaatcaccgctaggtactctgttagacatgacatatattaccttttttattctccaaatcagctcttcaatacgtatcattatacacattttacaggtcagaaagactgaggttcaaagaagtgacaagacttgttgaagactacagtgaaagagcagagtcaggattcaaattcacatttgtaacattttgaaaaatacagtaatttttttttactataagcaaaagactattctatgtatgattcacacatacgaaatgactgaagtgaaaatttgctcgaatggttttgacaatggatatattaatgacccacaaaattgaaatacagtgaatatcccagttagataagctaagcaaatcaaatttttaagcaactaggatcttggaaacaagagccaagccaactaaaaactatgtacagttcctaaacattcactgggttaaatgtcgtttgatttatatacatgaagtttgagatattacacagttttaaacagtgcatgagcacattgtgtgtgtgtgtgcgtgtgtgtgtgtctgtagacagagtaacatgtctttgatatttttttctgtgaagaaaatgaggttgcagccaggcatggtggctcacgcctgtaatcccagcactttgggaggccaaggtgggcagatcatctgaggtcgggagttcaagaccagcctgaccaacatggaaaaaccccatctctactaaaaatacaaaattagccaggcatgatggcgcatgcctgtggtcccagctactcaggaggctgaggcaggagaatcacttgaacacaggaggtggaggctgtggtgagccaagatcacgccattgtactccagcctgggcaacaagagcaaaactccacctcaaaaaaaaagaaagaggttgtagaaatttccatagtataatcccacttttgtccccccacccttcaaaataaaacaggtggtaaaggaggcagtgtagataaaaggagaagcaatagcagctgggaaaaatattctccaaagtgttcatagtggctccctttgcagacgaagggtagggtttaggaaaagaatgagtttcatcttctactacatataattctgtattatttacattctttgcaagatacataaatttgataatataaaaatgtaaaagagaggcattaaaaactctctagagccttcaactgcttcagaaattacactgaaaatgttatttgatatttgatattaatagtaagaaaaaaggcttagagaaatagtggggtacctatactaacaagcatagaaaaaatactaatactggaaaataaaagttaatttattaatccttttacctatcatttcaccacaggctctagaagcctcctatctgtttttccatctacagaactacagctttgttttaaaaatctggaaaaagttaaaaaaaaattttctagtctaaggtttttcaactagttaaaaatttgcatctgttggatatatgtaattggatcttgaacatacgctatggctcccattcatttttaagaattacatctaaggttctattttttaaatcaaatcattaaaaaaaataccttctacacataatcaaacaagtctatgaagatcaaagcctcatttacactgctgtgaatggtacccttgaggttatgcagcacacaatttgtacaatacccaagagccctgccaagacacacaggagcacattccccacagccttgtatctaatggtgaaaaattcaaaatagcagaagttttcacaaataagaaatagttaatccacaccatggaatattatggtatatctacacaatgaacaccaataataatgtagatgtcatcaatatggaaagttgttgatgatatagtaagcgaagaagccagcccactaaacagcatttaatcttatttttggttttaaaaaagtatatgaatagtaatgtgtagaagaatacaacaaaatatcaatagtagttctctcagcatggtgagttaaataactttttaaaaaatccatctacattttctaagtttaacaccagaaatatatataatagcagcctaatattgatttcttaaaaaattacagctgtaggagtaaaatgaaacaaagagatcttatatcataagattttactattttttttgtttttttttttttttcaaatcatttgacttataggagaaacatttttcttccatcccacctcctccttaagagagagatttatgcagcataagccacataatcggggcattttttactttatatttttatcagctgcctttcaaactgtgctaacactgtggtttctggattttaaagattagttgtttgcacagtcctgttactgatgatgaaaaaaatacgtaattaagagatcaaccaacccagttgaggccccctgaaagaatactattccaggaagggtgtacaaggtttcttgccctgggagtttcacttcataaatggattaatccttggttcactagaaaattctagaacaatcaacttcccaatttctgatttttttcacaattaatcatgttttaaatatatatatatatatatatatattttttttttgcattgtttcactagcggctgttcaccaccaaagagctcaagattccttgaaaccaacaaggaggattttttctttataatattttactagtttccaggaaaactgccagtaggaggcagcaatgactggctgtggcaacagcagcggctctgctctgcacagtagttagctgctgacttcattcttctgtcattatataagcaagatgacactgttctctaatccagccaaagctgataagtaccatcaacctgtcacttcctacatttcaaattctaacatcacagcatcaaagagtttttacatttcgatttcttttgctggcagcagccggtagcctctcattctcccacagtgttctaatgctgcatttgcacaccggggttactcccagactgaatagcaggtcatcccctgctcactgagctcatctgtggcccatgtgctaggcaatttagatccaatcagcccttatttagctcaagagtaatgagcagcatagtgacacagacttaagcctgaccctcaggacactgctcatcaagcagtaaaactgtgacaaaatcattcatcttccacccgctggcaagaaataatactcgcactcactgtattacttttcaagataaaaaaaaaagtcctgaattttcatgatgtgagacattaatttgcagaaagctgaattcccttaaacccccctgttgctatgagctcaccagggggaaataggccttaggagactgaaatggaataaagaaaattgctccagctttcttttcattttaaataagccttaaatctgacaagagataccctaaagagagaaaaatatatatcttgtaaggtaaagaagaaacaattgaaattaagagtttcaaatgctagtttcactccttgtttgtcctcaatttctttaaaatataaataaaatttcaaacagcagttactcacctttttccacaaggcggatgaagaaagctaagaactgcttcccataaacaatatggtggcaacagtaaattcatatcattaaacatgtactctgatgttttctacaaaacacatcttaaagaaaatagctttagggtaacagtaagatggtgagaatagctagaagtattttaaaactataatgaatctattttctccacaatttatagtgccttctgaggttttattaatccaaaagtaattaattacaggaataattaagattggtttccttccctcactgtcatattacatcattaaaaaaaaaagtctggtagcttattctagtgcatttattgaatgtaaatgctgaaattttacttgcttcccaagtacttcccttttataaccaaaagccacaatgccagtttatcatactgagtttttttaaactaggtcaatgtaccaaagtcacaattttaggtgtttttaacctattccatagtcagagaagagttaactttaaccaatctgtcacgaatgggatttaccagtcttcaatatacttactatgacagcctgtctttggtttaagaaacagcaccgtgtggtgccatgaaagagcacagtagtgatgtcttcctacaaactcattgctgaatttcatctaaagcttcaaagatctgggtggtctaaacacctatagtgaaccacagggttcagactaggaatcacagtgacataaataagattgggaaaagtagcttttgcctcatcccatcatcttttgatttattgccatttgctaaagagaaatattccagtggctggtaaagaaaaataatcatggcacttctattccctaaacaactgaattgatccactttcaaaggaatgaaatgctttctttacagagtatatttattttttccttctccttttatccaatgttcttcactctagtttctgttttacagtgttctttctccacccttatgttttctctttttcctctgtaattatgagaagacaattttctgggtttcatcctagaaaaatcatattactggtaacttcaaattttggtaataactataaatcagaaatcataaagctctattctattctatgcttcttgaaagtaggagtaatcttgtaaaaaatctaatatatttttatttttaattcattatttatttatttttttgaggcggagtttcactcttgttgctcaggctggagtgcaatggcgcattctcggctcactgaagtctccacctcccaggttcaagcgattctcctgcctcagcctcctcagcccttgagtagctgggattacaggtgcccaccaccacgcccagctaattttttgtatttttagtagaggtggggtttcgccgtgtcggccaggctggtctcaaactcctgacctcaggtgatctgcctgcctcagactcccaaagtgctaggattacaggtgtgagccactgcacccagccaaataaaatctaattataaagcttcattcacctcccacgttaattatataattattaggaactggggttaaatatcagctctgacctagattacaactacagattataatcaggggcatagcaaataaaaaaccagaagactaacaagggtgaggaacgtttgtgaaagctttgatatcttttctttgtagctagtattttgaatttctcacagatggaccctgctgtgattctattttcttatgttgtgctggagtcactcaataggccctttcattacagaatcttcggttctgagaaattttcttaaattgttttattgattatttccttcattccattttctaagttccctcttccaaatgccttccttccactctaatcccaatacagacaatctgcacttgtagattcaaagtgttcctgcagacccagccttgagagactggttccgaaatgtctcaaaaggaaggtaaaggctcaaaggacccacttgctgcacctgtttccatagttcagtggaaaaaattcaatgataactagtgaattagaaagataaaataataatagtcatccagaaaatactaaggaaaacacactgaatttttcaataacaccgaaaacctttcaactgggaagaacaaacctcctatcatcctctagaggtcccttctacccatgggtacttagaagacaataaacacagagatgaaattcagattatgcattaaatccatatcctgactgcatggatactgttgtctgcttgcatatggacactggcaagaattgttggataagcatataaaatttcaggacaagtataaaccattagcaagtagtatgaaatggtgaaaaagtgatggtttaaataaatacaagtttctttgtccttcctctctaccatcttagtctttcatgtaaaaaatacatgagtgcatactacatatgcttcatgtgactggttcactgatatatcctaagtgcctactatcatagtaggcattcaaaaatactagttaaatttgttgaataaattgtttttcatgaatatgtctcccctttagaaaataattacaacacaaggtaaaaaacaataaaggacattagagatttagtaactattcaggaaattcaacaggaatagagattattcaagactggtgtattagtcggttctcacactgccataaacaccctagactgggtaatttataaagaaaagaggtttaattgactcatagttccccatggccagagaggcctcagggaacccaaaatcatggaggaaggtgaaggggaagcaaggacccctgaattgaattttttattttatattcactaatttaaactgtcacacatagctagtgctaccctactggacagcagaaatcttcacatgacagcaggaggaagagctgctagcagggaaaatgccagatgcttataaaaccatcagatctcgtgagaactcactcaatactacaagaacagcatgtgggaaccacccccatgatccaatcacctctgtccattgacacatggaggattataggtctctccctcgacacgtggggattacaatttgagataagatttgagtggggacacagagccaaaccatatcaactggtaacacacggataagcatacatttctcttgaaatgtacaagcatgcatttcaagagaagcttgacatgaagcttcttgacatgaatattattcacaaaaaaatgaagaaaagataaatgaagaaaaccaacatgtattgaatgtactgaaagcttattatgattcatgttctggacaggtgcagcatcaaagtcagtgctatcccttggcaagtctttctgctgctatccactacattatccactaactaaatatagctattgaggacttaatatatagctggtgttacagaacagttgaattttttattttatattcactaatttaaactgtcacacatagctagtgctaccctactggacagcagaaatctaagcagatgttcatggaaatcctatgaggtggatattattttacaaagatgcagctgaaacttagaaaagattaagtaacttcctaagattgcactgttggtaaatgaaagagggtgatctgaactcaggtttactgaccttaaagctcctgctttttaatacaatgttttgacagcagcaactatcaggcactactagaggttccttaagaagcaaaggcaaaaagcaaaacttgctgtgtgcataagtctcctgcctggaatactggctcctcccatatatgatgctctttaattccatctctacctctcatcaacatactactaacttctgaaaacactttccattctcctcaaatacctctagttttttctttttctatactctgccatctcacccctatgtctactattaccaacactgaccacttctgactcttgattttgacaattacttccattcccccaacttaacctttttctaagcagtgactctcacatgacatgcttattcagtcctcagcttcagctctgctatactggtcatgttctggcctgaaccctcaattggttttgacaagaggtcaaacttgtcaactttgaccctcaacttcgttggacaagaagatataaataaaggtagaaagacttggggatttcttgagaactagtagctccatctgactaaaggagaatcacaagaaaaagttacagattaaggtaaaagaagactgtggatggctttaaagaccatgataagaaatgtgaaattttctactgtgtctattagagtgtcactaaaagtttctttttaatgtaatgaaatgttctaaaatagtggtgatgggtacaaaacaactatgaatatactaaaaaccaataaattgtatggtgtgtgaattatatctgaataaagctagcaaactctatgatatgtgaattatatgtcaataaagccattaaaaaagataatctgaggaaggaaggcattggaggcagggtgattaggcaagtagtattaatgttttaaaaacagaggtaatgacatctgtgagaataaaagaaagaagataaaaggaattcaccaaagaagacacacgctccccaccttaccaaaagaatcagctgattataaaaagaaagggtatacatatatgtcacatttgtacctttaaaaattactttttctacagcagcactcagtaacatagcattacaatttccaatgggtccactgcagtgaggcaatgttgtttcctacaattctttgtttttaaagaaaacgattcattacacactaaaacaacaacaacaacaacaaaacttgctcaatggtcactatgctagaagtattatattaagaatgggtaaaaaaaccatccaagataagacccctgacacacacacacacacacacacacacacacacacacacacacacacgtccattgatgttgccaggcataaagcataacgaagaaatgattatgagttcttttgaaaacaatacttatgatgatagcattatctaacattcattgaacacttactgatatgccaggcaatttgctaactgccttatattcattattgcatataattcccaaaacattctagtgaggtaggtggtattatcctcattttacaaataagtaagtcaagattttggcacataagtttttcctcacattattttaaatgaatcgctttatacttatttaaggaaaactcgtatctatgtaccggatttagatagggactgaaaaagtgacccaaatactaattcctatgcgtgaaaaactgaggagataatctatgtttcagcaaaacacaaaaaagtggaactctgcaaagctaatatattgagtagtttatattactgcatgggattataaaatatgtaatagaaatacattatgccaaattcaagcctgataaagagtaaataaggtgaaaatactaatttatagtatatatctaaatactcagctgaaagatataaaaaatatttaactaggaaaaaaagtttttctttacatattttatacattcctgaaatactaagatttatactgtattcccttagagatacccatgctttctctgaaggaacgaaaaaaggcaatggattactccttgtaagcaacaatatctctacttggtttttcaaataaaaactggtaatagattttattaccatgagggcatacacatgtgtttcccaaaaattattagaacactgcctcaaaatttccataaaattatatataatgaaagagcagacattttgagcaaactacagaaataactcatttgattaaaaattctatccagtttcaaatttgtttgttgtaaactgtcaataattaaaagctgtaacccattcatactaatagaacacccaataacaaaaggaagaaaaagcttgcatgctgtcaaaagtatcatttctatttttcctgaaatattatataaattatttggcatacagcagcccctcaagtgaacagttcctcttgtacctccttttttgcctaggcaatccccagttctcttacagaagcaaagaaaaaccaaaaatctttggggagaataaataataccataccaataaaactactgagcataaaaatatttgaagagaataataaacagtttttctctacatgctcatacacaaacacttcaaatgtcaaaacagttataaaacaagcagatgatcttctagccttatagggagagaaaaaaaggaatttaaatatatatatattttcaaaatgtattttgaagccagggaaaataaccttaatctttgaagaagttgtagttcagcacacagcatctcaaaaaggtaattatcgcttctgaactatttcttagtctcagtatttagcattttaggcaagttctcaactgcctttagacatctttgaaactagtctcttgtttaatacaaaataggatgtcagttgatcaatatctatttggcttaaattcataagtccacaacctcccttaagtggtagaacaaacaggtacaaatcctgaaaatttattgtttctttttaaactccaaatggtattttcagatgccaaaaggcattttgaaatcactcacccttacttcagtaaaaatgaaaaagggggatggggagggagggagaatctcatgaggccttgtatgtcaagtttttgcccagagctaattttcatagctgtgttataaaaccccgaaaatggaggtttataatggaaatgctgacagaccctcaactatagcagcatgaatggatataattaaaggaaagcttttggctacacctaactccacaaatgaaagactgccatttttatattaacctcaaataacagcaagtgagaacttaaaatgtgattccagagaggtaatgtgaaatgttaaagatgactgctaaaactatttgacattcgaagttttaaacataggcatttagttaacataaccaagtcagtattttcacaatgctacttaatcagcaataaagaatgctctggtgagccatcagctccagttagcagaaagaagcatatgaagttattattcctaaacagcctagagggaactgcttttctctttaatcagtgatcatagatccttcctacctataatttctctgtcatacagttgtaaaactattacccagttcaacacacacacgcacacactttatacacacatttttgcaaggactggtacctattcccacctgaatttgaaaacagaagagatggctaaggtttaagtatttcattatttcccttgtcagagatgcagccaggaataaatatcatcaatctatataatccatcttccttacctaaacccaaattcaaataacttagctctgctcttaactaaagggggcggcgagcttatgctttaatttttaacaactatccaaaatgtttttgacccgatagtattaacagtatatggcatatctaaaaaactactatcaaaaaatcttgaatgaagttccagatttggggttaagaaattaggaatacatctccataactgaatacctaaataactttttcttgtttcctgtccaactcttcttcccttctttctttatttttaaggtaaacaatcctgaatgatctcttgggcccatctccaataaatcccaaactaaaggctggactgccttgataatatttgccttggaaatgctaaaaactgatgggataaaatgaacctatccaagtcatagttccttttattacatacagtaatctgtttgcaaattactaaagtatgttagtacctaaaatacaacagcattaataaagacttgcatattgctgcactatttttattcatacattgaccttatacttgtatctgttaaaactgctgatttgggcaatataagctgaacatgatttgatgggttttttatggcaattgttttcaatcatagttgacagcataagacaaaaccaaaacagacatttgtgaaaggaatcaaatgttatcaacataaacatctgatcctttttgcacaggctaatcctgaaggccaatagcacaaccccctatcacctactcacactccagaggacagcaaactacaaattgaatccaggtgcagttacaagaaactcttcctatcaatgtaaacttaacttcactttatataattgtcattcttcatcatccttttttgatttctacctctgtacttctgaatagtgtcccacagactaacagatacatcataactcacaatatatttgcaagaaatatttttctaacactcctgaaataactttggctttaatgctaaaggatttctactaaattgaatttaaggagcaaaaatttgtttttattgcaagaagtgaaatttagagggttggaatagtactaaaaaaatcaaagacaaattattataaataaaatgtgatatacttgtctccacacctctcaaatcattttttccaactgactcatttaaaaaaaaaaaaaacttacaaaataaaaagaaagtaatcaaaagtccccaataagcaactacccctttttttgtagcaaaaacaaaatgtaaaagcactcagaattatacaaatagtggtaataatttcaggtttgcaaataagtttgcagatttcattcattcatctctaatttttttttttttaatgtagtggtatggttagttttggtttagttatctgtaaacttataaagactgtataagccattcaggtgatggttacactaaaagcccaaattttaccactacacaatatatgcatgtaacaaaactgcacttgtaacctctatacctgtaaaaataaaaagaaaagaaaattaagtaagttaattaaaaatatagtgtaagaaggcagctgtggtatagttggttaagagtctgagtgccagttctgaaatttaaatgtgttattttagatgagccacaaaaaagtctctgtttccatttttttcacctataaatagggatggcaggattagtaaagaataaagaagacagtatttataagcattaactctttcaagaatgtaagaattattcttgtgtttctagttactatttttaaagaattacataccaagaaaagttccagttaggagattcaagataagatgaagttggtgaatgaatgtgaaatagagaaaagagttcctctcttttttgctttctttgtatttttaatgtctatccagccttcaaattaagtctaatacgcctattaccaagcttcaactgacattgttaacaaacttctgtgtttcatttcttacctttttttttttctttttgagacggagtcgtgcagtggcgtgatctcggcttactgcaaccaccacctcccgggttcaagcaattgtcctacctcagcctcctgagtatctgggattacaggcacacaccaccatgcccataacttttgtatttttagtagtgacggcgtttcaccatgttggccaggctggtctcgaagtttttttttttttcttttgagacccagtctcgctctgtcacacaggctggagtgcagtggcacgatctcggctcactgcaagctccgcctcccgggttcaggccattctcctgactcagcctctcgagtagctgggactacaggcacccgccaccacgcccgattaattttttgtatttgtagtagagacggggtttcaccctgttagccaggatggtctcatctcctgacctcgtgatccgcccacctcggcctcccaaagtgctgggattataggcataagccaccacgcccagccttatttcttatcttagaatgcttttctaaatacactccatacaatgatctaaaaatgagaatggaagctttttcatacattatcagtgagagtaaaaactggtacaatgggtttttttggtatgaaatttggtaacatctattcacatttaaaatgcacatacaccaattcattcttaagaattaatctataggtatacttccacaagtacacagaaatacatttacaaagatgttaaataaacgtaaactggtaaacaatacacatttccattattagcaactggataaagtttggcacatctatataatgagacagtaaatagtcatttaacagaattaggtaggttttcatgttttaacatgaaaagctgttcaggaaatattaaataaaacaaggaatttgcaaaacaaagatcatctattttgtgttttaaatatacggctgggcacagtggctcatgcctgtaatcccagcattttgggaggccgaggcgggtggatcacctgaggtcaggaattcgagaccagcctggccaacatggtgaaatcctgcttctattaaaacataaaaattagctgtgcgtggtagtgtgtgcctgtaatcccagctactcaggatgctgaggcaggagaattgcttgagcccaggaggcggaggttgcagtgagccgagatggcgccactgcactccagctcgggtgcacagagtgaaactccgtctcaaaatatatatgtatatattctatatacacatatgtgtatatcctatacattctttatacattctttatacatatatgtatatatataaaaatacatatatagtgtgtgtatatatatgtatgtaggtaggaaggagatatctggaaggttctatagaaacaattttatttctatggattagaactagagcaatgtatctcaaccttagcactgctgaagatgggcgacataattctttgttgtaggagttgtcttgagcactgtagagtgtttagcagcatttctgacctcaccagtgctgtccccctagttgtgacaaccaaaaatgtctccaggcatccaaatgttccctgggggacaactcactcccagttgagaactactgaactagagaatgaagaagtgaagctgaggagacagatttacttgtcactttatatctcttttgtcccccatttgtaaaatgataatatattacacaaacaatataaagataattttaacaaaaaccaaaaagattgccagaaatttttaattaacacattaaatttaaagtacttgtaggatacgaacctatgaggaaaaaaaaaactatgtaagaagcaatataattgttaaaaagaattaaaaaggacttatctattttcagaaaaggcagaaagatatatggattctgctacttttttccccacgactgcctcttctgaagatgcccatactctttcttcctttcttattcctatgctctgacatcttttggggactatagttctccatgaccaggatggcttagaccaacaccctcctcttccttcttgttttgtatattcagacagatatatagagacaaaccaaaactgatattggaaacataaaaatttctaattttcccaagaagcacagggaatcacttaacatttatttaaaaactgaagaaataaaacaaagttggcatttggaagaagtataaaacccgccatgaaaacacggcatagaatagagaaaatcaagctagtaatagaaataaatttgataataaataaattcccaaaatttggaaatcttgccaagcttagcacctctgaaaaacagatgcaacatttgtaatatgatattaggaggagggaagcagtctgtttatctttggacatgatttcaaatacaatcattttctgtgacagtgagtaaccatactgagtggtagtatttaacttcttaagaacatgtacttcaaaggtaaaactgctatgtgaaaagtgcctaaaggcaataaatatcataaccattgttcttatccacatcaagtttgtgtctgagtgtatttaacatatctgcataatttaagtggatctgaaaaacagtaagttttgtataggtgattggtgttattaatagaattatctatgttaatttcagagcaaactggtttatttcaaagcatttgatgcagctaaggctatgactttgctgcaaaaatttaaagaaagtcacttttaaaaaatggtgtaatgtgaccaaaacttccttatgggcacaaaattacaaatgcttcagtaaaagccacctcagacatgagctcatgatcttgctcagaatatctgtaacgtatctctgggtaataatacacttttctgagaggtagcaggggaaggaagggctaagagaaagcatggctctcagactgcaccagagctgctcttgactttagttctgcatcttgtgtttgcatataagctttcttttgaaaagctattgtttgaaaaacagcttgaaaactacaggttgagcctcactaatctgaaaattcaaaatccaaaatgccccaaaattcaaaactttttgagtgccaacatgacactacaagtggaaaattgtatctggcctcatgggatgggttgcagtcaaaactttgtttcatgcacaaaattattcaaaatgttgcataaaattacattcagcctgtgtataagatgtatgtgaaacataactgaattttatgtttagacttgggtcccctcctcaaaatatctcattatgcatatgcaaatattccaaaatctaaacaaatccaaaatccaaaacacttctagtcccaagcttttcatataatagcattttagtacacggatatattcaacctgtactgatttatgcccatgtagtagaaaactaaatccttcctctacatttggatttcatgtgtatttgtatatatgcatatatataactttaatataaaatccacataagtaattatataaaacaaatcataaattagcatacaactgaaaaccatacctgattctggccagaacagcttgtaggaagctcaatactgtcctaagttcagattctcgacatgctcgcagaagcatactaaatccatcattaagcagtttttcatgggaaggatacaagcaatagctggtctcaaacacttcttgaacaccatcaatgtatatggaaagaagggtccagatagtctgtctctgtaccatttcctcattcttagacaccaagaattcctttgctttctcccggaaagcacatgaaaatttctcagccaaaacaccaatgtccagatttttctgggcatacatcaagaggaaggccatgtgacccttccaaatgagggctctctgagacgttacaaaagcaggcttgaggaaattcaggaggtctaaaacatgacttgcaacatcttctacctctgcaacagctgctaacagtagaaaaaggctaaaaaagttctgtagaccaacttcagttagttcttccattcttttttgatggaattttgaatatattctgtaaaacattaaaaaatgctttaataaaattgtttcattcacaaaaatctgtatctcttaaaagaaaatttgtttcaatactcataacaatctcattaaattttaagctaattctttattttgatgctgccttgtcactttttttacttagaaaacacataatggccctaccttgaaatttcccaatgatgcagcaaatcacctgtaagtgaatcaaaggattcaatggctttccccaaaggaaagtagaaatgttttcatatagtacatggcttttccttttattcaagtcccccatcacctttcttttcttattttgattagtaaataagaaagaatatataatcttttaaatacaatttgatatgcttttacagagatcttaacaggacaattttatgtaacaattttccttaaactcttttctccctgcaccccctcacgaacacttgctcttattttacttataccttaagacaatgcaaggcgttagaaaaattctttgtagccatctgcaaagaactatgcatttaaaaatctcccatcaatactatttaatacaatagttgacaaaatagtacaatagataatatagttaatagttgacattcttttctttcatcaattaaggggttagaattgaaaacaattcatctgaattcctacttacgaattaagttgttgttggttttttgttttttgtttttttgagacggagtctcactctgttgcccaggctggagtacagtggcgcaatttaggctcactgcagcctccacctcccagtttcaagttattctcctgccccagcctcctgagtagctgggattgcaggcacgcaccaccacgcttggctattttttttttttttttttttttagtagagacagaatttcaccatgttgtccaggctggtctcaaactcctgatctcaagtgatacgcccacctcagcctcccaaaatgctgggattacaggtgtgagccaccacacctggccttaagttttgcaacttctataactggcttattcaggacagaaatgagtaatgctcatgagagttaaatgtttataaatacttaaaagctgacaaactcttaaaagtaaaaatctgtttaattatctttgtattgtctactactatccccactatagtgcttgacatatagtatgtgtctaatagacttgttattgaataaactccaatgacttcttttagccataaagttctgagtattatgtcttccataaaattgcttaagattcaaaaacaaactgtcaaatagaacaaaataaaaaaaaactgtttaagccatgtgattcttgtagatttaataaagaagctggcatttaaaacagtatatgacaaatgaaatatccaaaccatatcaccatacccttataagaattactcactgtgggactcaaacaggaatttcattaagtgattcttgagaagtccctacctagtattctcttccctgagaggtctcaacaaataatctgagcaagtggtagatggtggtgtactgcacaaagaaggctaagaaaagagctaatataggcaaaggaagtagaaaaaagaaagacaatttaaaagtatactcattgaacaagcaaaactctcaaaagagacagagaaaacaatggactaatgtgaccaaagtttattttatcagaaatgaaaacagcatagttcccaaatgagaacattagttatctggttctactatactgtggtcagttctcatttaaaaaacaaaacaaaccaaaaaaaccagtgcttgtgaaccgctgggctcaaagaacacaaaagttttatatgttgaaactattacctaccaacgtacaacttgaagatgtttgtttctatcacttttaatcaaatgcatataatggattacctagtaacattataactaattaagactctaatcccaagtaaacataacaaaatacaaatagtaacacctatccaaagatatcagtgcacactcatgacagaagatactgcatataccttcctttgacttgtttccaaggatgagggccattgctcttcattgcttttttaacaacttttgccagaatacaaagaaaaatagtataactactgctggatttatatagttcctgatcttgtttatcgcaacagcaagtcttcaccatttcaagcatagacaagggtgacttcatggtattagcaaggcctttaaaaggaagccaagaaatactgaaggaactattctaaaaggggggaaaaaaaagatagaaaacaattattagtctcttagtaaataaaatggtaagctgcaaatcccagttagttggttcatcaaaagtctgactcatcttaatcacaaaaactacatgaacacgattctctaaaataaaaattccatgaaagtacagagcatcaagaggtgtccaaattttggattgtcccccaaatgtgtttttaacagttgatttgtccaaattaggatacaaacaagatccatacattgcattcagtgatatgcatggcactgtgggctcttttattctttaagtttcccaatgtttttgttataccacttgtttttaatatcaggtcattggttgtataaaatttcccatgttctaaatttagctgcttgtatggctctagtgttacttaatcttttttcccttcccttttctgtaaattggtggctatatctagaggtttcatcagatttatgttgacttttttgacaagaatctttcatcagtagtactaagtagttcctattgcatttagtaaaaaggcacataagttctgactttttgtgatgttaaaactggtcaggttatcagcctggtccacccattttagtggtcccacaagccttttacttaacagttttcgtagcattgatgatcattgcccagatgccttatttcattaaatgtacaaaatggtgacttctaattctatcacgttttcttaattaactcatcagaaatctgattactctaaaatatagtttgtattttctttacagttttcagaattaggtgtttcttttttcagagtaactttttacaaagaagcataaactcagagatttaaacatatttaatatgttttaatctattgcagtcattattctttcttatgctcaaattttcccattttctgggcaatggacattccttcaggttggctcctgtgttcttctgacatgactctagcttaatttgatacctttcctgctttctggtatgacaagacaccctagactcaccctggactcttcctgcctcaagactacaatcagtcatttctccaactagcctaaaattatgcttcagagaagggcatttttctaattttttaataagctccattatccacaaatccaaacattatttacttgtaaatcttccattaccattttctattttgattgagaggttcactaattatttaccccaaacccaaaacatcccaaatttcctttctatatacaaagtataaatcctttaaatctacctttaaattttcaatcttccaaactcatcctctcctttctaaatatattgttcctatttcagttctcagccatagtatcatttgctcatacaactacaataaaccactaagttgtctgtacccaattcatttacaccactttcagaaaaaaaaaaaaagctttctcaaacacatacctaagtcacatcctcgctatttagtgtctcctgaataaaccagaattaactgtacattatcttcaacccttcatagcctagccccagactgccttctctagtctcctatcttcggtctctccatagttatccgaggcctataattcagaactatttaacatggtaggaacagaccatgctttttcatacctccatgtatttgtccatgttgttcattctgcctggatccctttttcttctgttagaaaattctactcattcccaaagccaagttcaaaaattatgacctcatgaagtcttccacaaatacagataccgggttagataccctctcctctggagttccacaattataacttttttcccacaatgtatgtatacccacccactagtagcctataagctactcaaatgccaggattgtttcttactcaggacagcagtgcctgttcaatgtgtcatgagcaatcaattattattagaaacatttataaatgaagattttataaatatctgatacattttagctactttgtttacccttgctctcaagagaaaaaggataccaaatgctgtttcccttatgacaaagctctacaatgttaaagataaaactattcacgagctactccaatctactctgaaaaaaattaactttttaagaaaaatccataactattcataattaaaccataaagacattcctcaaatatgtacaaatttttaaaattcctggagcaaattcctattctattcactcaccaggttcttactataatattcccataaaatggtaacaattgcaatgtttggctcccagaaatcacaaagtgtcaaacaacagtgaagatacattcgtaattgttcttctagaatgacaccctaaaaaataaactgaagttatgagaaggtaaatgggctctggcaatataaacattttcacttgatattgtgctgtatataacctgcagctaaaaagaaaataaatatgtgtcacccaatcatacccattctcatatgcagactaggtctaaatcaacacaacacatacttccaaaaacatgttttaaacaccattaacacattcagataacagaagtcacataactcgacttttaattcaattatttaaaaattacaggtgtttcataattgaatggtactggaaacccagaaaccagaaaaggaacccaaaccaaaaagaagtggcaaaaatgatgtaacgattaagatgtacacaaatccagagtgcttggtcatacttaagtacttggtcaaatctttttataggattataggagttgttctttctaaaaccaaaggattgtcagagtacatctattttaaccttttaggagataacaggaggaaaaggaagtagaaaaaacatagatgctttttctatgacgatataaccatgcatatattttttaaataacacactgaattccaatcattcaacaattgtatttaaaacttaccacatactaggcactgttttaacgtactaggcataggacaacaagtaagtcagagatagcacatgtactggtagagcttacatttttggaaagaaaagaaaaggacactaaaacaagataaatttgaacagaagtaactgctgtgaaaatgaaacaaagcaaagtaatgtggcaaagtaattggtaaaggataagcatcattattttattagctgctatgaatggaaaagccttttgaagggctgcaattgaactacatgattaaatgaaagtcaataaagacttggaagaaaaacattcaaggcagagaaaatgagtggaaagttcctcaattattagtaggcttggtattataaaattctagacaggaagacatcatatctcatttgaggctttactggtcttggtaagaaatttggattgtattttaaatatgttgggaagctactggaaaagagtaagcacagaagtgacatgatgtgattgtttcaaaaacactgctctggattatacataaagagtgaatagaggggttaagaagagatgcagggagaccaggtaggaggcgactgtgcgaaactataagactgaaactttaaagatatgtttggaaaaagattcagtgggatttgctggtaaattacattaaagtatgaaagaaagaagtttcaggtttttgcataaggaaataggtcaatggtgctatttcctgaaatggcaaagactaaaggaagaacttatgaggtgagtgtccagggtatacaagtagagctattaagcagataatctgacctatgggtctagagttaagggattaaagtcagagttgttgacataaatttgggtcaatgataaaaggatccataactgagagccatttgatattataacattttcatatgaagcaagtggagaatatatgcaaaaacaagtggtcaatgaagtaaaaaggaaaccaggcattgcggatgccaagagaagtacttcagaaaaacgacaatggtgaacaggattgacctctgctcagaggttacaaaaagaagaaataagaacccttggaagaaacaatatggaagtcattgacggccttcccagagcagtttggggcttgatgaagactatgatgaagaagctcaactatggatggctgaggacatctaggaggtgaggaagtaaatatttaagtgaaaatacacaaacaataaagtccttgaacaggtgagaagagttaagatccagtgcacgagggaaggaattagctcttgatagaaagtgacacttctaacataaaagaagaatagtctgagaggttgaatatgaagcagatgtgttgggagatttaaagctgtaaagataggaattcttacctgaccaattctatttttcaatgatttatgaggcaagatgttaacccgaatggattggagaagagtacgtattaaattttatgtcaaagagaagttccgggccaggcacggtggttcacacctgtaatcccagcactttgggagaccgagctgggtggatcacctgaggtcaggagtttaagaccagcctggccaacatggcgaaaccccatctctactaaaaaatacaaaaattagctggacgagatggcaggcacctataatcccagctactcgggaggccaaagcaggaaaatcgcttgaacccgggaggagccagacgttgcagtgagccgagactgccattgcactgggagacagagtgacactctttctccaaaaaaaaaaaaaaaaaaaagagaagttctgaagtaagtcattaagtcattttggagagcagaaaagcaaacattctagagctgatggccatttgagattatgatcaacaatttaaagtcaatcatcttagtaaaaatgaatgtatgattttctctcacaatattcagttgtgggtggtgtgggagataggagagaaagaatggctttttcatggttaaaacaagttaagggctatggaattaaagatgtttcttatggagtaatgcccaaatgtaatatgcctaaatttgattgttcaaaattaagataagacattcttttaaaaaggactaaagcagagattaaggccgggcacggtggctcacacctgtaatcccagcactttgggaggccaaggagggcagatcaccaggtcaggagatcgagaccatcctggctaacacggtgaaaccccgtctctactaaaaatacaaaaatttagctggtcatggtggcgggtgcctgtagtcccagctactcagaaggctgaggtaggagaatggcaagaacctgggaggcgaagcttgcagtgagccgaaatagcgctactgcactccagcctgggtgacagagcgagactccgcctcagaaaaaaaaaaaaaggactaaagcagagattagaagcaggcatattcatttaatggacttattggaatattcattaaaaataattggttgtgtatattgtttaagaaacaaagtgaggaaatggaagaggacagaaaaatgaaaaggtcaatggtaacgggcaaaatgaaaagaaaaatgaaaagtgaaaagctgtagagtataaccatgggaggaggtagataaggcaagtaaaagaaaatctaataagaagtgaggctattaagaaattgaaaggacagttcgattatacccaataacgtcagggtcactagcagaaatagtgtacaggtaaagaagaacacagtgatcttggtacaaaaccttttcaatgaatgaagagtgacccaaatatgggtaaaaagcagcaatgcacaattttttttggacaaggccttaactctttattcattatttaaaatacacttcaaactacaagttctccagaaaacttcctaactcccttactagataagtggcctttctttacgcttttatggcacactaggcatacctacatcatcatacttaccttgttaagtttaatgtttatctgctttcaagtgtctaagagctctctgaaagatagaataatacccacatggtatatacgccacggtgcctgtttcaccaaagagcctccataaatgattcatgaacaaaactgagatctgggttctgatgcttcttcccaacaagtagagttatggcttagggaaagacatttagcttctctaataaacaattaagcttatttaaccaaagaaggcaaggttctgtccatcactaatatcctctaattttattatgaaaatattaaactagatccaggttcatattgattcctatggcacattactgaattgaaataaagcatactaattttatcatgtttataaggtaaaaaagtaggttatgttatcaaagttcacactgaagggttttatttaacatctgaaattcattttaccatgtaaaatccagaaaaacatatttaaactataaaaaatatgcaaagtttgggaaaagcaaaagtatgaatgctaggtaccaaacagtggagttaaacatatgaaaattcaaatctcagttctgccatttcctaagctagctgtgtgaacctggacaagttcttcaaacattctgggcctcagtctgtaaaagtataaaacggaaacagaaatatcactacacacgactgtcgtaagtattaagtgaaggtatgtgcagtaagtgttaagcagagtgcttgcacagggatagctatcgttttgttatctgcaggagagaaatgtactttagaccaatgttactcttctgatgatcaaataataaatgcaacagggtcatagtattgttccttaagatgatacatatcaattttgtcagttttaagcaaaccctaccagagatttgattaaagacatgtaattccatgccctctgattaaagattgtttttagtaagccataaggcctgtgggcctcttttccacaaagccttaaacctgactggctcaaggagtactacgcatctcccacattttcagaagcccttatgggctctcagcgtgtctcatctcgtgtgtgtgtgtgtgtgtgtgtgtgtgtgtgtttgagtgtatcagacggggagagaatatgagctatttaatgaatattccaataagtccgttaaatgaatatgcctgcttctaatctctgctttagtccttttctaaagaatgtcttatctttattttgaacaatcaaatgtacgcatattacatttgggcatactacataggtcaaatctttaattggactaataaggtgcacattcactcttttagctctttttttgagacggagtgctctgtcgcctagcggagtgcagtgagccgagatcgcgccactgactccgctaggcgaaacagcgagactccatctcaaaaaaaaaaaaaagaaaaaagaaatggcaatttaacaactggttattatatataatttaacaaagactcatttatttatgcataactagcctacctatcagaaaccatcacaagaagaaaatttattcacagtctaaacagtaactgttaccagaagtttgcctaattggatttatttttaggagagaatagagttgggcttcaatatcccagttacgatccttctactcaagaaacactgatttttagttagttatttaaagactattgtcccacattatttagatctaatcacattctgagttggttctactcctggactctccaaattaatgtgtttaaaaaatcaaaataattttttaaaatcaggcttactttttaaatacccttccataacctttataaaactaaaaattacttctgtgatctcagaaaacaatgaggcttttaaaaagcaggcagcaaaagatgaaaaatctttctcatatgaaaacaataatgctgttcccaaaggtagaacacacgtttacaattagcattcacaaatattaaataggattacctctaaaaaactgtacttaagtaagtaaaattgagcaatatacgttctctttactaaactaaaactccacctctgtttctggcagatcctctctagctagaaaaaagaattcaaaacattatttgcttgattaaagctgtagtggtcaggctgggtgcggtggctcccatctgtaatcccaagcactattggaagctgaggcaggaggattccttgaggccaataattcaagatcagcctgggaaacacagcaagatctgtctataaaatgaagatattagccagacatggtggcatgcacctgtcctaatgactcgggagaaggaggcagaagaagtgcttgagctcaggagttcaaggttatagtgagctataaccacaccactgtactccaatccagcctgggtgacagtgaaagactctgtctctttaaacaaaaaataaaaacaaaaagtataatgaagtgtacactaattttatttgaaggctgctgtatatttggaagatttttattttgtttaaatacagcaaatggactctttcaccactgtcactgttggagatcaagtcaaagtacatgaccatggtcagatttcaatttacctcaatgggaggaaaatagatataatcaaactgacagttctatccaaatatattattctttacaactacctactactgctcccacaaaattggtttccagaaatccaacacatagtcctatactacttatagaatataatttgatacaatcaaggaacactaaaactgaaggaatagcagagaaccacagaactacttcttcataaatattataatcgcctcttttcccataggaaagatattttgactttatgctagacctaaattcatagagcatgtttcttagattagtcatattattcctacttctagggtgactaactcatcctggtttgctcagatgtttcctggtttcacactgaaactctgggccatgcaaaccaggataggatggctggtcacctgacctacttttttccccacaaccaatagtctttggggaacaggtggtgtttggttacatgaataagttctttagtggtgatttctaaggtttcggtgcacccatcacctgagcaatatacactgtacccaaagtatggtcatttttttttttttgagacagagttttgctcttgtcacctaggctatagtgcaatggcgtgatcttggctcactgaaacctctgcctcccaggttcaagtgattctcctgccacagcctcctgagaagatgagattacaggcacatgccaccacacccggctaacttttgtatttttagtagagacagagtttcaccatgttggccaggctggtcttgaactcctgacctcaggtgatccacctgccttggcctcccaaagtgctgggattacaggcgtgagccaccacacccggcctgtaccctaagtatagtcttttatccctcaccctactcccaccattcccctcaggccctcaaagtccattatatcatgcttacacctttgtgtcctcatagcttacctccaagttaaaaacgagaacatatgttggttagttttccattcctgagtgttgtcactaagaataatggtctccactcaatccaggttcctgcaaataccattatttcattcctttttaaggctgagtagtattccatgttctatatataagaagttttctctattcactcattgattgatgggtattgggctggttccatatttttgcaattgcaaattgtgctgctataaacatgcatgtgcaagtgtttcataatgcttcttttcatctggagagacacctagccatggcactgatagatcaaatgttagatcttcttttagttctctaaggaatatccataatgttttccacagtgtttgtactagtttacattcccaccagcaacgtaagtgtttccttttcaccaaatccacaccaacatctattttttttttatttttaaattatggccattcttgcaggagtaaggtggtgttgcattgtggttttgatttgcatttccctgatcattagtgatgttgagcattttttcatctgtttcttggccatttacatatcttcttttgagtactgcctattcatgtccttagcccacttatggatgggatttgggtttggtttattcttgtttctctagttccttgaagtgtgaccttagattgtctatttgtgctctttcagactttttgatgtaggcatttaatgctatgaactttcctcttagcactgcttttgctgtacctcagaggttttgataggttgtgtcactattactattcagttcaaaggatttttaaatttctattttgatttcattattgacctaaagatcattcagaagcagattatttaatttccacgtatttgtatagttttcaaggttcattttggaattcatttccaattttattccactgtggtctgggagagtacttgatataatttcaattttttaaaaattattgagacttgtggcctatcatatggtctatcttggagaatgttccatgtgctggtgaagagaatgtatattctgcagtttgagtagaatgttctgtaaatatctgttaagtccatttgttctagggtatagtttaaatccattgtttctttgttggctttctggcttgatgacctgactagtgttgtcagtagagtactgaagtcccccactattattgtgttgccatctatctcatttcttaggtctagtaattattttataaatttgggagctccagtgttagttgtgtatgttccctatttaggattgtgatattcttctgttggatacttttatcattacataatgtccctctgtcttttcaaactgttgttgttttaaaatctgttttgtctgatacaagaatagctacttctgctcacttttggggtccatttgaatggactatctttttccaccccattaccttaagttatgagtccttatgtgttaagtctcttggagacagcagatacttggttggtgaatttttatccattctgcccttctatatctttcaagtgacacatttaggtcatttacatacaacgttagtattgagatgtaaggtactattctattcactgtggtagttgttgcctgagtgccttttttcattgtgttattgtttgataggccctgtgagatttatgctttaaagaggtttgtttggtatattttgaggttcaagatttaggtctcctttcagcagttcttatagtgctggcttggtagtggcaaattctcttagcatttgtttgtctgaaaaatactttatatctttccttcatttatgaagcttagtttcactggacacaacattcttggatgataattttgtttaaggatgccaaagataggacccaaatcccttctagcttgtattctgctaaaatagctgctgttaatttgataggttttcctttgtaggttacctgatgctttctgcctcacagctcttaagattctttgctttgtcttcactttaggtaacctgatgactatgtgcctaaggtgattatcttttttgtgatgtttcccaggtgttctttgagcttcttgtatttggatgtctagatctctagcaatgccagtgcacttttcctagatgattccctcacataagttttccaaacttttagatttctcttcttcttcaggaacaccaattattcttaggtttggtcacttaacataatcccaatattcttggaggttttgttcatttttttaaaaaattcttttttctttgtctttatcggattggattaatttgaaaaccttgtcttcaagctctgatgctctttcttctacttgtttgattctactgttgaaacttctcagtgcattttgcatttctctaaatgtgtctttcatttccagaagttgtgattgttttttatttatgatatatatttctctggagatcttttcatgcatatctgttattattttttaaatttctttaatctggttttcacatttctctgttgcctccttaagtaacgttaagaatcgacctttagaactctttttctagtaattcagagatttcttcttggtttggattaatggctggtgagctagtgtgatcttgtgggggtgataaagaaccttgttttgtcctattaccagaattgtttttctgggtccttctcatttggatagaccatatccagaggaaagatctgagatccaaggactaatgttcttttgtactgcagggtgatcccttgatgtggtgttctcccccttcctgagagccagactgcagtgattgttattgctcttctgggtctagtcacccagcagagctactggggtctgggctggtactggggtggggggtgtctgcaaagagtcctgtgatgtgatctatcttcaggtctctcagccgtggataccaccacctgctctggtggaggtagcaggggagtgaaatggactctgtgaggatccttggttgcagttttgtttagtacattggttttcttgaatgctggttatgctagcagtgaagttgtcatgtggacagactcaggacctctggttaaacaggatgttacaggtaatgaaattagatgttgttttctccttccttggtgcagggttgttctgttatgagttgccgtaatggcttgagttggttggcctccagccaggaggtggcactttcaagagggcatcagctgtggtactacaggggggacataaacttgccctgaaatcacctgcataagtattcaggtttctcaggtgatggatggggccatggagctcccatgagtttatgttttctatcttcggctaccaggtgggtagagaaagactgttgatagttaatactgagtgtcaacttggttggattgaagaatgcagtattgatcctgggtgtgtctgtgagggtgctgccaaagcagattaacatttgagtcagtgggctgggaaaagcagacccacccttaatctaagtgggcacaatctaatcagctgtcagctcagccagaataaagagcaggcagaagaacatgaaaagactagactggcttagtctcacatcctacatttttctcccgtgctggatgcttcctgctctcaaacattggacaccaagttcttcagctttgagacctggactggattccttgctcctcagcttgcaggtggccaattgtaggaccttgtgatcatgtgagttaatactccttaataaactcccatatatattagttctgtccctctagagaaccctaatacaaaccataagatgggggaatggttaggcatggctgagctcagactctccttgggcagggcttgatgcgaccactgtggagtgggtatgggcgggggcagttctcagggctacgaaattatgttcgaaggggaattatggctgcctctgctgcttcataaaggtctccagagaagtgggggaaagctggcagtggcaggcctcacccagctcccatgcagccagcaaggtcagtctcactcccgctatgctccctcaacagccaacagagctgaatttatatccaggcctctggtgtgcagggctgagatctatgtaaatatatataatatatatatttatccatataaacctttaaagcttcttaagaaatattctgtaacttaaaaccagctgagtgcaaaaccataaattcatacactgttagagctgaaagggagtttaaaaattattaaatacaacagaaacatgggtcaatgagaaagcaatttaaagaacacaagcagttacaacctaactgaaaattaaacccctagttactgactcagattcagtaactcccaatagaataataatgttatccagactttactgaaattctctggatttggttaaagcattaagactgaattagtaactgatacaaatgacaatggccactgtaatatgcatcttatttcacaaccactttttagtaattcccttcattctgaaataaaaaatatacataaaaaactttttaagttactaaatcaatatgttctcaaaaaaaatgaggacaaccaatgaacatgatataggacaaaatacaataaacaaaacttttacagggattatgggaaagattataaaaagataatagatttgtttctgatccaatttatgtatgcagaattctttggcattctaagctaaaatttttagttcataattatgtgattcatattataactaaatgcctttatgtttcctaaaaaagtaagagttaatgcagataatgggtaaaagaaaatttcaagcaattaaaatttttccaaagacatagctactacagacacacacacacacacacacacacacacacacacacacacatataaagcaatattatactacaatattttttattcctcttcaagttttaaataatctttatttcttaaaagaaaaatatttcccaaattccaaaatattatttattataattctccataaactcttacaaaaatgataacatattacaaaactttacagggcttccatacaatatgtttaaaaatgtgatgaacagcatgtttaaaactattttaaaaggaggtcaagtctgacctctaggccatgaagcactacattaacagctctgcagaaagaaaaatgataaggtatgaaacgaatggtcagaaactaggaccttatcagttagaatatgattcaagcctgtaagacaaattgctcagcaaggcaagtcaccttcctgctgtgatgaggatatagctgaattttcaatgccaatgactatctccctcattgtgtcacctagtttgatatcatacagtcaaggaatggcatacagttctgaagcatctaccacttattttgaatacattttgtcaaagtcatcaactaggatattattgtcctttaactgacaacttagtgttaaaaatctttaaagaataatcactaaaagaaactactgtgagttaacccttcaaagcatgaaagttatttgttttctgaatcattttaacagcttgcttggttttaaaaataaaatttgtaacataaaaattaagcaaaatccacaaactgtcttactttaattgcatacctgaacactgatggactttttcagcagttcttctacaaagttccaatttgattccacttttctctagaaagggagaaaatagtgcatcaaaattattgctcttgattatgcctatatttaaaattagggtatagcaaattaagtgtgcagtacattttcctctatcattcagcatcaatgtgatttcttgaatttctaatattcctttggtaaagagttaacaaacttggcagaaaaaaatgtacaactattccaatccaatacaaaccatatcaggagttgtaacagtggtgcttcagtaagattataaatattctaccaaatatttaatttctgctttcagatacaaaatccaacaggaaaaaaaaaaaattatatagccacatgtatttttggtgtttgtttttttttttatgctgagtaatcatccctattttccactttaatcactagagctttttccttcattttgtgaataacaaacctgagaccatctactttagtaaacaaagtaactaaaaattttatacagaaaataaattgacaacctcgactatctagaatgatttccataaggaagaaagctaaaaaggactttcacaaaggctaggtaggcacttaaaacaattccacatttccaaaaggaaagcctggaagacattctcacaggatactcagttcacttaatattcagttcttaaagttctggatatgtggatactggacaaaaccaaaagcaaagaaagcattttaaagaataagcaagtaataaccagcttctaatgtggaagggaaaaaaacggtataaaaagtaatcatggccaggagcgatggctcacacctataatcccagcactttgggaggccaaggcaggtggatcacgagttggaaaccagcctggctaacatggtgaaaccccgtctctactaaaaatacaaaaattagccgggcatggtggcgggtgcctgtatcccagctacccgggaggctgaggcaggagaatggtgtgaacccaggaggtgtaggttgtagtgagccaagatcatgccactgcgctctagcctgggtgacagaacaagacttcgtctcagaaaaaaaaaagaaaagtaatcataagacctcaaaaagcaaaacctgaggccttaaaaagtaaaagaaagaccttcatcatacccttcttatccctgttataaagaatatgctgttcagaggcatgaactcaaatgatcaataaagtgttaaagcataatgaattctcatgattttaaatggctaggcaatattcatgtaaaatgctaaatacagtaaatcagtaaatcaatattttcttaataaagagcacagtgagtatggtagtcagcctctaagatgtcccccagtgacctttgtctcctggaatttatgctttctacaattccctctcacactgtacgagggttggtcactaacagactaccaataccaatataagtgatagtatgtcacctccaagaataggttacaagacactgaagcttccatctttatgacactctgatctgttaacttgatctggaaacagctatattgtgaacagcacatatgatgagaaactgaagcactgtgccaactaaagtaaagctgaaagcaaattctgcagttccagttaaatcttcagatactgaagccctggctgatagcttcactgcaacctcatgagagaccctgagctagaaccacccagctaagcttctcctgaatgcctgattctcagaaattgagagtgtgagataataaatgtttgttttaagctgatacttttgtgacacagcaatagattactaatacaatgatttagttatttttagcaaaattgttgactttttgacatacacaaataaaatgaatgcaaaaaagcatttattgggagaaaatgtggagtaaagaatttggccttgcccaaagaaaagatctggcctgctgggctcactcctgtaatcccagcactttgggaggccgaagcaggcagatcacttgaggtcaggagttcaagaccagcctggccaacatggtgaaaccccgtctctactaaaatacaaaaattaggagggtgtggtggtgcgtgcctgtaatctcagctactagggaggttgaggcaggagaatcgcttgaacccaggaggcagaggttgcagtgagcagagatcgtgccattgcactccagtctgggcaacagagggagactttgtctcaaaaaaaaaaaaaagatctgacctttgcccatagcttcctggaggtcatctctgggccctgggaatgttatgcctgatagtagcatctttgactagggtcctatggtcatactggataatctaactatgtgatagagagtgaaggctggacacacccacatagtcttagcttagggcctggtcacacccaaagagcaacaatagtctcaggctgggggctttgagtcagttgacttggaaactgaaatcagccacgtgagcaattcagtagtccacccctacataatggaactcccataaaaattatgaacattgaggcttgagtgggcacccgttttgcaacactccctgcatactgtcacacactgatgccaggagaagaacgtggcctgactccattaagagaaaacaatagaagttccacatttggtacttctggactctggcctatgcccttcttcccttggctgatgttaatttatatccttcccctttaagaaaacaaaataatagctttcagtgagttctgtgagtcctaacaaattatcaaacctaaggtcgttttgggaaccctgagcttgcaactggtgtcagaagtaaagacagttttagggactgtcccctgaaacttggtagttggccctaaaagtctctcaaaaaaagctcattttcttctatcaatactgtatgtctactgtgttacgttcttgacatagtgcttcctcaaaaaaatttccccatttcacagaaaacataattaagtctcagaaaggtcatgtatgtacaaatcaaagaatgaattcaaatccaaggttatctggcaccaaagcctgtatttcttctattataacacgtaccaataaccaatttttttttttttttttttttacctaacatgccttccctcagatttcagcaattcatttttgtatcattctttattaagaaaatgtcacctccagtgccaagtgagaagggccatgacagggttgatataatttaagttttagctttataactggatagtgttgagtatatttcaatcattctgtgttatcaaagcatttgaatcacaagaattacagaaaaactgtaattctcacccaaagaatttcaactatataaatcagttttgtggctataatctaaaacaaaaataaactgtaattcaaagaaaagaatgacaactatgtcatacccaaatcaagggtaagagaatatgtatcaaagagatatagatttttcttccacaataaaatttcactttgggcagctacagcatttttttttctacataccaagttaaatctgctgatagaaagcaggtaggatgtcatcaatttgaggctacattttatatttcttatttcagcattaaaactaagatacccatttaaacgttagtataggtaggatctctaccagatatgtagaacagattctccaccctccacttccagcagactaggtagtctggtgcaactctcattttaaggttacatttcacacttttatctggttactatttcagacgattcaaagacgagcatcagctagcctgactaattgcattatgttctgggtacagaaaacactgttaaaactgaccccttgcaatgcccagaagtaattttcctctttaaactgtatttggttttaaaatagatgactagaatcgtgagagagtaacccactctcatcttgtctgagagaaaagcattaaacagaaacgtaagaaaatctaatgactctaatataaaaagtgagataccagatttttcttacaggcctacactaagaaattggctagctttgtgagttaaatccattatagctttgtgatttaaatccactacaggtttacattttaaacctatttaaaatgtaaagatttcacattaaccttcagggcaaagcagttcacgtttaaaaactgaaacatcgccacactgccacaagattatagatatttctctggtgaagaacacatgactagccattattacttcatatcatctctcactccagattacttgttagtagaataaagcatgcttactgcacaaccattttctctattgtagttgcttatgttaatatatcataaggagaaaaaaaaattttcaaaattctaaacagattccagacccaaactaacatcttatataatctctcagaaacaatacgtcaatatgcctttatgttcatggattagaatgactatctgatttgtcaattaagctgaaacactttgaggataaaagcaaaaattaaccagttaggatgaatagataataaggtataaagtgggactgtctgtacctggcaaaatggaacacatggttaccctaccaaagacctattcgtaagaggcaatccttaggagaaatctaatatcaagtttatctaagagataaaatagggtgatatttaaccactgtgtatctcaatttctttacctgtaaaatgaatatattaccctctcacctactttaaaatatttcactgagataatacacagtcactgtgaaatactaaatatgttgcaaatgcagcacatattttacccctaatgaaaactattattaactagagagcttttctttaaaaacctttaggaaatccagaaataaactctttgaggactcatatataaaggcaaagtttattttacatgtgcatatacacatatatattacacatcctcatcatttttatcatatcctttttctattaattatcacagccttttcttttaaaaccttctacataaaatatgtgattttttaaaatcgtggcaaaagaaaatcaggaactgctgacaaatattaaaagacgcaagttaagctattttaaacacagacaattcatttactatcttgattcagagctaataaaagcaataatctcctctggagttctctgtatgaaatggaagggtagggctaggtacggtggctcacgcctgtaatcccagcactttgagaggccgaagcgggcggatcacgaggtcagaagatcaagactatcctgtctaacacagtgaaaccccgtttctacgaaaaatacaaaaaattagccaggcgtggtggccggcacctgtagtcccaactactcaggaggcagaggcaggagaatggcatgaacccgggaggcggagcttgcagtaagccaagactgcgccactgcactccagcctgggcgacagagcgagactccatctcaaaaaaaaaaaaaaagaaatagaagagtgacttcagcactgcaaccataggtggttatatcactgcaattccatattacaatagcaatggcaacaatatatcctaatgtgactagattgcctaccacactgagaatatctggcggggtcaatatcaactaatattaaaatatactacgcactcaaaaaagtgttaatacagttccaacaagtttttaataacctaaaagcatgttccttgaagcaagaagtagtacaatctggcagggtgcggtggctcacacctgtaatcccagcacttttgggaggccgaggcaggcagattaactgaggtaggcagattaaccgaggtcaggagttcgaaaccagcctggccaacatggtgaaaccccatctctactaaaaatacaaaaattagctgggcgtggtggtgtgtacctgtaatcccagctactcgggaggctgaggcaggagaatcacctgaacccgtgaggcagagtttgcagtaagccgagatcacgccattatactccagcctgggtgacagagtgagactccatctcaaaaaaaaaaaaaaaaagtagtacaatctatttcatgtgtattctctgataggcacctaatattatgcaaatacacaacagaaactcagaaacacttaactaattgccatacttacttacattgattaaaatgagaaatatatacttggaggaactaaagttggagaggaagaaaaatgcaaatgcttatattacgaccttagaattacaggtaaattttcttagttcctttaatatagttctaatattctaataattaaaagatgtgaaatcacattaactccacaaaaacacttaataaaagcactactatagtaataatggcaattgctaaaatttattatttactctgtattagcatggtaaataatcatggatacaaacaaaaaacatacaattcttttctgtgagaagttcattgacttttctcaataaattggtagaatactcaaatacactgatactgggccgtgtgtgaacttctcagagcaatttctgactatttcactatattctgggatctcctacaggaccttttattattacggggattatttagaggactttttgagaccctttccatttctatgatgctatattaatactaactaaccctcagattccatggatgacttctcaaagctgggtctatccaatattccaaagaggaaaatctatcaagcctattaaagaatatgtttcataaagcaatggctcccatacctcgtagaggatgagaaccaaggaactttttaaaaatcaggatttccaaactccaaatcaggacctccagagttaagatctaggtatctggattttttttttttttttttttggatggtgtctcactctgttgcccagtctggagtgcagtggtgtgatctcggctcaccgcaaactccgtctccgggttcaagcaattctcctgtctccgtctcccaagtacctgggactacaggtgtgcgtcaccatgccctgctaatttctgtatttttagtaaagacagggtttcaccacattggccaggctgatgtcaaactcctgatctcaagtgatccacccgccttggccttccaaagtgctgggattataggcatgagccactgcagctggactagatacctggattttttaaaactcacaagtctaatgatcagccaggtttggtaaccactgccataaaaaatggcaattttgaaaatatagacaagttggcttcatgattctagatgcttattttatggagctgataggctgatacaataatacaatactattaatttctgaatatggtagaaattgtataaaaatagggcttcaaagtaaacatctgttagctgattttattcatagggtttttaagtaacactgtaaaaaatgtttctaatgagaaattaatatactagttaaaatctctttgtatttgaagcaaacttcatggttgtttaataagttatcttagcaaaaagcttcactaaagaagtgctattctgaagtacttttattaaattattcacaaaaataagtaattcattcctcgagaaatttctttgccaatcataatagattttaaaactagaaggaatctttgtgacaatccaatcccatgattttttgttaacggaagacaaagctagaaaggtttaagtaatttgctcagggtcacacaattgttcagtagcagggccaggactacataccaaatcttctacaagtaattttttttaattaaacaattaaaacataaactttataatttttcaagatgtttacagaaacattatacataaataatttatctctgtgattgtagtctgacttttcttgtttctgctcacttattttctaatttgtccaaataattacatattaattgacaatataagaaagtttttaaaaaatgaagtcttaccatttcatctggtactccatggcgatcaaacttgtaaaatgatgctacatgagtaataatccaccaactaaaacctaatggatccctggactggattacaggcatagaggatcttcttcggtcacttgatttttcaagcagtgttttaagtagtttattcaaccagttccaaaatgactatagaaacagaagtaatttgattccattaagacagtttcaataacctttgatttcgtggtttttctctatttttataatgaagcatatatacaaaagacaaaacacatatataaaactgaaataataaaaatgcccaggttaagaatcagaacataaatagtactttagaagtaccttacaggtcaccacatcttcctcctccatccagtagttaacaattttgctgactttcatgataaatcatttccttgcttttttgtttcgccacacaggtataccagcctatattatatattgtgtggcttcatctgtattttgttttttttaaatgcatgtctgtattctcaagcggcttgtttctaattcttttgtaacttgcttctttggtcaatgctgcgtttctgatgaactcatctatattaatgaaaactgccatagcttattgcaatattccagtatatgactatatgataaaacatttattcaatctactattgcagaacatttagtgagttttaggtttttctaggtatttcatgtaaatgttcaagttattagacataaagttgtcgacagtatctcttacctttctaatgtatacagaaactgaagtcatgttcctttttatatttctagtattgagtatttttgtaaccatcttaagtaacattggccaattttaggtatcaatttgaggaaccaacttttgctcattttatccttttcattgttttaaattcataattttttgttatttttataatttcattccttttaccttctttggatttactatgaagggcttattgctaacatcttgagataaattattagttcatttgcaatctttcttttttcctgtatttgcatatacagttacaaatttccctctaattataacttttagctgtagtcccaaaactttagtttacagaatgttatttactttggaatattttctaatttccatcatctcttctttaacttatgagttatttagaaatatatttcattatttctatgcatgtgtatttctccttgaaaatctgtccattttaaattgctacggttaacaccatgttattagccacatgcaaatttaaatttatccctgataaagtaaacctttcatcactataaaacaacttaatgcttttttgttttaaagtcaaaatttttccaatatttgtttaatacgtcactttcttgtatcttttctatcaattttgaaccttgatatattctgttttagaatatatcctgacaatatgtcttttaaatggagcttttagtagtaccattgcaggtaatataatgactaatatatttagttttaaatctacaatcttattccatatttctatttgtatacctactgtatccatcaacacctccttctctggggttgaatattaattttttccccctctacctgcttggaagttaaaaagtctacttttcttctttcagtgatgatcttagaaataaacattacacatccaaatgtcttggtaaattaacatagacctttctcttagagcaaacaagaaccttaaaagagtagctcatttatgtcctactcactttagatggtactattactatgtgctttagccgttttttaattccaataaattatattactgatttatacaaaacatgtaccactttctttgctctttattccttctacatgtcagaattcccattttggcatcaccattcttctgcctaaatatccttcaggattctcttcaattttgcttcaatgaaaatagctttattttacctcactttttaaagatattaataggtaaagaattttaggttgacaaatattgttttgatacaataaggatatcattcccactggcctccattgttgttgaaaagtcagctgcccaattgtcactcttttagtggtactatattggccagctgtggcagctcacacctgtaatcataacactttgggagggcaaggcagaaggactgcttgaggtcaggtgttcgagaccaacctgggcagaccagtgagaccctgtctctacaaaaaataaattagccaggtgtggtggcatgtgcttgtactcccagctactaaggagtctgagacaggaggatcacttgagttcaacaggttgaggctgcagtgagctgtgaccacactactgcactccagactgggtgacacagtgagaccttctctcttaaaaaaataaataaaataaagtaacacatttttctgtaagatgctttaaatttcttctctttgtctttggtcttctgtgattccactgtgatgttatctgggtgtgttttttctttttatttaccctatgtgggtgcactgaatttatctgattagctttcactaacatttgaaaattttcaagtcattttttcttcaaatatttttgttgttccacttcctttttaactatagttagaagtatatcagacatcctctctattcttaatgtctcttaaccactctttcatgttttccatcttttgttatattatgcataacagatcttattcaaaattagcctactataccattatgcagcaatcataaggtgcatttagctatcccatcatttaatgtttcttcagcttactttaatctgtaagcgttcctcagactataccactcataaccttgatatttttagagtataccagtttttcaggtttgtctgacattacacattttattctttttttgtggggggagagggtctcactctgttgcccaggctacagggcactggtgcaaaattctgggctcaagtgatcatcccacctcagcctcccaagtagctgggaccacaggcatgccaccaccacacataggtaatcttgtttattttttgtaaagattacgtctctatgttgcccagtcttgaactcctgggctcaagcaatcctctcacctaggactcccaaagtgctggggttacaggcatgagccaccacacctggtctatttttgttctttcaaggcatcatattgatggtacatgatatcaatctgtcctattactagttaactttgattgcttggttaaggtagtacctgccacattttctgtactataaagttattattttcccttttataattgataaatattatgtaaagatcttaacaaactatgtaaatgtgctgtttttcatcagttttgtccactactttaagcatccattgaggattcttgcctgaaacaattaccatggaggttgtcaaatggtgattttctaattccatcatgactctacatctattaggaagagcttcccttttcccaatttgtttatatcagtagggactcacagattcctagtgaacagattacaatcccttactattttgtagctcaacagcaatggaggccagtgggatgatatccttattgtatcaaaacagtatttgtcaacctaaaattctttacctattaatatctttaaaaagtgaggtaaaataaagctattttagcctatagaccttaaggctgactctcatgtccttctgacatgtactcatcattttttgagcacttccttagtttctggtacaagatgtttcaggctcatgtttactttccatgcttcatcctgtaatcagccatttgttcaaagactcgtttcctttcactacagaatggttattttgaaactaagatatagctgcaatgtgtatattgttactcagtatcattgcttgtaagcccacccagtgaaaaaggtaggaaatggaggtatgcacacacacacatatacatttatatatagtcctatatattaaaaagaagtattgcatactataacaaattctaatccaacataatgtgcttcatgctggctttccttctttccatatgtgtaactcaattccccaacacagacaaacctgactccaattacccacaatgtatttattaatttgtccagtccaagaatacaaatataatagatttaaaattgctaatcctcacataacaatgtaaaaaacaaatctcctaagtatttacaattctttatgattgtctttagccttatagtatagtgtcaaaatagtacattcttaagttacctgggttaacattgccaatcccctcaaagagtgttattcatttaaaatacatttaagttcagttgtttctgttatattccattgagtgcacctttcatacagattgatttaattttagggcatgtggaacattaacacgattctaaagtcagaactacccaaataattacatcaaacccttccactccattttcacccacccatctttatttttacccaccaatctcaatagtttgtctttccagtatttatttgtgcacaattgaacacatatatatacacacacacacattgcctttttcctaatttcttatacaaaaggtaacatcatcctatagttttgaactttatttctatcatttaacaatacattctgcaactcactccgtatcagttcagatatcttcctcattctattgtacaactacaaatagaatggttaattttatgtgtcaacttgaacaggccacaggatgccaagatatttggttaaatattattctgagtgtgtctataaaggttttctcgttgagagttacattttaattggtaggctgagtaaagagatggccctctctaatatgggtgggtgccatccaatcaattagtggcctgaatacaacaaaaagtcctccgagggtagagaagactccctgtgcttcatactgaaacactgttcttttcctgccttcagacttggactcagactggaaattacaccattggctttcctggtttgcagacctttggactgagactggaaactataccatcagctcctctgggtcttcagcttgccaacctcagattcgggacttcttggcctccataactctgcgagccaattcattataataaatcttatatatatatatatatctatatatcctattggctgtttctctggagaacacacactaatacagaataatacttcagagtacagatataccatggtttgttcaactactcttttatatataagaatttagtttctactatactattataaaaacaatactgcaataaataaacgtatgcatatgcattttaattttggagggtacacatttagagtaaattcctggaagtgggattgctagggtcaaagttacaaaatccttggctcacactttttcattgagtcattttaaatgctgcattgaggccttgttttaagttgactttgcaagtctagtgccaataaaattattttgctcttataagttgtttggtctttgtgcctagaggacttggagattttttcctttatgtttaaagtgaaacagttttagtaagacttgtcttcgggtggattgcttggggttaatctttcaaattatccagcagaccctttcaatacgtagatttagatcttttatttctgggaagtttcctttgattatagtttttaatattagctatatcacactgttttcttctctagggattgcatttatatgtacagttatttcctccttgcctaccttccatctcaaccattttctcactctcttcatatttatctcatttttattcccttagttgttttcaacctttcttctatgccccttattaaattttcatttaagtctattctccctcagtcatgttgtaatttagtcaatacggatataattttcctcttcctatttctttcctgcattgaatgtattctttccatccatccccggttttctgtccatttgtttttaacatttgagtatcttattcaaggtgtttttctatactcccagatgtagtctgaacagacaaactaattcaatctacagtgttgtcagtttcttctgttttatggttgtttctgggggagagggtaccatcaactaaagtgttatcaaatctgttttcttctagtaagtttataatggtctagtttcattccattcattttgtagattaggattagcttaaaagattcttaattcagggttaccttcttttgacaatgcaccaaagtcccatttctttactgaatttcctttccttttctttcttctttttttttggtggtgggagagggtatgagtcctttgatttattctttttttggtggtggtgttttaagaccctaaattttctgctttctcttctggtgcccttcaccacccaatcaccaatgggtaccatgattcatttttgccttctacagaaactccatgtcatgtggacacttttatgtttctttcttatcagttctccgatctacaagaaaactttttcagtatcttcacattctggcaatgattttaaagcagttttataaccactgttagttctcttctcagagtagtttttctcagactgccctgccttgctagaaaggctcgtggtaagagctttagaggttttctgtttttaaaactgacagtactaagcactcccatttgcagttatataatacgtatgtttttgtatacagctgacgtttgaacaacacgggtttgaaatgcatgggtgcgcttatacatggattttcttccatctctaccaccccgaagacagcaagaccaacccctcctcttcttcctcctcctccttagcctactcaacatgaagatgaggatgaagaccttcatggtgacctacttccacttaatgagaagtaaatatatattctcttatggttttcttaacatttattttctctagtttatcatgtatataatacatacaacatacaaaatacatgttaattgtttctttatgttatgggtaaggattgcagtcaatagtaggccaccaatggttttttggggaagtcaaaagttacatgcagttttctgactgcatgttggggggacggtcagcatccctaactcccacattgttcaagagtcaacagtagatatatttgattttgctgttctatattttgttggaaggttatgtagggagatgtgggtttaggcatccatccatttttcttggctacccagaattcaatgccttgaaatttttttttcttttttcaagagagggtcttgctttgtcatccaggctggagtgcagtggcacaatcttggctcactgtatcctcgatatcctgggctcaatggtttgaaatttttaataaaatctaggtaacatgaactcagtctgtaaacccacataagggctagaatacaacaaaaaacacacagacgcaattttaaacttctgaaaagcaccacagttaaagacagtcagttttccttacaaatctagttgagtttctacttcatctttctgagtgcccagttttatggataactggtgtagttgtaggctaccaacttgataaactctgaactttatcttctattcttgtaccccttaatgcctgaaagccaaagttcaaatttacacaattcagcaactgcctctaggttatgaaaataaatttttttactcaataaacaaaaatatattaagtttacatttatttgatgctaaaataataattcaaaataaatacagtacttgcaaacctacaaaaatagagttgttattaaaaaaagatagcaggccaggcatggtggctcatgcctgtaatcctagcactttgggaggccaaggcaggcagatcacttgaggtcaggagttcaagaccagcctgggcaacatggtaaaaccccatctctaccaaaaatacaaaaattagctggccacggtggtgcatgcctgtaaccctagctactcaggatgctaaggcacgagaattgcttgaactgggaggcggagattgcagtgagccgagatcatgccaaggtggaggctgcagtgagcactctagcctgagcaacagagcaagactgcctcaaaaaaaaaaaaaaaaaaagatagcagcacccaaaccccaaattacagaaaactggaaaattttaaaatccatgaaaaatcaaaagtaccctttcatataacataaaccatttttaataccgttttacaacagactgttttacttacttctgcctaggatacttctctttttcaataacctacagcacttgaaataaaataaagccctgttctgaagacatgactgaaaatgaagtgaaagtttctcatcttcccttttctgcttctcttcctccctccttgaaattgctataaaattgagtaatagaaacctgttttatttctccacaaatcttctaaatctgccgtatttcctgactaaaatgttttctaggttactaatgggtagtaaataccttagtctgaaagatttctgatagaacaacaacaacaaaacttgaaaaaaagtaagggttgaaccttgtactgctcttagatttttcatattactaacttggggctaaaaataattagggttaaaaataaagtagatattcagtactcagttattgctctattggtggttattattgccttattataaaaaaggaagttaagatttttctcagttaaaaccattggattaaatcaatataaaggttagtaacaataaccaacacatcaattttccaacttacttccgagacaaaccatttacttctgtggtctagaagatgaataagtagaacccataattctttaatgcataaacatggacactggtcactcattaatgattcagaagacctaacctatagaaaataaccaaaatgtgttatttataagacagcagcagaattttaaatgccatatatctttcaaatacttttaaaagaatgatttagatgactaagaatttattctcaattagacaaaattatttattgaaaatgtgcaatttcatttaacttttaagacaaatttccattttaaaacaaaaagcacagattaatttgatttcaacttaaaaaaaaattttaatcatctagtgccgtggtcagcaaactttctcttttttttttctttttgtgagatggagtctcgctctgtcacccaggctggagtgcagtggagcgatcttggctcactgcaagctccgcctcccaggttcacgccattctcccgcctcagcctcccaagtagctgggactacaggcgcccaccaccacgcccggctaattttttgtacttttagtagagacggggtttcaccgtgttagccaggatggtctcgatctcctgacctcgtgatacacccgcctcggcctcccaaagtgctaggattacaggcatgagccacctcgcccagccagcaaactttttctataaagggccagataggacatatttaagagtctgttgtcaatacagtctctgtcacaactactgaactctgccatttcagtacaacagccgcagatacctggtaagagaaatggacctggttatatcccagtaaaactatatttacaaaaataggtaatgggctagattacacctcagggctagtttgcttattttgccctgagtcatctacaacaaaagacttctaatgaaaagattagaaaataaattttgattcactgtaaacagagtaaaaattttgcaagacagaatgaatacagttattagggatttataaagattcagtaatttctaaattatctacctttttttaataaaaaaatcctcagcagccctagataatgcacagaatgtacactatatttgcaaatatagctaggcttcttaaattaataatgtatgcaatattttacgtaagttatgtacacttttctaacctaatacaaagttaaaaaaaaagtattaggatgttactagaaatcctagccacagcaattatgcaaaagaaagaaaaggcatctaaacagaaagaaatgttaaaattgttgctgtttgtagataacatgatcttttatatatagaaacctctaaagacatcaccaaaaattatttgaataaataaatgcagtaaagttgcaggatacaaaaatcaacatacaaaataccatagcatttctatacaataacaacaaactatccaaaaaagaaatcaataaaacaatcccatatatagtatatacctacaaaaataaaaatacttagggataaatttaaccaaagagtaaaaggcctatacactgaaaaataaaaaacactgatgaaagaaactgaatacaacacaagtaagtagaaaaaatatcttgtggtcatggattggaagaaatattgttaaaatgtccatactacccaaagtgacctacagattcaatgaaatccctaccaaaatatttaatgacacttttttacagaaatagaaaaaacaatcctaaaattggtaggaaatcacaaaaggtcctgaatagacccagcaatctttagcaaaaaagaacaaagctcgaggcatgacactacctgacttcaaaatatactacaaagctacagtaatcaaaacagtgtgctgctagcacacaaacagacacagaacaaaacagaacaattgatttttgacaatgatgaaaagagcatgacacggggaaaggacagcttcttcaataaacaggttgggacaactggatatccacatacagaatgaatttaggcccttgtttcacaccatacagaaaaatcaactcaaaataaattaaagacttaaatgtaagacctgaaactataaaactagaagaaaacataggggaaaagctatatgacaatggtctggtaaatgatttcttggatatgaccccaaaaagcacaagccatgaaaatgaaaactgacaaatgggattatatcaaaataaaaaggaaatatctgcaaagcaaaggaaaaaaaatcaacggaatgaagggaaaatctcgagaatggaagaaaatatttgcaaaccatacatctgataaggggttagtattttaaatatataaggaacgcaaacaactcaatagcaagaaaacaacccaattacaaaattggcaaaaaatataaacagacgttttcttttttctttttttttttttgaggcagagtctctctctgttgccaggctggagtgcagtggcacaatatcgcaatattggcacactgcaacctgcgcctcccaggttcaagcaattctcccgcctcagcctcccaagtagctgggactacaggcacgcaccaccatgcccggctaattttttgtatttttagtagagacgggtttcaccatgttaaccaggatggtctcgatctcctgaccttgtgatctgcctgcctcggcctcccaaagtgctgggattacaggcgtgagccaccgcgcctagctgacatttcttaaaagaagacatacaaatgggcaagcagtacatgaaaaatgctcaacgtcactactcattatggaaatgcaaattaaaacttgataagatatcacctcaaacctgttataatggctattaccaaaaagacaaaagataataagcgccagagaggaagtggtgacaagaaaacccttgcacagtttggtgagaatgtaaattggtacagccatcatgtaatacagtatgcaaattcctcacaaaattaaatatagaactaccacatgatccagcaatcctactaggtatatttgcaaagaaaatgaaattagtatgtttaagagatatctgcattcccatgttcactgcagcattatttataagagccaagacatggaatcaaccaaattgtccatcaacagatgaatgcataaagaaaatgtggtttatatacacaatggaatacagtcatgtgtcacttaacagcaggacatgttctgagaagcacgtctttaggctaacatgatttattgtacttaaactttttcagcctactactgcacacctaggctatgtggtatagctaccttgtatatgtggtctgtcactgactaaaactttgttacacagtgtatgaccctactattcagccttgagaagatggaaatgctgtcatttgcaacaatatggatgaacctggaggacattaaattaagtgaaataagccaggcacagaaagacaagtaacacataatctcacttatatgtagaatctaaaaaagctgaactcatagaagcagagtaagatgatccttaccaagggctgtgaggaggattaggagggaggcggggtagatgttgatcaaagcatataaaatttcagttagataagggaataagctcaacatgatgactacagttaaaaacaatgtactatattgtattcttgaaaatcactagaagcatagattttaagtgttctcacacaaaaaataagaatgtgagataatacatatgctaattagctatatttagccattctacactgtatacacatatcaaaacatgatgtatatgataaatatgtataattttgtcaattaacaaaaataaataaatatttaaaagttattctatcatatctggttaatccactaatacacatacacactaaattgtaaaaatattgataatgcataaaaaaatctaaattttgaaaaattataaaactccttttccctcaatcttgatttcccaaaaacagtctttacgcttgtaatctaaaataacagataatactctacaaacatttatactacttaaaaataaacatgttctgtagcacctttaaatcactgtctccattaaacactctatgataaacataatttaataaaaacacataattttacccagattcgagaccttttatgaaaacaagcaagaaaatcctctcttaaaatgtgtaaagtaactttaagtaagcatttattttattattacacaacagtaatacaatacattattaaagagctggcctctactatttggatagaaattaggcttccagtgatttcggtaaacatcatttttatttatttatttttgtcaaaatagaaaaggctatttttcttaaaaaaaaaaaaaaaaagaaaaaaagaaaagctctaaaataccaattccagcctcttttagatgtttaaataaaaattgttttccctttcagctcccagataatagcaactaaatataaaattagaacatataaagcattttagtttaaattcttacagattaaacgacatgcattaaggactgaatactgtctttaagtctcaaaaatacaaactcttaaagcattaccttgtcgtacctgttgagtgacaggcttattaaatcacaaaggagagtttcacaatgttcttcaaataggctgatgttggttaaattgtcacttgccagattcataaactgatgaccatatacaacttgttctgaaaatgtaataaaaatagttttaaaatacagattttactaagtcagaaaggaaaaagtgactgtacatctttaaattataacaaaactaaaacatacagtttttaatttttttttgcaaataaaatatgaatttgaggacaaccttctcatatgagcactgataaacattatcttcaaaagtttcttttttttttttttttgaggcgaggtctctgtcacccaggctggagtgcagtgacgcgatctcagataactgcaagctccacctcccaggttcaggccatcctcccacctcagcctcccaagtagctgggactataggcacccgccacctcacctggctaattctgtttttgtatttttagtagagacggggtttcaccgtgttagccaggatggtctcaatctcctgaccttgtgatctgcccaccttggcctcccaaagtgctgggattacaggcgtgagccaccacgtccagcccaaaagtttctaattcttccaagtaacatctaataaacttctcttttcctaataagtctatctttaagaagcattaatgcaacacaacttaaaaaaaaaagagagagaacaacataaaatcttcatccacatttctaaccaacaaagcctttaaaacattatttttttaacaaatactgataaactgatcccatgcaattgttttatggcataaaatagggcaaaccaaggtaatagataaccaaaatttttacttatcagaataagtccacttgagtattactctaagaatatattaatgtgaaatacagagtccacatgagaggaaattatatactggtgtacatcttcatatgtttctgtgtatgaatatatgtaagtatatacctatatagacatatatatgtaagtatatacatatatagacatatatatgtatgtatttattaacagaaaagcaggtgtaggagtaacagacatctttacaacctaagtgacaggttgccaatggaacttaaaaatgccaaagagcaacatcaagaaataaatgggcaacatatccacaaggataaaagatatttatccataatatgtataaactcctactaaaaaaagaggaaaatttgcaaaatacaatgagtaattaataaagcaaatatagacaataaaacgtaaagatgttcaacttcactagtaaccaagaaattgcagataaaaaaaagccatttcatttttcacatgttagctggcaaaaaataaaatataattgataatatcaactactggcaagagtatgaagtaaaggcacactacagttaatgcctatatatcagcaggacttactattcagcaaaacagcagcatatacatattaaaactacgatgtgccactctacttctaagaatattttacagaataacttgtacgcagattaaagatatatttctatacacaagggtgttcagtgaaaaatgatttgtaaaatcaaaaaatgaaagtaacttcaatgtttaaaaataggcatggctaaatatagtagaaccataacatgcagcctttaaatggataaagtagaactataggtactaacataaacagatcgctaaaacactgataaatgaaagatcacactgaacagtatgatgatcatatctgtggttaaaaacaaaaacaaaattttacctatgagtttctatatatgtatactaacagatagaaggtaaatatggaaagataaaccaagctgttcccaatagttatctctggaaagaaaggagtaaaacttttacttcatactttgtttactatttgatttttttttaaatatcagaaagcacttattacttatgtaattttaaaaagcaataaaagctgattttaaaaagaatataaatcataaatccataaacttactcaatttttcacccagcatgtaaagaatttctagcaccagccaatgtatatccaagtggagatgtaataaatgccatgacggtggaaaaagctgtggatgacattatcaactgtgattgagaattcattaatattttactaggtatttcatagcatgtcacaatactcctccataaacacaaggataaagaaccaattaacctaccactattcaaaagctcagggaaaacctctgtcttgttcattagaggattctttcactgaagatctttgaaagcaggaaatattttcatctgttggtttaagacaaacccaccttggggctgctgaatagacttgtatagtaaaggtaccttccaaccaacctctgattctactacagctgcaaggcagtaaaagaattttttaacacgtattttcataattttgttttagaatttagctaggaaattttttttaatgtatgagtacccaggaactcctataaaatattttaacaaaagaactttagactgtcatgtagacattattgtcatctcattaagaaacagaagttaaaagaggtgaaaaaatttacctctcaattcatgtattagtattcaaactcaattctacctgagtcaaaacccagcactttcaagtattgtgttatactgggttatcaataaccttcctcctgtcagcatttagcatcactataaaaataaatacaatgacataacatgttccattaaaacaaatagaaagaatgatgaagagtagacctgccttattaggtatacaaacaaaataaaatgctacactgacaaaacaatattgggacagaaatagataacaaacagcaagaacagacaagacagaaataaatttatgtggcatctgaaatcgatgggaaaagtatgggtcattcaataaaaaataagatttttaactttgcaagaaactaaagttagacttctcacctcactgcatgtttaaaaataacatgaattaaagaaataaaagcaacaatcaaaatattttaacagcatagataaaacaaaaaacggaaaaatataactatctaaaaaattcaaatcgacctagaaagtcagcttacttgatgaaaaagtaaataaaagaaaatatttgcaatacataattctgaacaactaatatatacctagagagttcttaaaaaataaaagaagctcaactggaagtaccaattaaaacaagacatttcatatacaagactgttataacaaatatataaagtcttgaaagatgctttttattttattatgcttttttgtttcagaaaagaacagtattttagtgtgtgattttttattttttgaagactgtaaagttcccctgctttaaaaatttagtcttctgagcttcaaataacctatcttttcaagtctgcctaattaaaaagcctatgaaaggcaaaacctagtttgaggaccccagtgcacaaatttttatttctgctgctatataaattattcatttttatttcttacatatttgatggataaccagaaaataaaaaccagtccaatttacagaaactagtaaggaaaatatccctccctcaacaatctactcatgaatctttttattaaatgacgtaattaaaagcaattacctatttgttttctatcgattagatatattaacttgtaaattcagttagaactttgcttttattattacatatattgatctctgatgaaaaacttgtttctgcttcatttcacagaaatatgtaaacatttaattctacttattttatttcttgagatagggtcttgctctgtcatccaggctggaatgcagtggtgcaatcatgtctcaccacagcctcaacctcctgagttcaagggatccccccacctcgaccacctgagtagctgggactacaaggtatgtgccaccacactggactaactttttaattttttgtagaaatggggtctcgctatgttgcccaagctggtctcaaatcctggattcaaacaatcctcctgcctcagccacccaaagtgttgggattacaggcatgagctaccatgcttagccgtttttatattttaacaaagatatattcataaagagtaaatattattcaaaacggtaaagtcaaatataatgaaaggggttgagacttcagggaatctcactgtgaattaccataatttgttattcatataagctcccattttcataggcagaatctattacttatctataagctaggcacggtaacaatataaagttttaaaaaccaaacttcagagggaatgattatcacaggtaggaaaaaaagggcacagtcaaaacaatcttaatcacattccaaaaaggcctcaaaagtcagaatacacataatgatgtggtcttgaaagttttttttataagctgatcttgaatcttactgtaatatatgataaaaatttcagaaaataaagattatttcatttgctttaaaattttcagacacttatactgtcataaatcaagagaatagctactgattcaatgactactatgttttaataacttcatgtatatgaatttatttaattcatccaatgattctggtaagttgtaagaattacacagatgtggaggctgaggtgtcatttgcccaaaagcacacaattaataaaaggaggatggggggcaagaatttcaactcaggcagtcaggttccagagctgtaattctgactaatttctctccttcttgaatgaatactccttgtggggagaaaaagctgataatttaaaaatcaaatgaaacaagtcaaaccttaatctggttttgatttacaaatgctcctatattaacactgggaagttcagataggtgtccaatatacaagagtaatccatgaagctcatcaatcaacactgagggaagctgagcctccaaagcctcataaggatggacaggaacatgactctcagcattctgtactttcagatacctaaaaaataattagataaaataaacaactagagtctgtgtgaatacacacagaaattcatgcagtgatcaaaatactcatctgatatcctacctgaagatgaaaactttaacataatggagaaatagtacacactgctgcctaatattgtctgctttgcagtgtagagttgataccttccctgaaaccaaaatagacaatgttaatcatagttcaaataattatcatgggcagtgacaaaaaatgttgtaagccataccggcagcaattctctatcttgtaacattttatattaaacattctcttatggttcttgctccccgctactcctcaaaaaatgctcttattaaagtcaccaatcacacccacattgcccaatctaatagacagtgcctaccctcaagtaacttgctcccacagtagcactagctacacctggcttcatggtgccagataatgagtcttctttcttcctcatgtatcctttgtcctacctcttttattggctcctcctcctcaattctattattaatatggtctcttcaagactcagtcctgaatcctctactctctgtatatctcttcccatatgtatgatctcatcagttcctttattaataaatgataatgactctaaaagggttatctacaaccccatctctcctttgcactccagaccttccgtgttaaactgcctaacacctatacttggattgctcagacagtgcaaataatacctcctttgatttctttcaaaacctgttgatgctgtccttgttttcagcctttcataaaatggtgccaccagtggcctatatggttcttgattcttgcatttcctttaacctcgtatctaatccttcagagtcctattaagttaataaccaaatatacattgaaactatccattttccctataaacacttaaaccaccacaatagcactcttcacaggtctttccatgctctcttttgtccccctatacactaagtaaaaaatctgcttaaaatgtatatcaatttatcttgttcccaagtcaaaactcttgaaagaatacctattatatttagaataaaatcaaaactcctaataataatttataaagctctgaacgaccttttaatagttgctgcctttctcccaacctcactccatgtcagctttccctcacttacttcagcatttatatcagcaataattatctaggtagttactatgggcaaaacactaataatcattatatagagaatgagtaagagacaatctagtaaacaaaagcaaagaaaacatgatgagaattataggctacaaatttacagccatactaaacatgaaactaaagtttaattcaaatgaacaatcatgccactactgtggcagaatagaagcataagtgtgaagcagttgtgtaaatacctccatattaaactgcatttttatggctttatttcacccataaaaagtcatatcatcccaattttcacaattctcggcccattaaggcagtactctcttaaaaataactgcagtgaacatctgcatccaggcaagacggagtaaaataatcagattgctccatctcccactgtaaagctgaaaaccataaaaattacgtcaagcaagttttcaggctctggacacaagacaatataagattgctctcccagagagaaactgagccctacaactgtaccagctccccacctagagacagtttccaggcttcaatatgaggaagagaacccaaatacagcccaactcactctttgagatgaggagatatgggatccaagtttagggaagtccaaatttgcagggcaaaagtacccaagaagaaagaagctatacaaaatagagttctggaagggtacagaagtgtccctctgagatttaagtatcgatctgttcaagcatgaaaaatattacccaacgccagggaaaaacaccagaaaacaattccctataaagagtacacaagccagggaatagttcaagttctcaccagcaagcatgaaaaaaaatctcataatagactacgcacgagaaagaattctcaaagccttactagactaatttactaggctaagttaacattaaaggctgctttttaaaagtcctaccaaaatttaaaacaagcctcaagaagaaccagtggattacaactacacaatagcgacccataacaaaattcaacatctagtttaaggaataaaaatccagaaagcaacaatgtgaaacccacaatgttcatctaacaataaaacattactatatattcaaagaagcagaaaaatatatcacagaatcaggagaaaaactaatcaatacaaatagtttcagaaatgacagtgataaaagaattattggccgggcatggtggctcacgcctgtaatcccagcactttgggaggctgaggcaggcgaatcacgaggtcaggagatcaagatcatcctggccaacatgatgaaaccctgtctctactaaaaatacaaaaattagctaggcatggtggcgtgtgcctgtaatcccagctactcgggaggctgaggcaggaaaattgcttgaaccagggagtcagaggttgcagtaagccgagatggcgccactgcactccagcctggtgacagagcaagatgccctctcaaaaagaagaattattaatagcagcaacaacagtggttataatgtatactccatatattcaagatggatgaaaacaagcatgaagtcagaaacagaagacattttaaaaaatccataaggaatgtctagagaaaaaaaacacacacacaatagctgagacagggtaacaccaacaattatatttaagaatagctcttggctgagtgtggtgggtgatacctataatgctagcactttaggaggccaaggcgggaggatcacttgagcccagaagtttgagaccagtcttggcaacatagtgagaccttatctctacaaaaaattaattttagtcaggcatgatggcgtgagcctgtagtctcagctacttgggaagctgagatgggaggatctgcttgagcccaggaggtcaaggctgaagtgagtcatgatcgcaccactgcactccagcctgggcgatggagtgagaccctgtcttgagacagagacaaagagacggaaagagagaaaaaaaacagctgtcagcaaaacatgtcattaagtatgttattctgcctcaactggaaattaaccctggaagcataatggctagaacaagaactatactcatctggcagtaagtaactacatagggacttcttggcacagctgaggtccaagggtagctacacaagttaatgaacacagctacatggcagggacatgttcatgtatggataatatttaacaccactaacttgtccaaaatctgtcattaaaagcttttttaagcaacaaaaacagccaaaatgtcagtgtaacaaacaaccatcttaacaaatagtccactgcagtggtttcaggttaataagtgtaataataataatctatcataataaatgccttccatgaacccaatttacttaagttattctacgtaaaggtaaaggtattttggttctttccactataatcttttagtggctccacaggagttccaaaataaaaatcatactctctgtcatggtttacaaagccaactctgcttttatcccttccaaattcatcactcacacacattctgatccaaccatatgtaattaatatttaatccatgctctctaaacttttatgtttttacacacatcacgtctttgtttatacagttttatttttttctgcctggaattcttcctgtccgaaaaacttttcccaaatcttttgcctagctaatttcttcccatctgtgaagacccagatctggcatcatttagtgaggagctcacagatagacaaagcccttggcttccacagcagcttgtacattcctttatcaccgtaccttttcatttaccaagctgatgtatgcttgcatgtctagctgtctacacaactgcaaactcatcagcagcatatttttcctctttgattcgtcagtaccttgcaaagtacctggcatgaaccagggacccatcagatgataatgaaacaataatacttaacatttacaaatcacgtaacatattaagaaaacaaaaaatataaaacagcctaaaagctgatagctaacagctaggccatggtatcccctactgaaaataaacaattttcataaaacataaaaaatagtccaggcacggtggctcacgcctgtaatcccagcgctttgggaggccgaggtgggtggatcacaaggtcaggagttcgacaccagcctgaccaacatggtgaaaccccatctccaccaaaaatacaaaaattatccaggtgtggtggtgtgcgcctgtaatcccagctactcaggaggctgaggcaggagaattgcttgaacccagggggctggaggttgcagtgggccaaaatcatgccactgcactccagcctgggtgacagagcgagactccatctcaaaaaataataataataataaataataatgatacagggccactccattacagtgaaacaagacaaaaacaaaacctctgtaaccatgtctgaatacaaaacatggcactatgcaatcacacacactccaaacaaaacacacacacacacacaaaatgaacaaaaaaacacatcctccctcttccagtgaccaggacaatacttttttactaattaggatgctccctttgtttgtctcacctcctagataaaaattaaaatacccactcttcaaattgcccctgctaattaacagcatccaatccagaatatagccttatcccccttaagccctacggaaaatcaccagaatgagccccaaacatatcacaagtcccttcctactccctcttactgacaagccccagcttttccttgtaatgtgtatttttccttttttcataatctaataaacctctgtttgaccaaaagtgttccaggtagtctttggttgctaggcatcaataatggtagacactgtgttaagcacttaacacgctcaacaaagttagaactattacttgacgtaagacccacaattagctagggttggaagccagggtgacaaggccatgattctaaacactgcactgcaccaaaattactagaaaggagaagcagccagactgcactaaaacacactgcccttcaattccctttattaccttagctatacatgcggtggctcatgcctgtaatcctagcacttcaggaggccaaggcaggggatcacttgaggtcaggagtttgcgatcagcctggccaaaatggcaaaatcccatctctactaaaaatataaaaattagctgggggtggtggcaggtgcctataatcccagctactcgggaggctgaggcaggagaatcacttgaacccggggggcagaggttacagtgagctgagatggcacctttgcactccagcctggacaaaagagcagaactccctatcaaaaaaaaaaaaagcaaaaaaaaaccaactataccaatctaaacaaaagaaaaaaaaatcagtaatccatcacacaccaaaagcaaacacaaaagcagaaagcagaaaagaaaatcaagaagacagcatgaggtctggcactgtttagttctcatttaagttctctatcccactccctacctccaaaacaagtactaattctcttcagagaattttagcttaagtcggttttacctttaaaatctacagatttgggaaaatactatatatctcagctacaacaaaatttaaaaagtcatacttttctgaacactaaattcgtaaacttctggcctaatgcttcctctgtattatcatgatatgccaattataccatcatggacccatgtgcaactcactataatgaagcaccattcccttttgcattaaacacaccttaaacttaccaaaatcacaactggactgtaacaaggtttccaagttgtacagttgttgcctaattttaaaaatgtaaggtgagagttaattttagaacactttaaagcatgtaacaattacgtggacaatgtttccaaattacacagcttcaatacctctttaatttggggatgatgattaataccttgtgaatgttaattaaaggatcagcttcaggtaatgaaaactttaagaaaagataaaatacatctttgcctgaccttccaaaattatctattaaagactgcatatatctcaaaaattatttcaaataccatagccttcaccatcagcaagatactgtttatatctttaagtttacggccgggtgtggtggctcttgcctgtaatcccagcactttgggaggccgaggcgggcggattacgaggtcaggagatcgtgaccatcctggcaaacatggtgaaaccccgtctctactaaaaatacgaaaaaattagcccggcatggtggcggacgcctgtagtcccagctactcgggaggctgaggcaggagaatggtgtgaacccaggagctggagcttgcagtaagcagagatcgcaccactgcactccagcctgggcaacagagcaagacttcgtctcaaaaaaaaaagaagtttaagatggggtgcagtggctcccgcctgtaatcctagcactttgggaggccaaggcaggtggaacacctgaggtcaggaattcaagaccagcctggccagcatggtgagaccccatctctactaaaaatacacaaaaattagccgggcgtggtggggggaccctgtaatccgagctactcgggaagctgaggcaaagaagcgcttaaactcgggaggcggaagttgcagtgagccaagatcaccccactgcactccagccagggtgacagtgtgagacaccctctcaaaaaaaaaaaaaaagaagtttaagatacataaaacattctaggttaacagttacataataaaattttaaactgtatcatacagttatacaatagaagttcaaaaaaggaataatgtagactaaagtatcagggaaagctgttatttatcatgttccatcttaattcctgatagcaatttcttgctattcttcctagttgatttcaaagtctttaaaaattaacccatatttataacctatgtcctagataaagactcgctcattctgtaatcttcaggattacagaggatcactcactgagcctgttctatcaataaaacgtatgacatggcgtagatacagtttaagtctcttcaaaaggtttcatgggatgatggtgagagaattccttccacctctccattttcctttaaatgtatcacatatagatttttactgtgttttggaataattagctttcaataactgactcctgtttaaaattacctaaaatctgaatatgaactgtgtcttaaatgataatgaagaactttaatttttattaattgagatgagttttttttttgagacagagtctcgctctgtcacccaggctggagtacagtgggcaatctcaaatcactgcaacctccgcctcctgggttcaagcagttctcctgcctcagcctcctgagtagctgggattacagacgcatgccatcacgcctggctaatttttgtatttttagtacagaaggggcttcaccatgttggtcaggctggtctcgaactcccgcctcggcctcccaaagtgctgggattacaagcatgagccaccgcgcctggccgtcctcatcgtttttaaaaagcacatatttttaagaaattcatactgaagtatttatgggtgaaacgacatgatgcctaggatttccttacaaatacttaggccaaaagaagaggagacaagacagatgaaggaaatgtaataaaaagttgttgtttactgcaactgaaggagggtatatggatgttcattatattattattttgtgtatgcttaaaatttttcattaaaaaaattttaaatgttgtccaaataattaatatttctattacacagtctaaacaatttatttgttaagaccatactctaaagatcactgaaagactatggctattgcacaacaaaaatattttaattttcttctaaaaattatagttcaaagccttaaatatttgtcaatacatgtgtcaaatgcaaagaataaagattctgaaaacgcaactcattaaaaccattactcatcaggcattgctgcttgattattgttactggtaagataatcaagtgagcaaccagcacaattcctctggtcttttgtaatatcagtattagaagccacccaacaacgtaatttacaaaagtgaacaacacctacactcacagaaagttataacgaagaaatacctgaataaatgaaagagttctctagatgaattcactaatgctgtttcagtaacccactgaatgccaaatatttccaaggtatcttcttcaaaattagttggtaaagggtcaagattcaaaatcaatctgaaatgaaaattgtttcaatctcataaaaagtatactaagtaccataatacgacggctcttttctttacattatttgaatccatattatacatgacatgtataaaaagtcagaaaatgccttggtactttacacattcaagattacaatagctagactgtattaaaacgtcaatcttctatattgataaaatgtacgactaaagtgtaatgtaacttaagaggaaaaatcaacaagaattctaaaaaacatatttctgcctgtcttcaccagtagtcttcagttgtagaatttcatcctttgaggggacatttaattttaaaactgctaacagttattctgagccatgtctggagaatagtatccaactaatgaagttgagtattctatttaagatttctaacaaggtacaactataaggtcaacaaaaatagtttcctcactgaaactgcctcagcaggtattaccaaaatatttcaagaacagttttactgtaatatatatgtacctgcccaaggcaaaataagtctatacacttctatatgtgcaggtaggattagaaggaacaggggcaataaaaaatgtttgtctctcttaaatattactggaaagctctagaatattatcacactctttagaaggaaatactactgcaaaaggctcagatagttaggaattcattttaagtagaagaaaaattagtgcccagctccctacagtaagggaacatcagttaccaaggaagttttccctaataccccaaatactttagatatgcccttaccaagaagccagcagaactgataatcatttgtacccttatgatatactaagctgatttataaaacacgacttggtgaacaccaaagtttaatgggctgaaataactaacattcctaaaaaactggtgaataatcagatgagggaaaatgtctctgagttttacctaccgcttaagggctccgctgcagaggtaggattctccagaaaaatgttttcctcctcctctgttgtcaacagcacaagaaaagtaaggaggtttgcaccattccgtccccagctccagctctaagctgtcagtcaggaacgtcgatgcagcagaacagttctccattgtttacttcatgttctgaaacacttggggttcgtcgtatcattaagggctccaaagagaaggtgtgaagagattcctgttgggggggggggggtggggccgagagagtggggattacttcagaaagttctcaagacgtccgccagcaggaaggaaaaacaaacgaacaaacccagaggccaaattcccaattccccctcgccctccgtccatcaaggctgtcagaacttaagacaaaatgcacaaccaactggctgtggcagggacctcgaaatccggccactaagtcgggctctgcagcccaggacaaggtgaaaagcaaagaaatgtctgcaggacatagcgtcccgggcttgcctagaactgcgccctccgcaacgtttctaaaccactctccgcccgtttcccagcagcagggtggagaacgctccctccccggctcggggtggaaattaggaaagcaacccctagggccaaccccgaccctccaaggaggaggcgagacccaccaggcccacgcctggcagcactcgggcggagaaggcggggtgccggtatcccgcgtacccggctgcagcaaggacccggggcgtcggttacccgcggtgcctgtcgtacccgctcacatttccagctcccgaaacctgcctcctgtgacccagaccaccaacaggaatctttggggtctaaaccgcaaacaggcgaaattcccgccaccgcgcgcccgcgctccggaaaggcggggccacggcgcagccctcccccggctaccaatcgcctcgcgatatctgcgcggaaacagtcggagccccacgaattctcgcgagagtccgtcagtccgggacgaggtactgagaaacttttttttttgtacctttaattggtgcgttcggctgaaaggcggggcctggtaaaaaaaaaaaaacagaactgctgctgaggcggaggagaggacttaaggactatgggtttatcctctggccggaccaaagagaagatatttactccagtgagtgcgaagtgagtgcctcgttcacacccacagtcgcgccgtcccctcttcccgctctggggccagcaactcttgttagaatgcagatgccttttgtccatggactgtgaggcaggcaagtgcaacaattaattttctctgtaacagatggaacaagtagacagaaaattagtatggatatggaaaacttggaaagcactaaccaacttgacctaattgacgtttataggtgaccaacccaacaatagcagaatacacactcctgtcaagtgcacatgaaacattcactaagcgataccatattccgagccataaaacaaatgtcatcaactttaaaaagatttaaatcgtacaaagtgtatagtctgatcataatggcattaaactagaaataaagtagatacttgaaatactctaaatatttggaaattaagaatcatacttctaactaacctgtgaatcaggaaaaatcacaggaaaattagaaaatacgttgaattaaattaaaatgaaaacactaaaatttgtaacagtacctgcttacattaaaaagaagaactcaattcaataaacttttgtcttaagtaactagaaaaaacccccagcatattgaaaccaaagcaagcaaaatgaatgaaatgataaatagtagaaataaatgggatgaaataaatggaaggaaatacatgcaaaagttgtttttctaaaagagcaatataattgataacccccctacccaaactgataaagaaaataaacaaattatcagtatcaggaattaaaaaggtttcatcactatgaaatttagtcattaaaaggacaaggatattaaaagaacattatgaacatttttatgccaataagcataggtgaaatggacaaattccttaaaagacgcaaactgtcaaaaatcaacaaaagaagaaaatttgagtatctctgtatttatcgtagtactcagaatctttggttaagcctccctcctctctctctgcacacacacacacacacacacacacacacacacacacacaccacttcttacaagaaaacttcaggccagggcaggcacagtggctttgggaggctgaagtaggtggatcccttgagaccaggagttccagaccagcctgggcaacatggtgaaaccctgtcccttgtctccacaaaaaaaatacaaatattagccaggcgtggtggtgctcatctgtagtcccaactacttagggaggctgaggtgagaggatcacttgagctggagagttcgaggctgcagtgaactgtgagtgtgccattgtactccagcctggacaacagagcaacaccatttctcaaaagcaacaaaacaaacaaacactctccaggccaaatggccttactattaaattctcccaaacatttaaggaaggagtaataccaattctatactaactcttagagaaattaggagattggatgcttgttttatgaggctagcaccacactggtatcgaaacctgacaaaagacaattacaatacaatatcacatgcaaacataaaagcagaaatgttagcaagcaaaatccagcagtacataaaaaggatgacatatgatggcaaggtgcagtggctcacgcctgtaatcccagcactttgggagaccaaggcgggtggatcacttgaggtcaggagttcaagaccagcctggccaacatggtgaaacctcgtctctactaaaaatacaaaaattagccgggtatggcgccatgtgcctgtagtcccagctacacaggaggctgaggcaggagaatcgcttgaacccggcatggggaggttgcagtgagccgagatcgcgccactgtactccagaacaagactccgcctcagaacaaacaaacaaaaaggatgacatatgacaagaaaattagattcatgttaggaatgcaaggttattcaaatttctacaagtaatcagttcattatatcaagtctataaaaagaaaaactgtcatctcaatagacactgaaagatcacttgataaattcaacatctattcatgataaaaactctctgccaactaagaatggaagaaaactccctaccttatatgtgatatctatgacaaacctgctattaatatcatacttagttataaaaatgtatgttcttttcctaagattgagaaaaaggcaatgatgtccactttttccacttctctcaacattttactggaggtaactagtcaatgcaataaggaagatgaagaaataaatgtcatatagattgaataagaagaagtaaaactgtcttgattttcagatgacataattattcatatagaaaatcctaaaaaaatctctacaaatatatataaaaactatgagttcagcaaggtggcggggttcagtgacacacaaaaattaattgtattttatagacatgaaaagacaatttgaaaattagagtttagaaaacaacaccatttaatgacataaacaaggtttaaatttaacaaaatatgcgtcagattttgtttgccaaggattccaaaatattgctgaaaaaaattcaagaatattcaagtaaatagaatgagatagcataatcataaattggaagactcaatattattaaaagttcttctgaagtttatctatggcttcaaaggactgccaatcaaaatcctaatcccagagaactttcttttgtagaaattgacaaatgcattccaaaactgatatggaaatgcaaagggcctagattaaccgaaacaattttgagtaagaatagtgttgaaagaattccagtacctaatttcaggacttgccattaagttacaataatcaaaacagtatgattttgatctaagggtagacatagccagtggaaaagaatagagactccagtaacaggcccccatacacgtttgatcagctgctttttggcaaaggtaattccatggtgaaaggatagtcttttcaacaaatagtgagagaactattggatactgatacacttaaaaatgaacctacctcatattataaaatttaacccagtaaggatcatagacctacatgtaaaagctaaaactcttaaaaacttttagatattcagcttgctagtaatcaagaaaatgccagcaaagaaaagcaagaaataaggctagtccacagaagaaaaatcaagtgtgtgtggtatggtatgatgtctgtcatgaaatccaagagaagtattttatgaaagaatgggtaagctaataaaggaaaacagattaatcattggtattggcaagaaataggtcattactaatgttgataaaagctgtttaagttgagtagttggggaaaaacatctgataggagtgggtcatatagaaaatgggaggtgaatcagcaaatatcaaaactttacccaggaatttaattgaaaataaagcataaaaataggacagagggacatatagggatcaagaaatggtattttcaagataaaagatgttagaacatgtttgcgaggctatggcagttattaaatggaaagaaaaaagatgctgaacagaaggggaataattgcaagaataaaggcattgaaaagatgagaggggatagtattcattacacaaatgacatatcaacctctgataggctcaagaaaaaatttttatcctaataggaagagtaaaaaaaaaaagtaaatcttaaaaatacagaataagatggctggaggtggtgaactacgtgttggaatgttgagttgtttttgttttatttcacctatttctctatgacacatcaactggaagtgagaaggaagagtagttgttagaaattagagaagaggtgcaatattgtcatattggtgagtagaaaagtatatttactaggcaaagataataagaatgtctggaagtgttgagttatcatttgagatttgtgacaaaaaattagagttcagtcatcatggttttgtcattttctccagcaccattcagctacttggtaaaagagggcaggacaggccaggtacggtggctcattcctgtaattccagcactttgggaggccaaggcaggtgaatcacttgaggtcaggagttcaagaccagtctggccaacatggtgaaaccctgtctcttctaaaaatacaaaaattagccagttgtggaggcacacacctgtagtcccagctactcgggaggctgaggcagaagaattgcttgaacccgggaggcagaggttgcagtgagccattatcgtgccactgcactccagactgggtgacagagcgagactccatctcaaaaataaataaataaatagaaaaccaacaacaacaacaacaaaaaacagggaggacatatgatagaatttgaatgttgtataataaatgaacccattctaacttgctgctttttaaaaaatatacccacaaaccatctatttaataatgtattcttgtgttttcaggtatcagactcaaagtcaaacaatttaatatgaatgtcatgttttgtaggagggaaacttttcacaaattcaacttaatatgatatattccactgattgaaaggtctcagtttcagaaagtttatgattttaattgaaatcttatttaaagtttaagactgttccttcttatcccttaaatgtaaatgaggatcaccttaccactttatagtaactgctgttaagtctagaattggattcaacattgtagcaatatctgaccaatattaactccagttctaatgatcttattattacagttggacactgttgaggatacactgagatagctcaacttagttatggcttttagttctgtgctgtgctattgaaaatactaggttatctccatgagctatctattgtaaatgtttatacaacctactgtaagctgactttctgttgacccacagtattttaatgcactaattttgtgcaacagataatgaactcttaacctctcaagtgctactccctggcacacatattatgatttaaacaactacttcagtagcaacagagaaatgtagttggttaagaaggaacaactttcctataaaaggaaaaggacttttcatacaactgttcaaggcacttagtcattaacaagggaatacaccacatagaactttgaaaaaatctacatacaagaaaaactccattattgatcctcattcatttttctatagctttatcatctttccctcctgcttgtgctcttaatccattttcttttacctccaggagcttgatccttcaattaccactatttcttcaaccttcaaccactccctctctcctgtcttctttcccaaagcctactgtgatagacatcttctaagattgctctcagtaatatctgccagtattcatgtccttgtgcagtcttctccccttgtgtgggccgaacctaaagacttgcttctattgaccagaataaggcaaaaagtgatgagatatcacttccacaattagtttacaaaagactgtgattacatcttgctagaactctctctctcactaacattcttcccctgtcagcttcttgattagttcacttcgatgcagtaaacttccatgttagaaaggcccacatggcaaaaactgagagcagactctggacaataggtagtgaagaaccatggtcctcagtccatcagtccacaaggaactgaattctgccaacaatcatctgagcgagtttggaaagcagattcttctgcagttgagatttgagatgactaggcctgtatctattgtatctaatacaatagatagctcatggagatatatagtaaataatttaatcttgtccaaaaaggagtctgggcctttgcccttggcttatgagaggtaatttctaagcctctggaatgttgtgtctgataagagtgtcttttttgcctggggcctaggatcatacaggataatctaacagtgtgatttgggctggcagttggccatggctgaaagatcaaaaatgtaatttaggatgggtctttgagtcacgtgatatcagtctggagactgagatcaaccatgtgggtaatcactctaacatgcctgcataatgaggacccactaaaaactctgaacactgaggctcaggtgagcttccctagttggccgtattctgtgcatattttcacacgttgatgctgggaaagtaacacatcgtgactccactgggaaaagaaaacagaagtttcaccaaacagaagtttgatactttctcatatgggtttcttctcttggctgatttgaatctgtatcctttccttgtaaccataactgtgaatataatagttttcaataagttctgtgaatttctctagcaaattatcaaagattagggtggttttgagaaccccttggacctataattggagtgaaaattgagggcagtggtagtgtggactgtctgcccccaacttcacggttggctaaactattttagcaacattgctgccagtcacccatggtgactgacaacttgactgcacctgtgaaagtccttgaagcaaaggattcagttagcccacctccggatttctagatgagataataaaattttgttatcttgagaaactatgagataatttgttgtttcaagccactaagtcttggcgtaacctattacatagtaatagataattaatataactaatagcatacttttaaaaaaacaataaagcttgcttcaagccaagagttcaatatcagcttggggaacaaagcaagaccctgtctctacaaaacatttaaaaaattagctaggcatggtggcacatgcctatagtcctagcactttgagaggcagaaacaagatgattgcttaagcccaggagttggaggcttcagtgagctatgattgcaccactgcacttcaacttgagtgaaagagcaagactctgtttctgaaaaaatttaaaaaattgaaaaaaaataaagcaaccaggcatggtggttcttgcctgtgatcccagcattttgaatggcggaggcaggtggatcatctgaggtcaggagtttgagactagcctggccaacatagtgaaaccctgtctctattaaaaatacaaaaattagccaggtggtagtggtgctcgcctgtaatcccagctacttgggaggctgaggctggagaatcacttgaaaccgggaggcagaggttgcagtgagccaaaattggtcaccgcactccagcctgggtgacacagtgagagtctgtatcaatcagtcaatcaaccaataaagcaaaacaaaacaaatcttgttttcttgtatttaaatagtcacattgattccaaatctaaccaaatgataataagcacccttcacgtctcatgctctctatatatcttttaactaatatccttatttttagagcatttttaggattattaaaaaaaatttttttcaccttttatttttacagatggagtcatgctatattgcctaggctggtcttaaactcctgagctcaagggatcctctcattctcaattcagcctcctgagtagctaggactacaggcatatgccactgcacccagcttgaatttttaggtttacagaaaaatcgaacagaaaggacagagagttcccatgcattcccttacccttctttgtacataaattaccttaccctttttcacactctgtattttttcctaaccaacctactccaaacacattttctattactacttccatgcagattacctatttaaaataagctggagtgcagtggcgcgatctcggctcactacaagctctgtctcccaggttcacaccattctcctgcctcagctactgcaggcgcccaccaccacgcccggctaattttttgtatttttttagtagaggcgggttttcaccgtgttagccaggatggcctcaatctcctgacctcgtgatctgcccgcctcggcctcccaaagtgctgggattacaggcgtgagccacagcacctggccaaaattgagattttttattgttatgtcctcaggatttaggatagtacctgtatatgtggtaggtccttaaaaatatttttgattaaatgaatagaatgttgcctttagcgtttaactactgataatcatatcttagttttggaaatctttttgaaagatgttattatgtcactttcttttcctcaaaatttctgctgagggacaaacctgagaaaaatagctgtaatgtatccaatattctaactgaggtgctagaccactattgcaaaggaggtggccaaaatttacttttatcagcaaatttgcttttattagctcactctgtgtgtgtgtgtgtgtgtgtgtgtgtgtgtgtgtgtgtgtgtataaaataattcactggggggataaagtttctagagttaggatttctttagagactaaatatggaaaggtgcagtgttttcactctcctttaagctaaataggggaactacagagaatcactttgagaggctcacatgtatcttctggcacttggaacgcatagaaattgatccctgtctggatgctgacatctgaaggcaaaaggttggctagagtggctcttgttggcagggcaaggagtgagtgctgtggaaggaatacgctgtattgccactggggtagggaagtagtgtgtgaacccctgaggcagggagccagacctgggttgccttgggagggagcttgtccaagaggactgcttgcaggcatcgggtagcatcaacagaaagagactggaaaccaggtgctgaggggcagtcagtggcagccggcaagggaaggcacaaattggatcaacctctttgcttaaaatcctgcagtggcctcctattgtacttacagtgaaatctatactcctcacctttgtgatttgagcccttcctatgcccacagtcttatcctttactattttacacctctctcacaaaatgtcagccacatgaccttgtttcagttcttctcatacactgtattctttgctgcctcaacatgttagcacaaacagtgccttatgccaggacgatttttttctcttgctttatctaggcttggctcctttttgtctttgagatcttggctaaatttccttgcctcttagagacactcaatggacccctcaatttaacataagtttaataatttgagtttggcaaagttgcaagtggcataaaactcaacataaccgtaacttaacaagaaaaaaggtttctattccttttgtgagtcaggtagtcagtctagatctggtagacctttatggtgtcaggatccaaggatccctaatcctgtcttcacagtgtgtggcctctactttaagtgtgcatcattgtccatgagggctgttcctgctgcagccagtacacgtatattccaactggcaggaaggggaaaatgggaaaagggcacttctaaggtcaattctagaagttgctcatactacatctgtttacataccactggcttgaacttagtcacacactcccatttagccacaaattagacaagctgggaaagattatctttattctgggtggccacatgcctaactaaaattaaggggcaggttaaaatgcatctatgggactactgatagttgctcccacaaacacccatcagttctgttttctcacagcacttaagttatagaagctaaaacttttctcccttgtggaagctttctttgatcactctgtctaaaa

SEQ ID NO: 415 - DNA, 42447 bp, Homo sapiens
gccttccagaggacaagatgcttgtcctgaatttgacaggggtaggtgtttgcagagtggagaaaaagagtggaaattattgctaccacatgcaaaggcactaaaatctgaaatgatttgagcattaatgaaaacttttccatcagtctttgagttattcattatgtaacacacattttgggcaatgaaggatcatctgcttgagttattgctgggggcctgtagtgctgtcaggtcttgttaggatcagtatattggttagaacttcatgtcctaggctcgggccttacctttgcaggtcagtcaggcagattccataccgaatagcacagaggttaggaaaatagattctgtgccaaactgcctgagtttaaatctcagctctgtcattaattaccagtgaatgtgacttttaaaaaattacctaacatttttatgatttagtatcttcattcacaaaatgagaacagcaacagaatctaatttatcataagactattacaagaataaaaggagtcaatatagataaagctctgagaacagagcctggtacctaggaaactctacataagtgttagttactagtattacttgagactggtatttaaacagaaagctattttgttcattcagaataaactttgttcctttctaatgatgccccagtctcctagcatagtactttttaaatgttaagatacctaagataaattttgattcagaaagttgtttggaggaaataggcacagagtatttattccaagctctggtaaaggccagtgagatattcctacaccataataaagacatattcactattgattaggttacttctgtctcccacaatcattatcttactcctgagtttcttcctgcccatgtacagcttacagctagtggttcagggtggggagaagatagaatcgggaaagaatcccagaagtgctagacattaagctaagatctttttgataatatactcagggtgacctgtttgaagaactactatgctctactccactaactcccttgggtagaatgtgacttgggttcctaagctgtggaaggactttggaatagtcaaggaactctaagaattgctaaatgtccctgatagactagagagaaggaaggtttcaccatagaattagaactctttttcttttcttttctttttttaagacagtgtctcattctgttacccacgcgggagtgcagtggtgccatcttggctcactgcagcctcaaactcccagcctcaagcaatcctcccacctcagcctcctgagtagctgggactacaggcacacatcaccacacctggataatgtttgtattttttgtagagacgaggttttgccatgttgcccaggcttgtctcgaactcctgggctcaagcaatctgcccatgttggctttccaaagtgctgggattacaggcctgagccaccgtgcctggcctactatagaactgttgttacattctttggaaccctctactaagtagaggtggctcaggaactttaccttgtgggtctcaaaaacatgtttttttaggtttggcttggagatgatgcttccataaaccatcagagattcatgacacgttgggttgaaaagactgtagtgggatagagtttatgtgaccaataaccatgtcagccttaagtcctccaagacactggccataaatgctggaacaagtgaaggcaatatataatccaaataatagcacaatgtgttcacactgatcaagccttgtctggaagtttttctacttgattctttctggaatgaaggtaagtttataggcacactggagctcttatttagtaaagaccctcctgttccagggagctggttcagaaggccagagatcagtggcatccaataactcacggatggaccagtttgagacttctactgtggccatagacacaaagttcatcttcttttattctcatgaagaactgctggggctatctctgggatctcgaaggactttttatctgctgtctagaggggagagatgagtcatacaaagtaaagtgccaagttctaaaaaagagagtttagagaaaaaattgttgttgggaagtgggaatcaaggaaggtctcaaagaagacaagttgcttgtactgaattttaaagttgaggaggagcttgcatagtggacaagggagcagaaagacgagtgttgcaggaatacagcctgcataaccaaagattcagaaatctgaaatcatctgaatcttagtcaaaacatttcacattatactcttagcaatttcaatatgttttgaaagggcctaatactgcagggctgggaaagaaagttattctctttccagaaaagaggaagtttgagctgagtgttgaggacaggagtttgataaatagaatgtgatggaggagggctgatgctgcatccaccattctgtgataatgaaggaaaggctgaggacactgcagcgatgtcagcaatgacgtcttccagctactgaaccggctacattttgtttaggacacttaagttgagttttctgttatttttataaaatgaattcctagctatggagaattcagtatgataagtggagcgctaaaggtaagagactctgaaatatgaaactggctgactagaggggttacgatcacagggtttgaggatctacaacttttataggctagtggtaacagtggaaaaattggtcaaattattatctactgtatcttgggaccaagactatgtagtaacagcacggctatagttttagggaaaatgtttggaaaaatctcaggttttcaatgtgtgttacctattacttgcggttgaagagataggaaaagatacataatcaaaataaagttgggggtcattttattaatataaagtaacatagacttcaaaacaaaaaaaattaccagaaagttttatttcttgttgatatacagcttaatgcaccaagaaaatgtagcattttaacaattctaaacttaacactgtctaatacaagttttgaatacttgtatttaaatacaagtttacttatttatttattttttgaaatggagactcattctattccctaggctagagtgcagtgatgtgatctcaactaactgcaatgtctgcctcctgggttcaagcaattctcgtgcctcagccttctgagtagctgggattacaggcacctgccaccatgcctggctaatttttgtatttttagtacagaatgtgttttgccacagtggccaggctggtctcgaactcctgacttcaaatgatccacccgcctcggcctcccaaagtgctgggattataggcgtgagacaccatgcctggccaaatacaagtttagtcttcaaaatatataaagcaaaaactgaaggaagtaactagatgaaaagagaaattagaggacatatggattgggctggcaacaactcatctcagtgaccaatcttttaaaaaattatttaattatttattattttagagacagggtcttattctgtcacccaagctggagtgaagtggtgctaccatagctcactgcaacctagaactcctgggcttaagtgatcctcctgcctcagcctcctgagtagctaggactacaggcaagtacctccatgctaggctaatgtaaaaatttttttgtagaggtagggtgttgtaatgttgcccaggctggtcttgaactcctggcctcaagtctcaagtgatcctcttgctttggcttcgcaaaccgctgcgattgcaggcatgagccactgtgcctggcctaaaattttttttaattgatacgtattaattgtacatatttatgaggtacatgtgatatttcgaggcatacatacaggtgtattggtcaaataaggttatttaggatatccatcaactcaaacatttataatttctttgtgttgggaagatttcaaatcttcccttccagctatttcaaaatatacaataaattactgtcaagtaaagttaccctaccatgttactgaacactagaacttactccttctgtctaattgtatttttgtacccattaaccaacttttctttctcccgaccctcttcttcccagcctctggtaaccatcattctactctctacctctatgagatcaacttttttagctttcacatatgagacagaacatttgatatttctctttctgtgcctggcttatttcacataaaatagtgacctacagttccatcatgttgctgcaaatgacaggatttcattttttttttacagctgaacaatattgtgtacatataccatatttttctttattcatttgtctattgatgaacatttaggttgatttcaaatcttggctattgtgaataatgctacaataaacatgcaagtataggtatcattttgatatagtgatttcttttcctttggataaatacccagtaaagggattgctggatcctacggtagttctatttttagttttttgagacaccttcatattgttttgcataatgactgtactaatgtacattcccaccaacagtgtataagagttcctctgttctctgcatccttgccagcatttgttatttttagtctttttaatgatagccagtctaacaggggtaagatggtatgccatggtttacattttgtcatatacctcttggccacttgtatgtcttcttttgagaaatgtctattcatgtcttttgtctgcccacttttcaatgggattatgtggatttttattgttgggttgagttccttgtattttctgtatattggatgaatagtttgcaaatattttccctcattctacaggctgtctcttcaatttgttgattgtttccttggcagtgcagaagctttttagtttagtcctatttgtctatttttggtttcgttgcctgtgcttttgaagtcttagctataaaatctttgcctggaccaatgtcctgaagcatttccctatgttttcttctagtagtttcatagcttcaggtcttactttaagtctttaatctacaagttcgtttttgtatgtggtgagcaataggagtctaatttcattcttctgcctatggttatacagttttcccaatatatcatttgttgaagacactgtcctttatccaatgtatattcttggcacctttgtcaaaaatcagttggctgtaaatatgtaggtttgcttctgggttctctattctcttccattggtctatatgcctgtttttataccagtaccatgctgttttggttaccatagctttgtagtacgttttgaagtcaggtagtgtgatgcttccacctttgttctttttattcagtattgctttggctattcagggttttttgtgggcccacataaattttaggattgtttttctatttacataaagaatgtcattggcattttgacagatattgcattgactctgtagattgctttgggtagtgtggtcattttaacaatattaattaatccattaacatgggatgtctttccatttgtttgtgttctcttcaatgttttttgtcagtgttttgtagctttcctcagggaattctttctcctccttggttaaatttattactaggtatttaatgtgtttttggtagctattgtaaatgagattgctttcttgatttctttttcagctagttcattattggtgtatagaaactttatttgtttttgtatgttgattttgtatactgcaactttactgaatttgtttatcagttctaacagtttttatgatggagtctaggtttttccctatataagatcatgtcctttgcacagaaggacaatttgacttcctttatttccaatttgagtaccttttgtttatttctcttgtctgattgctctggctaggactttcagcactatgttgaataagagtggtgtaagtgggcatccatgtcttgttccagttcctagatgaaaggctgtctgtcatcttttccccatttagtatgatgttagctgtgggtttttcataaacactctttattaagttcaggtatgttccttctgtgcctaatttgttgaaagtttttatcaccaagggataactgtaagtccaatcaaacctctttcttttgtaaattgctcagtctcgggtatgtctttatcggcagcatgaaaatggactaatacacggcccttatgggaatttgcagccccaattcatttcacctgggctgttcacaaaatttcaatttatgaattcaggacatagcactatcaataaagtgctcttctgagaagacctgctcctgactctaaatacctactcaagtctcaagactgatgtacaaatttacaggaaatacaggggataaagaacatagtaagtgatgtctttctgtaaacaaccaaattcagaaagatattctacaggaaaagtgatccaaattcttcaacaaattaatggcacaaaaaattgggataggagaaagggaactgtctaaaattacaaaagactcgtaatatattaaacgcatataaaccaaaggtagtataggccttggttgaattctaattagtataaaattagatgacactaattatcatctaataaattaggtttattagatgatatctaatagatgatatctaggctgggtattcttagatgatatcaaggaattattgtttaatttgttaggtgtgataatggcattgtggattttaaaacaagttattggccgggcgtggtagctcatgcctgtaatcctaacactttgggagaccgaagcgggcagatcatgaggtcaagagattgagaccatcctggccgacatggtgaaaccccgtctctgccaaaaatacaaaaattagctgggcgtggtggtgcgcgtctgtagtcccagctactcaggaggctgaggcaggagaatcgcttgaactcaggaggtggagtctgcagtgagctgagatcatgccactgcactccagcctggtgacagagcgagactccatctcaaaaaaaaaaaaaacccaaaaaacaaaaaacgaaaaaacaagttatctgttggagatacatactgaataattatctttcttgtcttgtagctatcaactgtcaaaccattaagacaataagaatcaggctgatcaggattaagaatgactgagagaagattgcagagacttagactttaagctgggtgcagtagctggttgagattttgggactgccttacttagaggtctgatgaatgcctttagtgtgcaatgcctgcatgggaagaagggcatgcatggatattaatcagtttaaggataagctgtcaccaaccatgtttcttggtgaactaaacacatttttaacccaacacacatttctttttttcttttttttgagatggagtttcactcttatcacccaggctggagtgcaatggcgccatctcagctcactggaacctctgcctcctgggttcaagcaattctcctgcctcagccaccccagtagcgggaattacaggcatgagccaccacacctggctaatttttgtatttttagtggagatggtgtttcaccatgttggccaggctggtcatgtactcctgacctcaggtgacccacctgccttggcctcccaaagtgctgggattacagacatgagccaccgtgccctgccccaacacacatttctaaccctctccttgacaattgccatcatagagcctggaaaactaagtactggattggctttcccagttttctctataccaaggtgtggccatgtgagacataaatgaaaatttttttgcagaggcctctaggaaaactctttgataaaagaaacaaatgatgttggtggccctcctttttcctttcttgaatttgggtatgatttctggagttgtaacagctcttgcaaccatgaggaaaatgctctaaaccaatgtgagcaactacctacccccactcttctttaaagcaataaaaaataaaatttatgtttaattaagccactgttagttgaattattctgttattttcagaagaaagcattcttaacctatacatcacagcaaaatgctggcaaatcctatctcataaactttcatgaggattgaataaataaaatgcctaacacttgcctaggcaatttacatgttcctctgtccaccctacttcctagatcaatttagctacacattgggaggaagttatagtttgattatacctttttattaaagcagaggtgagtaccatatacagtattttaatttgcaaatctgtcagctttatgtaaggtcaggataacattttctagtttgttccatactcttattcgtcacgctcaatatttttgttgacttctttggccagaagagtttactgctccagcatcttcctggaagagtccacaattgggctaaatctattttaaccatttccctctagatttttaaattgtacttgcctacacagacattcccctgccacttttctgtaagcctgcagagcctggcattttcttctatttttctttgttagttcagttgctgcctaaaagcaagactaggctctcatagaggtagaatggggctgggcgtggtggctcacgcctgtaatcccagcactttgggaggctgaggcgggcaaatcacgaggtcaggagatcaagaccagcctggccaacatggtgaaaccctgtctctactaaaaatacacacacacacacacacacaaaagccaggcgtggtggctagtgcctgtaatcccagctactcaggaggctgaggcaggagaattgcttgaacctaggaggcagagattgcagtgagtcgagatcccgccactgcactccagccttggagacggagcaagaccccatctgggaggtgtcgggtggaagaggtaaaatggacagcagcaaaccacacgtgtgataggagagaatactgagctgagatcagtttcctaaaatatgaatccgatttcaggatcactcatttatctgactgtcaagaacgcctctgaacaggaggaagactttggggagagggtggggtttgttgaaagggtaccgagaagggaggtgggtggtacccaaacaatttgtttacataatgttttatggacctgaaatatgtagaacagtactttgaaactaaagtactgtactgaagtttaattatttttcttattgtttgcatattctccctcccagatactttacagagggcgctaaagctgatcccctgggagcttcagagtttaatgacttcgcctgaagatttcctattcttttccacaacgtgctaagtcaaattatggccaaattaccaatcgcatggtaattcagcttctaaatatattttgcagagtgtttccaaaagttaaaaaacaacaacaaaacttcacctaaattgtttttacttgcttcaccttaaatcagttattcggttcctttgaagaacatgtagctttagcaacccccaaagtgaacccagatacccaggactactgattgttacatcagagtttttgaaaacgccaatactggaaacaggccgacagttaaggagaggcaggcctcaaactaaagcagaaccttctcaaaactacttatatttcaagagatggattaagcgaaaagagctgtacaaagaaataagccattttctatgcgcctgttatatgcaaggcactgcactcccttgtcacttgttaatttacaagaagactcgccggtccagggaagggagaggggaataggtgcaaggtttgtggagggcggcaaactgcactccatgtggcgcgaggctgcgcttgcggagatccgggttctggtgcctggcgccggcagccagtaggggcgcgcgtcctgcgcagttgccgcgcgcggcctcctcgggcttcaggccgggccaatcaggaggcgggcgggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggaggtgaggctgtggctccgggcctgcccccccgccgctccgaggggccaggatccctgggctgggggcgcgagcaggggcccggcgggcgtccgcgggggttcccggaatctgtgcctgggctgttgggggaggcctagatgaattccagtttagtctttgcctaattaaatattgtagggccacgcggttctatgcagtgatgagtcttccaataacatttaagaggcccctctgctcccttccaagaaggatgactaactctagattgatacagaggtccagctgttttttaaatggccattgaaaacaggcacatcgagtactcggggctatagaagttagcatacatcaaattaacccagtaattgagtcaaccgtgaacttctgaacgcgctccccaccccgaggtgctggttttaggagaaaggcaccgactggtgtttggtattctggagaaaccccttccgaaactggaaacggagtcgctcctttggcctgaggacgcggttcattgtcctggatcctgaccgaggctggtgcacctgcagcgacgcgctctttttccgcttcctggggtttttgatcgtccggaatctgggcggatgggaagtcctggagaggaccgcctgaggacgcggagttggggcgggaggatgtgtgtgtacaagcggaggggagacgctccaggctccgccagggaggccggagcgagcgacaggggctcctctgcggcatcgtgggtggcccagatgacccagaggtgtgcgcgcagacggccccccagctgactgttctcccctgctctgactgccctgtttgtgtagttttgggtaacccttagaactgcctggatattctgagccagaagaataagggctaggagcttgatggggtcagttcccacgcccggttcagggtcagaacaaccaccatcccgtcctctcccagagcagagccggctcctttagcctccagttctccagagcttttgcctgggagcaagttgctggagctggtgttgactgataacttggatatttagatatgtgaattgtgggcctccagttgactcttgcctagctccgaacatgttagggcagacctatgtatgtagttatttattttattgagaaattatttagttatttattttattgagacggggtctgactctttcccaggctggagtgcagtggcgcgatctcggctcaccgcaatctccgcttcctgggttcaagtgattctcctgcctcagcctcccgagtagctgggactacaggcggccagctaatttttgtattttctgtagagacgggatttcaccacgttgcccaggctggtcttgaactcctggactcaagctatccacctgcctcggcctcctaaagtgttgggattacaggcctgggccaccgcgcccggctgggaaattatttttgcaatcgtaaataacttgcaacacttccctctgaaagagattatcaggtcctttactgacgtcagaattttagaaaagtggggaaaacaggacttgagtacctagatatgaaaaggtgggctgggaaggtggggtgggaagatgagtcaaaatatgagtttagaaggaaacaaactttccttccgaagagttttcctggatttgctcttgcctaggtacttcggtgggagtcggttgggaggggaagcatgcagccttgttactcacactgtgggaggccctgaccagtgtcctggcatcacctgttagcttgttagaaaagcagaatctcaggcccactgcagacctattattattattattatttagagtctcgctctgtcacccaggctggagtgcagtggcactataatggctgactgcaaccttgacctcctgagctgaagcgactctctcttctcagcctcctaactagctaggactacaggcatgcatctccgcacccagctaattttaaaattttttgtagagatgggatctcactaggatgcccaggctcatcttgagatcctggcctcaagcaatcctcccacctcagcctcccaaagtgctggtattacaggtgtgagccaccacatctggctttatcatgtgtgtgtgtgtgtgtgtgtgtgtgtatgtatatatatatttattattattattattattattattatttttttttttagatagagtcttgctctgctgcccaggctggagtgcagtggcgctatctcagctcactgtaacctctgcctccgtggaagtgattctcagtgcctcagtttccagagtagttgggattataggtgcccaccaaaatactaatttttgtattattggtagagacagggttttgctatattggccaggctgggctcgaactcctgacctcaagtgatcctcctgcttccgcctcccaaagtcctgggattacaggcatgagccactgtgctgtgagtcttaatctgcatttgagcaagatcccctggggattctgtaagtacaataaaatttgagttgcactggtctagaacttaaataccaatgacatcttacttttaaaagatcttttaaagatccgtatttatcttaagatcttaatacctgttggtattcttgatagctacaagaaaatgaaatggcccaaaatttatctcagaattaaatgccctttgtttctttactattatgtatctagattgtttatgtaaagaaggcggttttgattatttcatagcttataaattggtttttctttttttctaatggcaagtacatagagcaatggtttttattttctaccgcagctaaaggcttcaaagtatggaaaaaagcatgtattgcacaaaaaagtatgtagcattccacaaacatcactttttgtgacttttcaaggggagtattttcagggagaaatgtcttcagttttggaaaaacttcttttagtcgtgctttcttttcctccagggaggccaactcttaatttcttttcatagaaatagtgggggctttatgttttcccataatattttgggttcttacttctgaaattaacccatgataaacttgattacctaacacacagatgtggttggagcttgtgctgagccaagtgtgtatttaggttccgcattagtttaaacccctggccagggtttggagacaggtatggaaattagtcatgttggcttctgctttgatgttttttgtactcttttgggatacattttcaaaggaggtaaatgttagaattttgagcagttaaggctctacctttaatgagaggaatgaacatctttgcttcaatatcaaaggaaaagctgagacgaatatgtggtaatcctctgttgataaacctggatcagtaaagttgcattatgaattcattgtctttcctatttataaccctcttatataggaagtggaggggagaaaagatttcttttctcacccatcactaggttcatggctgagacacctatgtttctggatcaaaccgatagttgggctgcctattctcgtggcccagtaatgtgattcagatgaactgggaaagaagggagattatttctgtaactggttatagggagaaggcctggaagatatcgccagaccaattcaaaattacatatgtttataagtatatatatgtttatgtgtaagtgtgcatttatctaaagacataaatgattaacttctaatctataactaagatctgagtcctgaagaccttcctctggagcctcagtaaatttagttaatctaaatgggtccaggtgctggggtgattactctggtcttgtctcctgctgaatcatggaggtttggggagttccttcagacccccagtaaacttgtttgtggaggtctggggagtttcttcagacccccagtaaaacttgtttagtcccaaacgggtcctttaagaattccttcgttatgttgtcatgcttcgaggcccaggaaaggcctgggcaaacgctcggtgggcttttgttacattccagcctttgtataaggaccctggttctattagcttttaatatttaacttaaccactcagtcagtgctgaaacagttgttacagagacccggcctgccacatctgtaagaaaagacagatttacaaaataaaagcttacaaatttatttaatatttgcagtggcctggtcatagctcacccagaaaataaatactcaaagcttaagagaaatatatatttttgttgtagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtaagatactttattgcaaagttttttgataattagaaaataaaaagctaagcatatcttacttctacaaatcgtaatgattgagaaacatttaacaattgtcctttatatagtagagtagaaattatcagctggggatggtggctcacatctgtgttatcccagaactttgggaggccgaggccggaggactgcttgagcccaggagtttagtctgcagtgagctatgattgtgcaactgcattcaagcctgggtgacagagagtgaaaccttgtctcttaaaaaacaaaaattggccgagctcagtggctgacgcctgtaattccagcactttgggaggccgaggtgggtggatcacgaggtcaggagtttgagaccagtctggccaacatagtgaaaccctgtctctactaaaaatacaaaaaattagccgggcgtggtggcacacgcctgtaatcctagctacttgggaggctgaggcaggagaatcgcttgaacctgggaggtgaggttgcagtgagctgagatcacgccactgcacaccagcctgagtggcagtgtgagactctgtctcaaaacaaagcaaaacaaaacaaaacaaaacaaaacaaaacaaaacaaaacaaaacaaaaccccacaaaaattatctaaaggtttttaaagctataattaaaaattttccatcatatcttattagtgctcatcatggagtctgtcaccttaagcagttctcttgccattggtaaaaatgtttggtggccctgtggctttgccaggggtctttcagtttgactggggagcagtctacctacatctcacatcattggagaaagtagagaatgggtcatcagattgaggaactactttaagcgttgcttgaattgacccacactgatcatgctgtccatctataagtataaacatttctcctcaaatttactaattgccttttataccttaaggatctgctgtgtcgatacctttctttaaacaaacaagcacactgctttgcattacaaatggtcatgttccaagaaaagtgcctaaaggaaaggaaataagtgaggcttcagtttttggcttgagttgtctgtatctgaagtttgcgttttgctgtgtgtatgctctactttaaattttgctaccgtctcacagttgtaaataaagttcagaatacctaagctgcttcacagaaaagtctctgaacctgttccatgttttcaggcagcaactttaactttcggttccaagaggaaccaccctattctgatagcaatttctggggctctttcacagagactctttgtatagttgctatttacagagttgcagtttgccaaagtttgttaggcagttgctaggatgagtaatgttgtatatagattgattataaatttatttagcaactccaactaaaaacactgaggaggaatggaggataagggatgtgttgatatctttcagaattaaagaggggtttggtaagtttgtgatagttttataatttattcttacacaaatttagtgccactttctaatctctgtataacttatacagcatggacttgaacgtcagaattgatccaactcaacttttttttttttttgagacagggtcttactctgtcactcaggttggagtgcagtggcacgatcttggctcattgcagcctcgacctcctgggctcaagcgatccttcgacctcagcctcccaagtagctgggaccacaggcgtctgccaccacatccagctaatttttgtatttttttgtagagaagtggtttggctttgttacccagactggtctggaactcctgggcttaagttatctgtctacctcgggctttccaaagtactcagattacacgtgtgcgccaccatgctcagctgacccaactcaactttgatggagaagttattatatttagtactgatccactcagtgagatttcttccaaactttttcaccccactattaaagtggtatatgattatcaaggaaaatgggggatatatagaaacatagaatatattctatatacaatatatagaagcagctcactacccaaagccagctgctagttttttttttttacaatatctgtatgactttttcttttttttttgagacggagtttcactcttgttgcccaggctggagtgcagtggcgcgacctcagctcactacaacctctgcctcgtgggttcaagcgattctcctgcctcagcctcctgagtagctgggattacaggcatgcaccaccatgccctgctaattttgtatttttagcagagacgggatttctccatgttggtcaggctgggctcgaactcccagcctcaggtgatccacctgccttggcctcccacagtgctgggattacaggcatgagccactgtgccatttaactgttgtgaagtatgtgtgtgcataaaatactgagccactttttaatgacagaatcatagaaatatgtttccacattgttatgtgctgatcaaaaacaagatttttaatacctgccagctagtccagctagtccagtggtgtttatctgtgttctccggagctgtgagggagccttgggggtgtgccaggtggaagggcaggttagaaggggaaactctattctgttcttcctttcgctttaaccaattctgcatttgttttatgtattctggttctataaaagattttatttgacaaaagggtttcactgctaaaatgtttgaaaactgttgtctagtaatttacttactggttctcttatgtcgtgtgggtgtgtgtataatgtagctgatgtaagtactattgctaatattattggtatgcataaagctttttctatatatggaattattttcttagggtatattttccaaaaatgaaatttctggttcaaagaatggaccttttcaagtttcttgaaacattattaaatagaatttgttcttttgtaacactcttttttttttttttttttttgagacagagcctcgcctgttgcccaggctggagtacagtggtgccatctcagctcactgcaacctctgcctcctgggttcaagggattctcctgcctcagcctcccgagtagctgggactacaggcatacaccaccatgctgggctaatttttgtatttttagtagagatggggttttcatcatgttgcccaggttggtcttgaactcctgagctcaagtgatccacctgccttggcctcccaaagtgctgggattacaggcatgtgccacaggctcctggccctttcgtaacactcttgatagcattgtgtattacatatagtttttaaaaactttgactctttttgctaagttaaaatggtatctcattttaatttgcatttcttttttttttcttttgagacggagtctttctctgttgcccaggctggagtgcagtggcgtgatctcggctcactgcaagctccgcctcccgggttcacaccattctcctgcttcagcctcccaagtagctgggactacaggtgcccaccaccacgctcggctaattttttgtatttttagtagagacggagggtttcaccgtgttagccaggatggtctggatctcctgaccttgtgatctgcccgcctcagcctcccaaagtgctgggattacaggtgtgagccaccgcaaccggcctttaatttgcatttctttgattaatattgagaataataaatttagtattattttactgaatatcacctatgagaagaaagtgagtgatctatttaagaaaattacaatactataagaaggagctttggctttcaaaaatattgataatttattttgaagtcaaaagtcatattaaaataaattacatcaacacatgtttattgaatatatttctattttaagtagcaaacatgcaaataaatttaagtaatgcactgtgacaaaaataacattggtaaagaactttttcttttcttttttttttttttgagatggagtttcgctcttgttgcccagggtggagtgcaatggtacgatctgggctcaccgcaacctctgcctcctgggttcaagcagttctcctgcctcagcctcctgagtagctggggttacaggcatgtgccacaacggccagctaattttttatttttagtagagacggggtttctctatattggtcaggctggtctcgaactcccgacctcaggtgatccgcccgcctcagcctcccaaagtgctgggattacaggcatgagccactgcgcccggcctgaactttttcatactcttaggctgtgcttctctattaaggaatctgtagaggtaagtgttttaaggaaattatataattattctttgtattgctgtgaaacagcttcttaaataactaaaaatagaaatctaaaagagtaaagatttcctctgaccaaagcaacataggtgatacaagtactatatgtaggagagtttattttcaccttactatgaagaataataaagcaataataattaaaaaatcatatctgcctttaatataatagaaattgtaatttttgataatacctgtattgtgtttatatttctctctctttctccttttttaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgtgagttatattattataaacacataaactcagaatgtttatatgtcttccttgaatatttaacgtgcttttttactggttgtagagttaatattcagttgtattagttgtagagttaatattcagttatggcgttaatattaaacaactaagtagaattcattggatagatactctaagatttcatttttgtggaagaactcagagttaatggtatgcttgataatcataaaccctcatctcatatagttcagataatttaagtaatagtaatggattttaaagaattgccagatgtgatctgattcaaatttttgaatatgggagttgaatcaactaaattctattcatagattttaaaaaagcattttataagtcaaaaaacttttatggtttgctgatagattaacatagcatgatcattttaatgctttgtatgcagtaatacccttaccttaatacctgtacccaaattccaacctctaccccctttgcccttacactggatcatccattcaactaggtagagtgctagtccattagtttccttcaggagatagtcaatccagttgttgttatagtagtttgagttgaaatcttatggtgaagtgtgtaataaaacatttttaatgacagtggcaggaataaatctttcattggctgaatatggaagtagttggagaaaactgatttatttatatgccttggttcatatatatatatatatatatatatatatattttttttttttttaatagagttttgctcttgtcacccaggctcttgtcaccaggagtgcagtggtatgatcttggctcactgcagcctctgcctccagggttcaagtgatgctcctgcctcagcctcccaagtagctgagattataggtgcccgccaccacgcccggctaatttttgtatttttagtagagacggggttttgccatgttggtcaggctgttctcaaacccctgacctcaagtgatctgcccaccttggcctcccaaagtgctgggattccaggcgtgagccactgtgcctagctgttcccatatatgtttgtcagaggtgtgaatgggtaaagattttgttaatagtatattctggcctccattacaatgtggcttgatttttttatacaacgacttttctaagatgcaattcacatgtcatacaattaacctatttaaaatgtgcagtttaatgatttttaatatataatcagcatgaatgttgtgtaaccaccagcacaatacatttcagaacatttttctcaccccaaaaagaaactccatattcactaggagtccttccttacttttctctctccccagccctaggcaacccataatctactttctgtttctggatttgcctattctggacattttatataaatagaatcatagaatatgtggtcttttgtgactggcttctttcatttagcatgatgttttcatgattcatccatgtagcctatatcaatacttctttcctttttattgctgagcaagattacactacaccctttctgtgtctacaggttggccttctaatttggcttttatggggagttgatctgtaggaagatttctacattatctcttcacctggtcctggccactgggctctccccgccatgcctgcttataattcagtttttgaggagagggtctgcattacctggctcttcaatttcttttagtccttgttgtgttttgcagttttttttttttctgtgttgtatctggttactacttcggcatgttttagaagtaagaacagtggctaggaaggagttcggtggctggaggtaagagttacaggggccagaggatctaggttcagctggcttttgccaggctaagtgtctttagggtagacaacatagtacctttaagaatttaactccctttacatcttgattcaggttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtaagtgatactatatgaaatgtgagcccattgtattgtttttatgtgtgctaacaatagtgaagccttatatttgttaagcaatttatagtatttttctttcagaaaacattctctcgtttgatttttattttttaaaagaggtttttaaaatttttattttattttttattttttcagacctatttagtatccataaaagaggttttattgctactatacaatgtattgtcattatagaatttagaaagcaagtggcagagatcatttccatcccaatacttgtactcaaatttgaatctgcatctccactgtttgtaatagctgaataatatttattttatttgatatgatatagtttacctgttactctactgtatgtaacttaagctattatatccatttcattttggaaacaataggtttatgttcatgtgtgtatatgaacatacgtgtatatacatgtaatcacttctgtagtaaaatatgtatatatgtatgtgcacacacatatatcttcttgcatacatatatgttgtaaataatgtagggaaagtttaataggatctattctaaactattaaaggtagatggatccttctgagagctgagcgggactggggagcagaatgtgttccctgtctacttgaaacacaggtgtgtaagttttttttttcttttttacaacaagcatgtattttttcatttaaaaattacataaatacaagtgtatattttcttttcttttctttttttttttttgagacggagttttgctcttcttgcccaggctggagtgcaatggcgcgatctcggctcaccgcaacctccgcctcccgggttcaagcaattctcctgcctcagcctcccgactagctgggattacaggcatgcaccaccacgcccggctaattttgtatttttagtagagatgggggtttctccatgttggtcaggctggtctcgaactcctgacctcaggtgatctgcctgcctcagcctcccaaagtgctgggattacaggcttcagccaccacgccaggcccatacgagtatatattttcttgtaaaagattcaaacaatagaaattaagtggaaaaagaaagaaattaagtgcaaaacacccttgaatacttctctttgtctaattctttccccgagggtaatttgctatcatcaattaatttttctctttaacatacaattttactatttactttttaatttttaaaaattatttgtatttattgtttaagagatagggtcttgctatggtggtaggctaggtttgaactcctgggttcaagcgatcctccagtctcagtcttcctagtagctgggattacaggcatgcatcaccatacctggctttacttttttttcaacttagaaaaatgtgaaggcctattgtgtcaggacacacaagtctacttcattctttttaactgctgtatggtattccacactgtagataaagcagtttatctaaccatttccttgttcatggcatttagatttccatctttgaatttgtctgcctgtatccttgcatgaatttgactctaaggtagatacagagaagtaaaactattggagcgtgttaacctgtaaaattctaatacattctgccagaatgtcctccaaaaatgctctgcttgtttttacatcctctactgatgctttagcttgcctgtttcctcacatttaggctaatcattgatattattaaacttgattttttttgccagtctgacatgtaaaattgttattgttgtttcaatttgatttccctggttattagtgagatagggatcttttcatatttattggccatttcactttctgtgaattgcctattcatatcccttgctcattttttttttgtttttatcttttgtcattgacttataggaagtctttttatatattctgtatatttttttgttatttattttgcaaacattttctcccaagctatcatttgtctcttaattttttttttctttacagtttagaaattttggagacagtcctttcctatttcagttttataaatatattctcctgcgttttattttaatacttttttatgtttagctttttcatatatctgtaatttattttttgtgaaagtgtgaggtagatgtttctaacttcagtttttgtctaaattgatggccagttattcaagcaccattcttgcccaaatcatttgaaactctaccatattctttatttttattttactttaagttctgggatacatgtgcagaacatgcaggtttgttacataggtatacatgtgccatggtgatctgttgcacctatcaacccatcatctaggttttaagccctgcatgcattagctatttgtcctaatgccctccctccactcgcctcccaccctctgacaggcccctgtgtgtgatgttgccctccttgtgtccatgtgttctcactgttcaactcccacttgtgagtgagaacatgcagtgtttagttttctgttcctgcattagtttgctgagaatgatggcttccagcctcatccatgtccctgcaaaatacatgaactcattcttttttatggctgcatagtattctgtggaaactaccatattctgtcatattctccattttgtaccactggcccatttgtctatcctgtgccaatattatatatttatgtaatatatattttttatgatagcttcctggtgtgtcatgatatttgatatggtaaattcctcctgtttgtgattgttttcaagattgtcttgatatttttgtgcattttctcttctaggtaattttataactagcttgttaaatttcataagtaaattcttctgcagttttatgggtgcataattgtgttaggctcaagcaacagctaaagaaaacccaactaccagtgtcaaaacataatgatgatgatgatcatgtttgatgacggcagctttgtactaccagcagttgtttgaaccacatcacttaatcctcacaacaactctgtgagttagattattattcctattttacagatgaggatacgcagcacagagaagtaaaataagttgctcagtgttattcaactaggaagtagcagggttgggttcaacctgaagatttctgtgggctctctagtctgccacattgttggctatttgtgtacagccactatgttgttttcattactgcagctttatcataaataaattagttaatatttatgacttcattttattgcttcagaattttcctgacctgttcttatgttttaattctttcagaactttggcatcattttgttaaggtattataaactctgttattttaattgagatcacattgaatatgtagatgaatgtagaaataattttttttttaaagatggggttttgctttgttttccaggctggactgcggtagtatgattatagctcaccgcagccttgaactcctgggcttaagcagtcctcccacccaacctcccgagtagctgtgcctgtgggcgcatgccagtatgcctggctaatattttacattttatattttttttagagacagagtcttactatgttgctcaggttggtgtcaaactccgaaggtcaagtaatcctcccacctcagactcctgagtagctgggactacaggtgtgagccaccatgtagaattgatatttttcagtattgtcttttcatttatttgtcatctgtgcaactaagtggaattctgaagttgttttcccagaagtcttgcacaatcttattaagtttatttctaggtatttaactttttttgagatggaatcttgctctgtctcccaggctggagtgccttggctcactgcaatctctgcctcctgggttcaagtgattctcctgcctcagcctcctgagtagctgggattacaggcgcatgccaccatgcctggctaatttttgtatttttagtagaggcatggtttcaccatgttggccaggctggtcttgaactcctgacctcaggtgatctgcccgcctcggcctcccaaagagctgggattacaggtgtaagccactattcctggccaattttttttcattggtatcatacatgagatattttttcttctattatatcttcttactgattattatttgtttataaaaaagcaaaagtgtttcattgcttttgttaccattcttattacttagagtttttactcaatttttagtttattttataaaaataatgttttttcctcttcctttccaatatttgtgactcttcttattcttgactagtcaaaatggctagtacttccagaacaatgctaaataatggtggtagctggcatctttgccctttagtgacgtctagtattttaacactaagtatcttcaaggtatagtcatgtgccactaaatgatggggatacattctggaaaatgcattgttagttgatgttcgttatgtgaacatcatagagtgtacttacataaacctagatggtagagcatactacacacctagctacatggtatagccttttgttcctaggcaacaaacttgttcatcatgctactgtactgaatgctgtagacaattgtaacacaatagtgagcatttgtatatctaaatttttctaaatatagaaaaggtacagtaaaaatatggcataaaaaataaaatgggccgtgtgcagtggcttatgcctgtaatcccagcatttgggaggctgaggcaggcagatcgcttgagcccaggagtttgagaccagcctaggcaacatggcgaaaccctgtctctacaaaaatacaaaaaattagctgggcctggtattgtgtgtgtgcctgtaatcccagctacttggtgagggctgaggtgagaggatcacctgagctttggatgcagaggttgcaatgagctgtgatggcaccattgccctccagcctgggtgacagagtaacaccctgcctcaaagtaaataaataaaatgttacacttttatagggcagctctgttacaatcttatgtggccaccattgtatatgcagtccattgttgaccaaaatgccttatgtaacacatgatttcatagggaaagaaagcctcttccttttggtcaatgaaagaaggtggagtgaagaaaggtgagagtaaggagaggaaatataagatgtttttgttctgatttcaggtatagaggaacctagggacagagggactccagatttttagccatgtggatacctagaccgaggaaacctcttgctggaatttggttcctttttgatgtggaaggagcccataattcccagctctctgggggtgtgggaaggcagctgacctgtgagtcagtgggccagtcatgcatctatcatagcagggggcagagctggaggtgggttccctaagctcggggactcaatagaggaagtgacaggtattgagggagtctgtacttatagtcggagcaagcatgaggctaccaggccctatcaagctgagagaccaacttattaaatacaagttgagcatttgagatcagtagcacatgcagccgccagagggcagcacaaggacgtgcgtgggccagagccccttctcccatgttcccacatgccccatggaagccactggggccaggagcggggagagactgagcaatcgtcccacactgtttatgttataagatggggctaacttctaacccaattaggaccacctgtggtgtagagatagcagtgtaggggaaaggtggtggtttgtgaagaagatagagcagctacacattttctctgcagcttccttccttttggtccaaaagtcaatatatttagcaattagtctttgtagtttatggtttggagttgtggatgtttcctcatttcattgaagagggtgctttcttctttatttttcatactttgtttttagatggtttcctagtaaggaatagagtaaaaatacacttattctacccttttcagccagaggttccttattgtgaatgtcttgcttttgatagtgttttataactattatatattagggttttgaacttctatgctaacataggtacataatattctttttttctgtgaaaaagttctcagaaatgtgcagaagaatacttttacccatttgcttttactttatatgtcagacaaaaatctaaataaaaagagtctcacagtgttgcccaggccggatccagtgaagtgatgtgatcatagctcactgcagcctcaaattcctgggctcaaatgatcttcctgctttacccttccaagtaggtagggctacaggcacacaccaccatgtccaactaatttatgtatttttttttttttggtagagatggggtctccctatgttaccaagactggtcttgaactcctggcctcaagtaatcctcttgctttggctttccaaagtgttggcattacaggcatgagccattacacccagtctaaaattttttttttatagaaagaatttctaataattctgctgaggttccaatttattttacattagaagtaataacttgtttgtatccctgtaaatatttaatttttattctccatgtattgttttctcaggtgtaccttcagttgaatttttagaatctcccattacggcagtagacagcccattcctaaaagcatttcaagcatcatctagttcttctccagaaacgttaacagatggtaatgaaatgaagtttagaactgtttttggatgtagtaaattggaatatggagctttgatttgttttctaggcatctctctttttttcattattacgataatttaacttcaagttaagctatcattttactttcttttatgtaagccacacactgagaaaaagcaagcaacttcattttgtattgggaaaaatagctaactccgagaatgtcgaggattctgatactactataatttgaagttttaaaccttgttctggtacatgctgttgctctggtgtttgaataagagggccttctggcggcctaattgcctttgggttttcccaaagaggcgtaatccagtgataaccataggttagcagggttttatcatttataaattaagagcaagtagaattcatttttaagcaccagtattctgtattttccttactgaaaacaggaagaatgaatttgtatgacttattaggtatttaaaatttagtattttagaatattttaaaatgagaattttctttatctgtattttcatacacctagacgttccccacaaggaattttaaggctgcttgccttaaaacatacaacttagtacataatgataaaatatatatacaagtaagaagccaagaaaaggacacagctgtggcagctttcaaggttgatgtaattgctttgtttaaacttcagttttgactgagtttagtggcagccaagacacagaggaaagtgcagtcaattaaatgctttctttattagacaggaggaagcccgagttcctcagtgctaatgaatgttacaccaatgctggaattttttttttttttttttttgagacaagttctctctctgttgtccaagctggtgtgcagtggtgtgatcatggctcactgttaccttgaactccagggctcaagtgatcttcctgcctcagccttccacatagctaggagtacaggtgtgcccccacacctgggtaattaaaaaaactttttttttgcagcagcagggtcttgctatgttgactaggctggtctcaaactcctggcctcaagctagcctcctgcctcagcttcccaaagcactaggattatagctatgtgtcactgctcctggcctggcatgctggattttaagtcagtatagtgaccctcagtgattagtgaccaaggtaaaagctttttttcagcaaatacagcagacagttgcttgtttctgatagtcaccttttcctttttttttttttttttttttttttgagacagagtcttgatctgttacccaggctggagtatagtggtgtgatcttggcttactgcaacctccacctacctggctcaagtgatctcccacctcagccacctgagtagctgggactatagggatgcaccaccatgtccagctaaattttgaattttttgtagagacagggttttgccatgttgcccaggctggtctcgaactcttgagttcaagcaatccacctgcctccacctcccaaagtgctgggactacaggcgtgaatcagtgcacctggcctgatagtcacctttgaagagttgtgatataccattttactagataaatggtaatatgccattataatgcaactcaatgtagatgagtctggaagaggctgggctcaaatggtcccacatgatccagggatagacccagagtttccagaggaatgggtggataacacttattcaaataagaatcccttcttactcttctcaataaaacttttgtcaaagataatcgacagactgtagctatactctgtggtgattgtctggagttacatgttgctgattgagggtgaattcatatgctttagaaactagaagcgcaagtgttcaggttgctagtctgctttggaaatgaagggacccagtgaagaccttcactcgcaatgaaggtgtacttttctatgcaattaggctcttggctacctgccaagaaaaccagatgttttcctactgaagcaatttcaaaagttcctttcagcatataaattagtgcttgatccatttgacaaagtgattaccgtaaaaaatggataaaatagttcagttttgaaagattttgaagcaggtactatcattacttatggttgcctataccaagcctcaataattacttttgtgcattatctcaaagtgtaacatggatttctagttataaaatgtaaaaagtagttggacaaaactaagtgtactcttatacggaatagctatatggtgctatttaatatgaactgtggaatatttggagaatgtttgctagtgaaaaacacttttgtcctgtgatgccattctctctaaaagagaatgaggtagtaggaccaattattcatttaggccatttttggtttgaaaaataaaacattatcaccgagcaggagaaaacttttctttcttttatttcaggggaatatgtaatgatataaatacattacttagattttttttccttgttagtaggtacaagtagtcaagtttcttcattaaggagacctgaagaggatgatatggctttctttgaaagacgataccaggaaagggtaggtttttgaggaaattcagttgcactaagcatttacttgtagcaaaagcactagaatgattatacattgaatgtggaacatccttgaaaataatttataaagtctttacttacagttggtgttaggccttgaggcttattagaatacacagaaacagggctaaagaataacatgatatttaatacactggttgatttatgaaggccataaagattggataaatacgcagataaaattgtcagtaataaacatcaatatcagcagatttgtaaattatatgtatcttgaattctttttttatacatgtacctttattttttatttaaaaatatttgccaaataaagattgaatatattttgaattctctttttttttttttttttttgagacggagtcttggtctgtcgcccaggctggagtgcagtggcgcgatctcggctcactgcaagctccgcctcccgggttcacgccattctcctgcttcagcctcccgagtagctgggaccacaggcgcccaccaccatgcccagctaattttttgtatttttagtagagacggggtttcactgtgttagccaggatggtctggatctcctgacctcgtgatccacccgcctcggcctcgcaaagtgctgggattacaggcatgagccaccgcgcctggtgcctattttgaattcttaatatgtattatttattcttcttagaggcttttaggtgtatccagactcgttaaaattacccaatacacatctgggcacagtggctgcttttttgctttaactacaatggaggaggaaaagactttcagaaaggtaactgtgggaatatagaaaccagaattatagaaaactatccttaaagcagtccacgttccagagagaatccagctggattaggtgcattatgtaactctgtagggaatgtgcataggctggatgtaagtttagtcattttaagcacttgtaattttagtggcaattgaaattgttttctctaaagcaatattcatatattacttttattaaaatgcttctgtaaaattaaaataaaaccatctgaaaatgtgtaattatgtccctttaacagattttggctttagtatttagcagcttaataactgtggaatggctgtgacatgaatctgaatgagttttctgcaagttttttttctttagaatggtttacaagttattatatcaataaatatgttaaatttacagatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgcctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaaccattttctagtgatattactgattttttttttcaatctttctcaggctgaagatatctactgatttttacgttgtgttgtcaaccacccattgtctatgactgtactggacacatcttgtgtgccactgcaaatcctcttggccccgtttcttactccattactgctgtggaacactttccagcaggcttctgatagcggaagccatttgatggcaccttgtcttgggcgcatgtcatggctctcttgcttccttctgcagggatcttctgacactgtggcttgggatgcccactagaaccccactgtatgatacatatgcagcccaaagatgttggggagctagtgactttggggccactcttgattaatgggaggtggaagcccaatacataagtgctctcccgtctgttgggaagacaattctgaaatgcatttcataaacttcctcagaaagtcctatcgttgagctccagtcacccatagcagtggccaactcaataataatatatccttatctttcttttttccttttccactcctctacccctccctctagttccctcagatcacttcccaaataaactacttgtataacaacacttacaggtataagaacatttgtcttaggctttgcttttgggcaagggataaactcaggctaagatggttagtaccaggaatggcctttgacagcaaagactcaggatagtatcctgtgactggatcagttactgcagtggatttggatgaagtgcaggtggcaggtgaagtgctaggttatgcagtcgctgtgccactacagtgaaatgggactagtggaaattataaagattaagtattcacttgctactgtgaaatgctttaggagctttgaaaaagaaaatgacacaggctcatgatagccatttaactcaaggaatgctgtgaaagccagagtccctctgtagcactttcaggaaactcatctgcagatgcagggcagactgtgctgccaatgaggcccaaatctaatagtaaaggtggcagggctgcagaggagacagaatgcacagccttgctagtccccagcaaagtcagtgctgacacaaaaacagtggaaccctaaatcacaggatgggacatttgtgttggtgagcctgagaatcttgaatcctcaggtttccatgaactctgagctggcacaagccgtgtcctccaattttctagtggagaatagcctgcccttaccttgagattctgtaaaggctttatctgaggcagttgcatcacaaggtaacacttatcctcctcaagatccacccttgtttcctctcattgactccaaagtaataactaggatcaggtcttagcaaaccctaagttggggaatacagtccttcctctaggaggataggtttcactctgaatcaactgcagattctggttaaaatgtattgggaggaacccaggaaacatgtctgagagtagatcttgaggatattgagtcaaggggtggggtggaggtggaatataaggcttgataggagagagtgacatgggagcgctcactcatgatgcatgatttaattccctggcaagaatctctggagttgctcctaacacaatgcaaggatggcatatagaagatatgataggcatgctagcagttatctgacatagtattgaggaagcggtcagaaagctcagggatgtatttgttgtttgaaactggagaagttatcacccgacttttccctgggagggtccagatgatattcataactaaggcaaaaaaatatataatggtagtcaggtgcagtggatcacacctgtaatcccagcactttgggaggctgaagtgagaggattgcttgagcccaggagttcaagaccagcctgggcaacatagtgagagctcgtctatacagacacacacacacacacacacggtgggcatggtggtgcatgcctgtagtcctagcttcttgggaggctgaggtgggaggactgcttgagccaggaggttgaggctgcagtgatccttgatcatgccaatacactagcctgggtgacagagtgagatcctgtctcaaacaacaacaaagagaaatgtaatggtgaagagcatactggaaactttgaaaagcttggcaatggttgattgacctctacaggctagaactgatgatggaagatgctgtcatgacaatgggctctgtggtatcaatgtagatagatgatgggatgctgaaattttgaaggccaagttgcagaacttaactgtcaggggcccagtggacctaattaacttaatgggcacctaggcatgaatctgtgaacaaggtaaagttcatgatgttccaaggggcaagacagaaggacagctgattaggatgttatttgagttgtataattgacttgttatataatgatgttgattgacttgtattatttgactcctctcacccctcaaaaaagaaaattgagaattggcaaggagaaggctgacatcaatcttggtaatgaaaaaccatagttccccatccagtttccagatctaaagctcatgatgcaagggaaggcccagatcccctcgaggaaggatcatccaatatatttggtaaatatccccctaatcctttctccaaggggcagtcacgtaccatcatttaccaaggtaactgtgcaatggataaaaaggaatagtcagattttttttttcaaccaatgactgttggatacagtgcctgacctgacatggattccagaagacccaaaataccattgtggttcactggttagagtagggaagctcagtgacaaatggcgtcctggccaaagttaatctcacagaaggtaaaatgggtctggtcccactctttacttctactctccctatatatacataattgagatagacatactttgaggctgacagagcccttggacctacactgatggctcttgcttcttgtcccagggcttcttagatgctgtaggacagacttaatgacctagatgcttcccttgaccaatgggtcatgtcgacataaagtcagtaaggatatagaagacttgaacaacagtattaaccaacttcacctaattgacatttatagaacacactaaccaagaacagcagaaaacacattcttttttttttttagtgcaaatggaacatttactaagattgaccatattttaggccataaaacaaggctcaatattcttaagatgatttagatcttaaagtatatcccctgaccacagtggaattaaattataaatctataacaaagatacatggaaaaatctcaaatgtttgaaaattatataacacatgtaaatgatccatgggccaaagaaaaaaagtcaaaatgggaataaaagcacttgtaattgaaaggcaatgaaaacacaacatcatatttgtgggatgcagctaaagcagtatgtagaggaaaatttatagcaccaaaatgccttcatcagtaatgaagaaaaatctcaaatcagcccttaccttaagtaactagaaaaataagagaaaatgaaactataatagatagaaaagggaaaataagaccagagtataaattgaaatagaaaacaaaagcaagagagaaaatcaataaaaccaataaaatttataaacctctagcctgactaatacgagagagagggagagaaagagagagatagagagagaaggcacaaattatccatgttaggaatgagagtggtgacatcactatagactctacagacattaaaaggatactaagggaatactataaataactatgccaattactttgacaactcagatgaaatggacaaattccttaaaaaaacactgtgttgtaagtcccctttgtgggatatttaaagatcattccagtttggccatggaaattccagagaggcatataaaattaaagacgtcattatactcatttgttctagaaaagggaggcatgacatgccacatgggggctacatataaggtttgaacgccaagggagcatgctcgagcttagagagagtgaggacccatgggcaagtgcctttactgggggtcagagcagagtacacaagaaaacctgggaagggatttcattggtgctttttgaatgtcattaggtcacagtcgggacgtggcaggaaatagcctatcaccctggtacacctggtcacttgggcagggtggttatagcctatttgtggggatattgaggcaccaggaaaatataaagttaaaaaaattacaatatagacacaactatcaagctcattaaatactaaatgggtaacatgattagccctatatctattaaagaaattgaatttgtagttaaaaaccttaccacaaagaaaattctagatggctagaatgtgcactagaggaaatgatgcctagatggctagatggccgcacagtgaatttcaccaagccttaaaggaacaaagaatatcaattctataagactcttccagaaaactgaagttgggaattctttgcaacttattctatatggccagcatcactctgatatcaaaaccagacaaagccattatgagaagagaaaatttcagaccaatattcctcttgaacatagatgcaaaaattcttaacaattttagcaaacctaataagacaatatataaaaaggataatacatcatgaccaagtgaattttatccaagaaatgtaaggttggtataacatttgaaaattaattgatgtaattcatcatattaataaactaaaaaagaaccacatgatcatttcaatagatatgaaaagaagtatttgacaaaattcaacacacattcatgataaaaattttcagcaaactcaggatagaaagtaacttccttaatctattaaaggtatctactataaacccacagcaaacatcatacttaatggtgaaaggaaaatgctttcctcttaagaataggaacatggcaagggtgtctgctctcagcacttattttcagcattacactgaaggatctagccactgcaatacggcaagataaaaataaataaaagacttccagattgtaaaggagaaagtaaaaacagcctttatttgcataagacatgatcatctatgtagataatcctgttaaatttattttaaaaactatcactagaaataggctagactcagtgtctaataccggcactttgggagactgaggcaggaggcttgcttaagcccgggagctcaaggctgcaatgacctgtgatagcaccgcagctctctcatctgggtgacagagcgagaccctgtcttacacacacacacccacccacaaaaaaactatcacagaaataatacacaatatactaaagttatatttctatatactagcaacaaaacaaacaagttgaaattaagaaaataatacaatttacaacggcatgaaaaatgaaattcttagggataaatcagacaaaagtaaaacttttataatgaaaagcataaaacatcactcagcgagataaaataagacctaaataaatatactgtgctcatggatcagaagactcaatatagctaagatgtccattctcctcaaattggtgtatacattcaatgtgatcccaatcaaaatcacagcaggctctgtgtgtgtgtgtgtgtgtgtgtgtgtgtgtgtagatgctgacaaattgcttctacgatcgcatgaaataaaactaccgtaattaagacagtgtggtattagtctaaagaaagcaaatagatcagtgtaacagaacagagaatccagaaatagacttgcgtatgtatggttaattgatctctgacaatagtgcaaagacaattcaatagacaaatgacagtgttttaaacaaatgatgctggaaaaattagatatccatatgcaataaaataaaatttgattgtttcacatgttataaaaataaactcaaaaaggactatatatcaaaatgtaaagcttgaacatgtaaaatttctggaagaaaatatagaagaaaacttttgtgaaccaggctagtcggagattccttacatacaacacaaaagcatgaaccataagacaaaaccgataaattagactttattgaaattaaaaacttttgttctttgaagtaccctttttagaaaacaaaaagacagctgtagactgggagaaaatattttcaaacctgaaggagttttatccacagtatataaagaactgtcaaaactcaataataaattcagttagaaaacaggaaaaagcttggacacctcatttaggaagatctggatggaaaataaacataagaaaagtttctcaacatttttagttagtagagaaataaatgcaaattaaaatcacaaggagataccactttaaacatttatacatgaatgtttaaacttaaaaacacaaaccatatcaaatgatggtgaggatatagagcaactagaactctgaaacccgctggtgggaatataaaatagtacaactgtgtaaaactatgcggcaattttttaagcacatatacaattctatgacttggccattccactcctaggtactaacccatgagatatgaaaacatatgtccatacaaagacttgcacacaatagcagctttatttgaaacaattcaaaactggaagcagtccaaacacctattaaaaggtagataaacaaattgtgttatattcatgcagtggaatagtaacagcaataaaacccaacaaactcttgacacataggacgaaatttatcaatcaaaataattatgctattggaaagaagctagattaaatgttcatactgtatgattctattatcgtaaaattctagaaaatgcaaactaatatatggtgacagaaagcagaacgggagctgggaggagtcaggtattacaaccgggcatgaggaaactttgaggtgatggaaaagtttatcttaattgtggaggtgatttcaacagtgtatacatatgttcacccttaacaaattatgcacttttgatatctgcagtttattgtactttaaccttcaagctgttaaaaattaaccggagataattttcaattgttgtgtaaggtttgccacaaagtgtaatatctgcaaagaagcagacaactaattttttcttcttaagattgtggaaaaagttgtaatactacagagagctgtggaatctaaggattagttgaccaacgcttgtaaagctaccaatctgaaaaacacattttcagttaccaaagttattttctctcttccatcgtgtaaatagaatgtcggggttcttctaatttgggtgtttctaaaatttaaatccacgtgaacagattaggaaagaccacgaaatcctacgtcacctctaaagtcacagcttgaagccttgcgaaaggaactggccctagaccccaccccggcctataaatcaccagggcgcagcctcagtgcctgggggtcggcagcagccagcgtcaggcggctcccgcacgcttcttcctaggcggcaggccgtggctgccacgtgactcccgctaacaccggatgatggcgcagcgctgtgcacgcaggcgcagtgtggggcccttgcggtcgaagctcacgcggtaagccgctgcacgtgtgctacggcgggcggagggccgaaagtccagtatgtgggtccagggtcactcttctagagcttccgcaacggaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggagg

SEQ ID NO: 416 - DNA, 34730 bp, Homo sapiens
tgcttttataaaagagaccccagagaggtagctctttactactaccatgtgaggacaaagttataagatgccatacagaaattagaaagtgggccctcaccagatctagatcttccaatgccttgatcctggacttcccagcctctagaattgtgagaaataaatttcaatcatttataagctactcagtttatggcattttgttccagctgtccaaatggaataaaatagtagatactaacaaatactagctcttgttatccttaacccttgtattttctactgatgataatgataattaagaatgtaagaattaaataactatacaaaacaaaacacaaaagaaagagaaaattttatcttcttaggacaatgtgtgttcatctctacctaaaagaaggttggtagactgtctttttggagatattgcttgttagtaatgaatatactatagtccataatgtaaggtatgcccattatcagtggagattttaacatgcttaagaaaccattatataagtccaaaatattaatttagttttgagaaatataacttttataagaaatagaatatttgcattaatatagtgagagtattttctttcagcaacctggccaaaagtataatcagaagaatgctaagtggacatagaatcaaatgagggagaatgagataaatcaatttgtaatatcatcaagctaataactccaacctaagggaaaaacttctgcttatggatgaaagtatcaaagtccgttgattacacaaccctttgcatactttcaccatcactaaatgcgttgttatcatttggctaaggctctctcccacaaagtgaagaggaatgggtactgtcacccctgcctctgtgactcttttttcttatttcaatgtatgtctagacatagactttcctcgaatgtctgcttatgttccttcagtttgccaagtctcttaggcttcatacttgttattaatataacatttcatacctttgcactatcatatttattgatttcatatttaaatttcagaataaagtaattttccactgttttcagacttactaggataatctcatatatgataagaataacaatgatgatgatacagaaccaagtttaaatattactccagaattacttccaggggcttgcaatgtcagtggatgaaatatgtgtcaaaaattggagcaaaataatgtttttcctaattaataagtgcatattctttttactttgaaatttcctgtatagatcatttcaaaggtggtttcccaaactcagtgagcaatcacagtacctgcttttaacttcttattgctgaaagaggcattgaagtgggtcagagagacagtcttgaatggtagacaccaatcttcccctatcccctggcagaggccatgcagcagtatggagagtctgtgtgttggaggagggagagtacagcatctgagggacattacattgaactcagtgttgcatgtcatagttgagaacaaagctgtgataggctcagccagtgcctgtgcatggtgggagcatttgaaccagccctagccagagaggaatcatctatcccagtggttgaaacttgagttgctcagcaagcctcgtcactgctagccaaagtgctctggggtccttggtagacttgaaaggcagtctaggattcaagaactacaattactagggaactccttgtgctgggctaggctcagagtcattaacctggaaagttactagccaggtggctaagggggtgtttgtctcacctcccggcaaaccccaggctgcacagctcacagcaatgaaagtgatttcttttttctgcttaagaaaaggagagagaagagtaaagaagactttgtattgcaccttggatattagctcacccatagtaggacagggcaccaggtaaagatgtgagatacccaccccaggccctggctctcagatgacatttctagacataccctagccaatcgagaacccagtgacataaagggaaggatccagtcctggcagaatttgtcacctgctgactaaagagtctttgtgtccttaataatcaatactcaggtagtatgcaatgcgccttgggctctaagatgtcctgaattcagctgtgatccaacacattcccagctgtggtgactatgctgaaagactcctacagtttgatgaaagcaggggagaaagtaaaggggactttgccttgcactttaggtaccagcttggccacagtgggttagagcaataatcaaggtcttagggtctctgagtctaggcctaggctcttggatagcatttctggacctgtcatgggccacaggggagcccactgccctgaagggtgagtctcaggcctggtagcattaatcacaaactgacagatgagccctgaggctttaagtgaacatcagtggtggcctggtagaatgccccatgggcctgtggtgctggtggccacagggaaagtctcctctgcctgtgggaagggaagggaaaagcaggaaggactttgtattgtggtttaaatgccagcttagctacagtagaatagaacaacaggcaaattactaagattttttactccaattcctggctcccaaatagcatttctgggcctgtagagaacctgggggagctcaccaccttgaatggaagaacacaaacctgtctggctttgccacctgctgatcacagagccctagggccttgagtgaacagaggttgtagccagttagtgattacagagcatcttgggagagacccagtgctgtgctggcttcaggtctgaaatagcggtggtggtgacaggggtgcttgtgtctctccaccccagttccagatggctcagcacagaaagagagactcttttgtttgggacaaaataaggaaaaagaacaagcgcccatctgataatctagagaattcttccaaaattctatgtctgtaactgtccagagaattcaaaatagctgttttaatgaaactcaaagaaattcaagataacacagtgaaggaactcagaattctatcaggtaaattcaacaaagagattgaaataattagaatgaatcaagcagaaactctggaattgaacaatataattgatatactaaagaatgcgtcagagtcccttaatagtagaattgatcaagcagaataaagaattaatgagcttgaagacagtttatttggaagtatacagccacaggaaatgtaggaaggaaaaaaaacaataaagcatgactacaagatctagaaaagaggctcaaagggataaatctaaaagttattggcattaaagatgaagtagagaaagagatagggatagaaagtttatttcaaaggagtaatatcagaaaacttcccaagcctaaagaaaaatatcaaccttcaagtacaagaaagttatagaacaccaagcagatttaacccaaagaagactacctcaagacatttgataatcaaacttccgaaggtcaaagataaagacagatttctaaaagcagcaagagaaagaaacaaataatatactccaatatatctagcagcagacttttcagtggaaaccttacaggccagaagagagtggcgtgacataattaaaatgccaaaggaaaaaactttgaccctaaaaaagcacatccagtgaaaatgtccttcaagcaaaaaagatgaataaaaactttcccagacaaacaaaaaaaagatgagggcttttatcaatgccagacatgttctacaagaaatgctaaaccaagttcttcaatctgaaaaaaaggacttaaatgagcaagaaagaatcatttgaagatacaaaactcactggtaatagtaagagcacagaaaaacacagaatattataacgctgtaattgtgatgtgtaaacatctcttaattagaaagactaaaccaatcaaaaataataactacgactacttttcaagatgcagacagtacatgaagacatcaagagaaacaacaaaaagttaaaaattgagatgatgcaactaaagtatacagtttttattagttttctttttccatggttgtttgtttatgcaatcagtatttagctgttatcagtttaaaataatgagttataagatagtatttgcagacctcatggcatccatacaatggatactcaaaaagtaaaaagcaaaaaattgaatcatactacaagagaaaatcacctttgctaaaagcaagacagaagaaaaggaaaaaaggaagataagatcataaaacaagcagacaacaaataacaaaatggcaggagtaataaaagacatttaaattaaaaagaaagaagtcaaattatctttgtttgcagatcatattttcttcttatttggaaatcgtaaagactccaccagaaaactattagaacagataaacaaatttgataaagttacaggagataaaatcaatatacaaaaatctgtagcatttctacatgccaacactaaacaattcaaaaaagaaatttaaaaagtaatcccatttatagcagccttaaataaatgcctaggatttaacttcaccaaacaagggaaagacctctacaatgaaaactataatacactgatgaaagaaattgaagaggacgcaaaaataaaatgatattccatgctcatgaatggaaagatctaatattgttaaaatgtacaaactacccaaagcaacctacagactgaatgccatctctgtccaaatgccatctctgtccaataaaaagaatgcccaacaacattctttacagaaataggtgaaatgagtctaaaatttatattgaactgcaaaagacccagaatagccaaagctatcctgagcaaaaggaacaaaactagaggaatcacattacataattccaaattatactacagaactataataattaaaacagcatggtactggcataaaaacagatgcatagaccaatggaacaaaatagagaacacagaaacaaatttacacacctacagtgagctcgtttttgacaaaggtgtcaagaatataccctggggaaaagatagccttttcaataaatggtgctgggaaaacaggatatccatttgcagaagaatgaaactataaccttatctcttgccacatacaaaaacaaaatcaaaactgatgaaagatttaaatctaagacctcaaattatgaaactactaaaataaaacattagggaaactattagaacattggtgtgggcaaaaattttttgagtaataccccacaagcacaagaaacaaaagcaaaaatggacaaatagaatcatatcatgttaaaaagcatctgtggaataaagaaaataatcaaggtgaaagacaaccaacagcatgggagaaaatatttgcaaactctccaaatgaaaagggattaataaccaaaatttataaggagctgaaacaactctataagaaaaaaatctaatgatctgatttaaaaatgggtaaaagaaaaaaataaaaatgggtagaagatttggatagatatttctcaaaagaaaacataaaaacaacaaacaggcttatgaaaagatattcagcaccattgatgatcagagaaatgcaaatcaaaactccaatgatacatcatctcaccccagttaaaatgacttttatccaaatgataggcaataaacagtgctggtgaggatgcagagaaaaggaaacattcatacactgttgggaatgtaaattagtacaaccactatgaagaagagtttggagccttctcaaaaaaaactaaagataaagctaccatataatccagcaattccacttcggggtatgtagccagaagaaagaaaatcagtatattgaagagacatctgcactcccatatttttttgcagcactgtttacatcagctaagatttggaagcagtctaagtgtccatcaacagatgaatggataaaaaaaatatggtacatatacacaatgcagtactattcagccataagaaagactgagattctgtcatttgcaacaacatggatggaatgggagatcattgcattaagcaaaacaagccagccacagaaagacaaacatcacatgttttcatgtatttgtggaatctaaaaataaaaacaattgaacttatgagtatagagagtagaaagttgattaccagaagctggaagggtagtggagggttgcaggaggaggtgggaatggttaataggtacaaaatttattagaatgaatgaataagacctagtaattgacagcaccccaggtgactatagtcaaaataatttaattgcgcattaaaaaataactaaaaggggataatttgattataacacaaaggataaatgcttgagggtataaatattctattttttcatgatgtgattattatacattgaatgtctgtatcaatatatcccatgtatctcataagtgcattcattatttgtgataacaccaaaattaaaagttaaaaagcatctcatacttttctctgttgttatacatattctccaactaaaaatgatggtgggattatggatcaaaagattacaaggcaaaagattacagggaccatgtctttaaaattaaaactttcaaaatatgtgtaaatacttgctaatgtgagtatatgtcaacactatttacttctttcactggatgttagggaaaaaaggaacggggtggatccttctgggtaaaggaaaatagtttcactaaattcttgtctttatttcagaaaatgcctgcccttcaaggcagataagagagtatttttttaatatattttaagtctaattttccccttttaagtcaaattcttcttttctctttgggtgacattactgattattattatctccaatggaagatagctacatatatgaatggagggaaagagaagtcgtttggaaatgaaagactaacagaaaaagaactcatattatttgaacccaattcatttttactttgattcctagttacgaattctaattctatccaaccttagttttaagagtcttggcaaagaattgtaacacaggcaattttggcttcctgtatgccattcaacctgctgtccattctgcaagccatctttcttaattataaatctgactataaataacgcccctgtttaataatattctaaaataatttacactgtccccaggacaaataattactcctatatatttcatcagtacatctaatcttttcaaaccatacttcaacttttacattgcaaccatacaatttttttaattcccaaatttgtcttatcgttttgcactctcaattttggtgcgtgatttttcctcccccttataaaattctctttttgatataacaaatttatcataataaaagcatgcacacttacatgcaaacataagtctctgtgttctgttttcctgtcaatttttaacaccgttaataactcaaattaaactcctatttttcattgtaccaccactagtctctaaattgctgggagttctcactccactgttgcctgcacaaccctggaagtataaatttggaaggtgaggggacagaggctgacttaaggctgccagtgatactcccttcactatttcaaaaagtcgcataagtgatctcttttcttctctctccaattctgttcatgtgtcaattggggtattgtttatctatcacactcacttgggtttttttgtttgttaaatatacaaaagactgatacttaaatcattttttaataataaatataggtttgccactaaaattaaacaatagaaaagtttgtaaagtggaaaaggattatccacactctttaatttgacacaaggtaaccccaattatatgtttagcttgcatctttctgaattttttctatgcttttgtaaaacacttaatatattaccgattttattgatttccttaatcattggcttcctagtatccttgacctttgcttcaaccctgtaacagtcttatgacttggttttggccaacataatgcagtagaaggatctcgtgcaattcccagctcaggctttatgaagcctggtgctcttcttcctcgtggacacctgaacctaaatgaggacgagcctgagccacattgctggctaataagacacatcatgtggaaaagagcccagctgccccagccagccaaggtcattctagaccagccatgtgctttccaaacatatgagagatcccagcctttcagtaaagatgcctaccccatgcagaggtgatctcagacacatggataatctcagcagagtcaagacctacctagctaactggtaaccttgtgaacaatagcaaatgcttattgtgttaaactactgaggttttgggtgttttgatacccataaataaataactggcagacacatatttacctataccttttttccttatagcaccagtatcatatattatcaacaatttgctccatttgtttaatctttgcttcacaacataggacaaaccctttaaaaattcaacacattaaaattcaatactacctgatttttagaaatctataaattattaaaagtgtcaattcaatataattttaaatattttgtcaaagtaatacattcatgagacagtccatagtacagaaaagaatacaataaaaatcatatttcccagtacaactctccccacctttagtcccacatactagaggtaatttccttcaattatttttgttttgttttgtttggcagtaacatttggaattctcaataatgactattatacctctgtgtttcccgaaatatagaacataaacaatgccattgactacctgatatgaaaaatgagatgcagctcacttacatagccacatatctggtctattctacctaatatttgatgatgtcatgatgttcatactttttattgattaattgtggaacaataaataatatatttaatcctaatttcttctttcatcaatgttgctcagtagttaaattttctctatgtaagttgattaatgttgccctcataccttctcactttcaattatatcattatatttttgcaatttttatcgtagtaaaatgccataacaaaattacaagcttaacaattttaagtgtacagccaaatagtattaaaatacattcataattttgcacaacaatcacccatctacctccagaattctttctatcttgtaaatctgaaactttataaccattaaatgacacttcattttctcctgccctagcacctggcaatcaccattctactttctgtctctgtgaatctgataatctaggtacctcatataagtgtgatcatattgtatttttgtgtgtgtgaatggcttattttacctggcataatgtcctcaaagttcctctatattttagcatatgtcagaacttccctcctttctatgctaaattatattttattatatctatatacaatattttacttatccatttttcagtccatggatactttcgttgcttccacattttagatatcatgaacaacgttgccatgaatatgggtgtataagtgtatctttgagaccctgctttcaattattttagggatgtacccaaaggtggagtttctggatcctatgataattctagctttaattttgtgaggaacttccatactgttttccacagtggtgccatttgacattgtcaccaacagagcacagggttccgattattctacatccctgcaaacacctgttattttgtgtttgtttgtatgttttgatgggagtcattctaatgggtatgaggtggtatcttatacttttaacaccatcttctttcattctattgttggcggtaagtcacagccagtcgtcttcatcagccaagtatagatgttacatgagccataaaactcgaaaatctagttagtttcttccacttcattttcactcgtccaccattttcattgaaattatattgtctattagagaatctaaaaagatacagttcatacaatctaaaaagatacagtctttacttttattgaaataccaaatattgactatgcaagctatactggtaaatgtgctctttgatgttgacagaggagggctgggctgcctgtggtttcctgcagaagagagaaaggacagaaggtcaagatggttacccctcactgccttcatcccatccttcattatgattcttcttccatcttctgccatatgcttttgccatttccctcgacttccatctgtgacctctgtgtctatttagtgaaaagtactcaggaatatctttgtaaaacctaagttaaattatgtcacttctcttttccaaagcactggaagggtttcctatctactcagataatatttttttaaagatttaccatgtgatgttcaagcacattgtgatgaggctcctcactgtttctcctaatttgtctctgtcagttccctcacttgcattctcttttggtcacactatctcattgtagttctttttaaacctgttcagcatatttctgccccagggcatttgcacttgtattctgtgctggaacacctctcctgcataagaaccacatgattcactctccaactctgtgcattctttattccaatttcattatttcaaggcaggttttcctgaataaagtacctatagttgagcatgtattttctacagtcccataactgtggctgaatgtcagtaatgagacagccaagtaaaaagggctccctggcagaacctcccaccagactgtgcactgggaagaatgcacactggggtggagccttgggaagttcatgccatttgcagcagggagaagcctggcccctcctcttcctgggtggtacctggtattcaatctgcgaggcaggaagggcattagcaggactctggctctgtgaagggtctgtttcccatttttttccttttcacacaataaaccctgccctcctcacctttcagattgtctgtgagtctaatttctcatggtcgtgtgacaaggaccccatctttagctgaactaaggagaaagtcaacaacagtaatgtgatatgtgcactcagaggaccaaagccctgctttccccatagatagctcctgtgtttactctgttttgttcaaggtctgatgcactgtttggtaactaagtgtggcaggtgggagagaaacagagagagagacaaagagagggagtgtatgagagataaatgaacataattaataatggtaatatttgtacattattattttaataattactaacctaggactttcattgtgtattacattttgctgcaattttccttaccctttgattgattatatagttgagggaaactaaatgcatataagtagaataaaaaagagcaaataaatactcaccagactacatcaataaagaacactaacttgaccatataagcagtcagctgtcattggtcattgaacttcaccaccgatatagctctttcatttatttcaccctccaacaactctcaatacttacattttcaattgccaggaaagaggtagaaatctcttgtcaaggttgctcgttctatggtgggcatctgggctttagcctgtggaacttcaaatgatttctgtacctaaaagaaaaaacagtagatgagatatgagggattttgggttctcagaatgcatcttacaccatgaaccaggaaatgcctgaatgaagagagcttccagggttgataggaccaagcccatggatattccaactccttaacactgctactctacctcttagaattgacaccccatgtcatactgtacactttacatcaaaataaacactgcatgcctagtcaaggcttttcaacctccattttctctattttccatttttgacctacggatgtggaaatcaattaaatatcctttgggatatgctcatgagaactggatatggaagatttagtactttcaacccccaccaacgctgattcttcaatttaaggagaattaaatcccagaatcttgctttaaggcctgaacactgaacaactttcatgcccacaccaccatgctgacctctgaaatcttatgcatggactgatcaatgagatcctgcttaccgtaaatccaatatttctagttcttttcccaggaataccctcaaaagtacaatgtctaattcctaatcatccaaaaggatttaacttcccagttctctattcacagaaaccccatctcaatttatggtacaatcttctttaaacaccagtggtatatcttccttttcccacaagagttttactgttctctataatttttaatttagaaacaaccacactttcctgtgttaataccaatcctattttcccttaaaaagagaaggaacatttatctattcattcatgcatctatttattcaatatatattaattgaatgtctgctatatgtcaggcatattgaggtgctgagcaaatccccgccatcctgaagtttgcatattagtgagtaaatacaggtaaaaaacagacacataaataaactattaatatatgcttaatgggaggaggtaagaactgtggagaaaataaagtaggaaggatggggaataaggaatgtcccaagttgggcaaggagtagcaaaccttcccttctgccctttcccatggaaagagtgatttcttttttattccctgttacatgcctttatgaattctaccacaatctgtaattgcacatttttttgttaacccatattttcagtatccatatctctcacaaaagtgtgagtcctagatagtcttaagccatgcaagcctcatttacccctttgtcatcaggatgaagcccctcacctccatccagtttttattcatttagtaaattaacaaaaattatttcaaaatattttctattctctgaattttaataagttataacccaaaataggaagcttatagctgatattattttgttttactttgctcttcttctgggatatattgacattttctttctctaaagcagattttaaacacctgaatgacagaaatcaggtgccatactacttttgcttgcctgaaaaactgtgtcatttttattcgattagtgaataatgataaattctttctgagcaaataagtaaatgactagaaaaggaaatggaagcttaccttccgaaatatttccattaggtggcagcagcaagaatatttctggaagcatgtgatgagttccgtaatgaagatggagccccttgtgcggtctctccaggacacgttatctatgatgatacagcctggtatgccttgggctacgactttcactatgtttttgtttatatttttgtttttgcatagcttgagaatttacttgatagatttatggaaatcccttataaccaaacatttacttaggtttcacacagaggaaacagaaaagctggcaaaggttgaacaaaaaagacagcttgtaagtattgcaagagattgcatagtgattgtattttgattcttggaactaactttttattatggacctcatgttcattcactttgcttagaaaaggggacttgagaaataactggaattctttcactttacaaaggaaagaatagaagctcagaaggatgaataaacttttaggttcagtgaggaagcaacaaaaaactaccgtcgggctccaagattgtttacagattgcaccatgatgtctttcaccataaaataaacaaaatagatgaacacatccaaagtttcagttatagaagattaaaatatagaaaaatactgtataatatggtgccaatagtaaataatactgtcttatatacttaaaaatttgcagagagtagatcttatgtaaattatccttatcacacccttgcagaatgatgataataataaatagagagctggaggaatcttttggaggagagatgtttacagcatagatttgggtgatgattttaggggtgtgtactaatctccaaacttattgagttgcatacattaaatatgtacagttttcatatgtcagctatgcctccataaagtggtttaaaaataagacttgaaaatttacaacttggaaagagtaaaatagaaagccctttaggatgattacctagaggtgaaatacaaacgactgtttcctgtaattagacctaattagctccaccctaacatttcttaccttttttaaagctcattcacatttttatctggacacttaataacattgctctttgtaggatcaagtgggatatatgtagaagagggcttgaagttgatcgtttggaaagacagccagtactgggatccataaaacttctattcaaaatgttaaatggatttattaaaaaaacagcatccatcatctatgtttacatggtgtgtggcgaatggggttccttgtattgtattgctttaatatttggtatgcctttgactgtaaagtgtaacacttataataaaagtacagttttttaaaatgtgtgtgtgggagggggaaggaatctattctcacagcacacataagatcatgcaaaatatatagagagcacacaccattctctcagctcattgttgcatagggcctatcttgatttcatagaatcattcaaaggtggcctcagcacccccaaatttttgactgttactaaaagacacatacgtggtgttgaagaacagaaagcaatgaagtccttctcctcgtggatcttgcaaacagaatctgcctccaggttctcagatgactgtgaagagatgagtgccaaggatgctggagagtctctgacccagagttccccatgtttttctgtagagacatcaactttcttttttttttatgttactttaagttccagaatagaaatgcagaacgtgtaggtttgttacatagttacgcatgtaccattgtggtttgctgcacctatcatataggttttaagcccacatgcattaagtatttgtcttaaggctctccttccccttgtcgcccaccccccgactggccccggtgtgtgatattcccctccctgtgtccatgtattctcattgttcaaccctcacttataagtgagaacaagtggtgtttggttttctattcctgtgttaatttgctgaggatgatagcttccagcttcattcatgtccctgcaaaggacatgatctcattccttttagggctacacagtattccatgggatatgtgtaccacattttctttgtccagtctatctatcattgatgaacatttgggttggatcaagagacatcaactttttatacactgatgtgcctcacttagcatggctatcacaattgcccaccttgttatttttcagtgttctttctaactaatttcatacatacatacagacccacacacatgcaaacacacacacacattttgctttgtctctagtgtcattcaacaatgtgtaaattaatagtgaatttatcatgtcattaccagttttcagttaaattattgctgctttcttaaagaaacaaaacaaaatatacatcccaatagtcatgaggtaattggaagtcaggaataaaaagagggagagagaagattgacttaaatcccctcaagtttccttaactcccaactcattttcccttcaataattgtgaataaatagggtgcttgtatcacataataacttcagtttcaagtgcaaattcttcagaaaccacataatgtcaacatgtctgtaaatcatttacaaatcaagctatcatgtaaatgattccatttcaaagtttgaatatttctgtttaactttgatttagggattctgatgatctccttcaccacttccttcaccactatcaccgtggataaaattgtacagaaatttctccactgatgagacaatttctcattatatcagccccttaggtagagtttcttcataattcaatgtactttatttgcactggatggggtctaacattgtttcccctaaatataaaccaaacatcacaatcctctgcatacaccttcaaaactgttagatgttcagcctcagcactcaccacctctgcaggcctggacaatgatgaccttgggtttgtcctttagactgaggcagttgcggttgttgaatatctggaagatggtgtcataaagcagcacatccggttttttctttttatgcgcagttccgcagattccctctaggatgccatgagacatgagtaccaagaacgtgctgtcagaggacttgtgctctggtctggcagcaaatgccctcagcactgactccatatcctataaaagagcaatgtctaacttcagtcagagaagcatcacaattaataggacctcctagatttaccatgagcgaaacaagaaacatatgtaacatccgggtcgtggtgcttcacatagcgcttactcagtcatgacagcagttttatgtttttttgttttgttttttttttcctttgtaatggggctgtgggttcctactttttctccctgctgacacaccatacactgtcttcttaatatattgtatatttttatatgttacttatattacttttttttatctcaatcttttctctcctttcctaacaagagtcatgtgttataaacgcatcacaccactgtccttgtaaaacccaacatacgttgcttagaataaaatcaatcttctggcctgaccatactcatccttatactatgtctgttctgcttcaatctctagtcacactgatctgttgtgcctcacatgtgccagtttcattttcagctcagctctttcacaggtagcgccccctactgggaaggcgctgcattctcatcttcccagagccattccattccttccggtagtgccgtccaactcctgtgttctctccccacagaggcttttctggaccaacccaaaaacatcgcaccccatccaacattctctctcatgtttcctttttgcttactttggattctcttgttattcttatatagacacatacacacactcattatctgaaattgtccggtttcgtttatattgtgagattttacctccactctaacctagatccttgcaatttgaaacttctggtatcatttacagacttatccacagtatcaggaaaagctcttggccccaaagtttggatttaatatttgttttaagagtgcattcctgggccgggtgcggtggctcacgcctgtaattccagcactttgggaggccaaggcgggcagatcacgaggtcaggagatcgagaccatcctggctaacaaggtgaaacctcatctctgttaaaaatagagaaaattagccgggcgtggtggcacgctcctgtagccccagctactcggtagggcaggagaatcgcttgtggaaggtgaatgttgcagtgagccaagatcacgccactacactccagcctgggcgacagagtgagacttggtctcaaaaaataaataaaaataaaaatagagtgccctcctgcctaaaacacattactctgtgattttatgtggaatcttggggctacatcccaatcacctgatcttattggaactcagtaacaattgcgaaaatacatgccaatcatattttgtctagttttatggagttgagggtatttgaggctcaaaagagacactgatttatgtgttcaataatttcatttgctagtgcatgtgcgcatgtacacacacacacacacacgcacacgaacccagaggttgttaaaccttgttgaacttctataaagctaactaattattagaagaatctgtgttgcctatggatgagtgtgagatggcttaggggttcttaccctggctgtgagattcttttcgtcaaccacagtgtagcccaggccttgaagcagccttttcatccccacgatgtcatagtgagccccattccttgcaggcaggtgatcaaactttgtattgcatatgatgagagccaggcgtctgcggtcctctctcttttttattggatagatctgcaggagatggagatgaagcaactttgattacccgagtctcttttcaacccccatatgcctcacaattttgcttttttaagacctcatgcagctgccaccttccctaacctctatcagaagacactgccttcctctctctcaagagcccagagcaagaaccaggacatatctggaatgatcactctagaatcttgaggaaactagaataattcctacccccttccttctcctttttcttctccacctactcaaacatttcttatatttaggttcaaatcaaatttcatataaaccaagaggtgttgtcatcggctccagtaaaaataaatatagcaaattttctttgccttccgtattatgattattttggtactattttaaaaacataaacttacaatgattttcaagatttaattatacttttcaaatatattttatgtctaggcttttcaactgggtataaacaattactactcagccatgttataaacattttattttgtggctttatctgaaattgtaataaatcccaaattgatacaaaaatcaataaatgataaaaaagagaaagctacattttatcatggattgaatgagcactggtatttgtttgaagccatatgaacccttgcctgctgaaagcatctatcataaaggttaccactgtcaccaccccctcatcatttagtgctttaagtatttgtgcatttatggctggcactgtggttcccgcctgtaatcccagtgctttgggaggccaaggctgtggatctcatgaagataggatttggagaacagactggacaacatagggagactatatctctacaaaaattaaaaaaaaaatcagcctggcaaggtagtgtgcatttgtagtgctaactacttgggaggctgaggctggagaatctcttgagcccatgtgttcaagatagcagtcagctatgatcacaccacagcactccaggctgggcaacagagcaagaccccatttttaaaaatgtgcattgcatttaatgaaagcaattgtttctctcttcttccccatttcatacagagagcacagcacctcatcatgattttttttacacagtctcaggaattcttcacgaggacaaagtttgagtatatttgtagattctgctgactcaggtggtccagcctcgatttgcagaagagctgtgggatatcacaaaatataaattatggtttctgcctctgtgacccaatttatcacctaagaactttgagagagagagagagagaaatcctaggaaaaagactctttatatttaggggttatagctgtacctaatttccagcttaaggaaatgtgttgtgagaattccctgatagagaaagcagactcccacaaccccaccaagaagaagatgcaactatagattccgattattctggagaaaaaatcttgatgatttaaagttaaatttggcttttctatattcagaaaaacagtttgatttttccagtggttttacgctagggtactcattcatttatttggactttctgctgtgtctgggcaagagtgtgctaagtaaatacttgtcagagtgctatttgaaatacaatgtgagttccatatgcaatattaaattttctaatatcacatttacaaaaggtaaaaataattgtaataatatatttatttaacataatatattcaaaatattattatttcaacatatgtcactagccacaagttatgtctggtggctacaaaagtggatgggacaacatcccattttggattgatagtcccctcctagttcacaccacatacagatacatgtatacaacaaacgtttgatagaatattgaatcctgtaccatcctggtattttttaagcaacttttatgtgaattaataattattctagaagaaataagcttcagttatctttcaacaaattgtgaaatcacctatttatgaagaaaggttgtctagtgacaacacagtacacaatagtactgtgtccaaggtcaaagggacaaatatttgtatgagattctgacgtaactctgaacatcttgtctctaaactgctggacagccaacactgtccaactcatattttataatgtgaggaaataatacatctgttttggataagtttgcttctgagtaattctgatctatccccttgtgaaatgtaatattgatctcttttgaccgatattgtgcaaaaaactgggagattattgagccctccttctggaaaagaaaaaggaatttatgtatacaaattcaaagaagaatttagtaagatctaataacaagatttcttttcatgaaagaaatggacaagtatacttttatgtttggttacgtgacccaaccaagacataggaatcatgagtaaagtaatattgttctgtataaaatttatattgtttttaaatatttcatgtattttttatatatcaatcatttgtttctcttcatttttaataatattttaaagtaaatgtcttgctaaagagtatgataaaagcgtgagttctgggaatgcaataagttctaagtgtgtaaggaaaccataccttctaagcatctcttttttcatagattaaacagtgacagatgctttttcttctcatttcagaaaagtctgccaatgtgaagacatctagggtcctgggatattactggtctgagggtatgttttcctgtttaaaggtttggagaacttccaacttaacagtcatctcctaagacttttatgtgtctgtgtgtagaacaggtgttttccagtaaaattagaaattagacagaaattctatcttatatccagtagtagaattagtacaaaaatattattttattacaaaataataaatattatagtgcagtctccttccaaagagagtttctattagcctggcagtgcaacaggaagtaatgtggaaatcaggagtttagataaaaatttcaatttgagtcttatctattatctaatgaaacaggaatctctcaggaatctgctcaggaatctcttaacattgacacaacaagaaagggagtagtggagtggtacaggatcagtaaagcaatttcccacagcacatagggacttaggtggttatctcctgactaaatcagatcatcggtatatagtgtgtatatatatatgtgtgtgtgtgtgtgtgtgtgtgtgtgtgtgtgtgtgtgtaaacagttaaataacaaatgaatagctaggattcttcttatcctgcactccagaatccaatgctttgttggaaaccctcataattataaccatatccaaaggcctagccaaggcctgtacctcttctaatagcccagcccacccagcttcctggtctgctgtgccagtgtactcaaagtattctgggatcgatcattctggagaatacaaatgcagatagagtgcagagagccactggacccctcctgcagggatctgcagctgcctccttcttgccacagcctctgctgatcagataggctaattcagtttagagtttagtgctcatcatatatgatatctgggattgctaaaatcattttgaagcccgtattgctacaaatatgattcctatttgttgcattatctctgatttttaaaaaccgatattttttcctcatgccattccaggtttgaggaaaaggaaaatacttgcaaaagaccagtttaaatattaataagaatgcatccttgcctaaaatcttggacaactatactagcatgtggtttctgttgaggggaaactttccccacagagaaggggagtttattttgtatagtgaggtttgaacaatttatgttgctttatgttcatgatcgtatgtgattattggtaagctgtagtagttcagggctgaagatttcagtttaaagtctatggcaaattgagtccttccctggaaaacatggatctgagaacatttaggctctaataatactgataattcaatccgtgtcaaaagttttgaaatgttataaaatttaaacattttatagtagttccctgatcataattttgtaactcacagaaatgagtaagcattggaaaattccaatttgtagcgcccaaataataattaagaaagcactctttattgcatgcgtatacttcatttgtttattcatcacacattaattaggtatctgctatgtgccaggatctccattaattactcttattaattggtgaagaaaccagttacattctggtagcagaaacttggtgcatgttacttctttttactgaagcggaaaagggttaaaagtggagcacgtttattctggaaaacaaagcatttaattttagctgtattcattttgtgatgccagtgaaacactggagcagaattgttttatatgccgctagagctaaatgagtctggagctcagatgagagagtcctgaatgagagctggtatcttggaagttgttggcatgtggtgcctggcattacaatgtttctggctgtagacagtcttgtgagaaagtgctggaattgcccacatttcacaggtggtaagactgatgactagggagaatggaaggtcaagaaacttgcatgaagctgcatagttcacatgtgacagaatctaagtttgggtttaggtatctcctactaaaaaatctcccttattaactatttctgtgcacagtctaaacacaaggacacagctttttggctaattggaaatttgatcccgtcccataaaagacaaggtggtctctaacaggatgatgacatgtttactgaaaatgagagtttagaaatgaaactgtaggtagatcacagataacactgcatgggccttggagttgaatatattctggaaaatttaacatatttatcgtgttagatgcaaccttacgttttacactggtgatcttttggtccatattgagaagtgtttgggtaaacatttgatgagccacgcgattctttcgcaaagagtctaccaagatcagggccttgtcttcaattttggtatcataatattttttcttttcctcttccttcaatgtcagaacatcgtgttttgccaaataattaaaaacaccatgaagaacatctttgcccaggtattccaacatcttaactgttttttttttgtggttgtcttctgtcagaaatagaaagactcctttaactatgggcacagcttaaagagttctgccttcacctaagacataactctgtaatatgaaactcctctaaaaatacattctattttaccatgtctccagcgaataacacacatctttttttgcaactgcagaattctctcacctatcaaattcataccagactgtgcttagcaattcatttcctcttaaatttgtttttatagcttttcttcttccttctgtggcattgggaataatgctaatttcctggtcacctgctgctttcatatttctctttctcttgctcacagctcatgatgatgataatttacctgaaatggacactcccaggacagtccatgctcttgtctagactgtaaatactactagactatacaatcttgcctctttgctgtatttagtttccttggggaaagcactatatctttgaatttgcatttttagcacacatcctatacccacatctttgtgctcattaacatctttgtgcccaaaatgcttaaaagtacttagcatgcttgctaaatacatgacttaatgaacaaatggatgactgcacccagagtcctaattttttagcatcttttcctcaatcaaaatttgaaattgaaaataatatcataactactctagcatggtgaatttatgtgacatcaggttaatcactacaccttagcataatttgaatttttattggaaaatatagatatcaaagtgataaatttttttgcctggccctcttctaattactgccagtcattggtaaagcaaccagttgcattctggtgggagaaatttgatatatattagtttcttttactaaaatggaaaggggttaaagttggaacaaatttgtttagaagaaaaagtgtttaatttttaggtaatcattagtttaatgaagccaatgaaacactggagcagaattgttgaaaatacatctagagctaaatgagtctggagctcagaggagagagttctggatgacagctaatatcttgggagttattggcatgttgatgccagccaacacaatgtttctaaccttccacagtcttgtgagaaagtactgaaattgtccccatttcatagatggtaagactgatgattagggagcaagagaggttaagatacatgcaggaagccacacagattattagtaacagaatctagatttaggtttgaatatgtcttactacaagcctctactattaattatttccatgcacaatctgaacccaaggactcagccttttagccgattggaaactggatcccaccccacaaaagacaaggtagtccctgaaggaaaaattataggtttggtgaaaatgatagtttcataaaggaaggaggatagggggatcacagaagtcactgcatgggacttataattgaacagattctaaaaaattggaaatatccattgtaaaatatccagtcttactttttacactggtcgacttttgatccgtattaggtactagggtctggatagatgtttgtccagccacgttgttctttagcatgtggtttatcacgaagttatccaatccactctgaaggatacctttgaacatagcttcaaaattcttacgccttttttttttgccactgtcttctatcagaaatataaagactccttcaactctgggcacagcttaaagagttttgcccttgctttagacaaagctctgtaatgtgaaacacccttgaaaatacattctgtcttaccatgtcttcaacaaatactcattatttctttgtacctgtagcattctctcacccatcaaattcctaccaggctgtgtttaacaattcattgccacttaagtttgttttttatagcttgtctttttcctttctgcagcattgggcctaatgctaaattcctggtcatccattgtattcagatttctctctcttgctcaaactcatgatgacctacctgaagtgtgtgcacccaggacagtccattctcttgtctagactgtaaattattcctactagactgcaggatctttccttttctctgtatttagcttccttggtgaattaactatatctttgaatttgtgttttttaacacacaagctatacccaattgtgctaattaacaattttctgctcaaaatgcttaaaagtgcttaatctgcttgctgaatacataagtaaacatccaacttaatcattaagtggataaatgcatctagatacctaattcttcagcgccttttctcaaaccaaaatttagaattgaaaatatttaacaaatattatggtagattaatataatactgagttaatgtattactccttggtataattcagatttttaccaggagatatatatatacacacatatatatatatatatatatatatatatatatatatatacacacacacacgtatatatatatatatacacacgtatatatatatatacacacacatatatatatacacatatatatatacacatatatatacacatatatatacatatatatacacacatatatatacacatatatacatatatatacacatatatatatacacacatacacacacacacacacatatatatatcaaagtaataaatcacttatttcaatacaagagatatgatttaagcaggttgtatgtggaaaagccagatatctcctctcttctgttaactctataaagatcattatctagtttatctaaatataaggatagctttcacacaaaatacattttctaaagaaaacatgtcaggacattgaacaaaattttggcctagaagcaccagactcattttccaggttatcttgagttcatatgccaataatgaaccaaccattattagaaagacacatggaagttacaaaacaggacaaaaagttacatttaataaatgtaacatctcctatgtattttttgtgattaaaaaatgaattcacataaagcaatgacaatcatcattatatcatgagtaattatcattattattaacaatatcagtaattatcattattataatgatttaatcagtaattatcattattattatactcatataataaatcagtaattatcattattatactgatataataaatcagtaattatcattatactgatataataaatcagtaattatcattattattattatatcatatcagtaataatcattattatttacaagtctctcttctaagtactttacaaatagtagtatactggactctcacaataaaccagtagaatatttattattttatcaattttataagtcatttaaataataggctgccctaaatcacatgaattagggttcaaatcctatttttacaccacattccatagagttaaccatgacaggctttcagtaataataatatatgttgaacccccatgaggtcaagtgctttactgaaatttcacaaaaactccatgcaaaatgtatattaacctcttttatatggaaaaggaaacatatacagataagttacttaagaaattgagtgtaatcctgtgaaaagaaaatgaagtatacagtaactccggagcaggaatagaagtacaagtgatcagaatccagagccccaactcttaagtcatgaaactacattacatgatagttgttgaagagcttcttaagagaacacagataagatgcttaaggaactcagaaaagatgagaaaattccaggaggagagtttacagaggcttcttagaagacaagacaaaaacgttggttttaaatgcaatgtagatgttggaacagggaatgtgaagatttgcaaagagtacacagattagttaatggaatgtctactctgcctgagttctgaagttctatttaacttacttgcatgcttagtaaatgaatatagttttgactgaatgaatatgtggagacatgtgaaaagcaattaacctaaagaggtttacaacacaataaatgccacttatagaaaacacacagttaacatcatactcaatggtgaaaagataaaagcttttcttcaaagattaggaagaggacaaacacacccactttcaccgcttctattctagaaatcctaaccagaggaattagacaacagaaagaatttaaaggcatcaaaataggagaggaagaagttaatgtgtcctgtttatgaatgacatgatcttacatatattaagaaaaccctaaatgctccatgaaaaatctgttggaactaatacacaaatgcagtaaagttgaaggatacaaaaacaacatgcaaaaattagtatcatttttataacaacaaactaaaaaattggatgataaaaatctcatttataatggctataaaaaaatttcatgaaataataaggaataaatgtaaccaaaaagttaaagatgtatatactcataactataaaacattgacagaagaaaatgcctgagattcacaaaaatcaaaagatatcccgtgttcatgaattggaaaatattacattattatgtctatactacccaagaaatctatgaattcaatacaattcctattaagcctccaatggcattttttacagaaataggaaaatcaaccttaaaattcatatggaattatttaaaaattcaaatagccaaagcatccttgagtaaagaacaaaactggaggcagcacacaacctgactttaaaacatactgcaaagttataataatcaaacatagtactggcataaaagcaaacacagagatcaatggaataaaacaaaaaggccagaaataaacccagttatttacagtaaatttatttttgacaaagtttcaagaacagacaataggctaaggacactttcttcgataaatgatgttgggaaaattaaatatccaagagcagaagaatgaaaacgggcccttatctgccaccatatacaaaaatcaactcaaaatggattaaaaacataagcctaataactgaaactttgaaactactacacaaaaacgtggaaaagcttaatgacactggtatagacaatgatttttggatataacactaaaaatatgggaaaagaaagcaaaattaagatatgagattacatcaaactaaaaagcttttgcaaagccaaggaaacaacagtgtgaagagataaccaacagaataggagtaaatatttgaatccatatgtctgataagatattaatattcaaaatatatgagaaacacaattcaataggaagaaaacaaatattacaaaatgagccaaggaccaaaatagacatttttcaaaggaagatgcataaatggacaacaggtctatacaaaatgctcaacatctctgatcaccagggacattaaaaccacaatgagataatgcctcacacctgttagaatgattagaatgggtattataaaaaaaaaagataacaagtgttggaaaggatgtagagaaaaaggaactcttgtatactgttggtgaaaatataaattagtacagtcataatgaaaaacaataggaaactcctcaaaaagttaaaaattaaaatgaattaaaaatgttaaaaatgatgtagcagcccaaatatttagtatatattttaaacattaagtcagtgtgttgaaaagacatatacacttccattgtgattgcagcattattcacaataggcaagatataaaatcaacctaagtatctgtagatggatgaatggatggagaaagtatcataatgcaacagtattcagctttagaaaaaagaaagaaatcttgtcatttgtgacaacattgattaacatggataacattacattaaataaaataagccaagctgggcaccaaaaaacaaatactatatgatctcactgatgtgtagactcacaaaagttaaacacataaaagcagagggtagaatggtggtgattaggaggaggcaggaagtttggggagatgttgatcaaaggaaacaacatttcaattagatcggagaagtaagtttaagaaatctattgcaccacatagtgactatagtcaatgatgaattcttgaaaattgtttgacagtgtaaattttaagtgctgtaatcacaaaaaaagatgagcatatgaggtaatgcatatgttatttagctctttaggcattctacaatatatatttcaaacatcattttgtacataagtacataaaatatttatttgccaattaaataaataaaataatatttataaaaaacaattcaagacatttggcttgagagcctcttttcataatctataaattctcatagcatcaattataagtttaaaataataaataaatgactcaaatttatggatcagcccagatgtggatcccgtatggaaacccatacgtccaaaaatgagacgtcacttaaaatactcccacaacctcattcaattgaacttttaaaattgaactgctaattttcttctatttccatccttcatttgctcctccatatagtaaaaaataatacctaacttccaagtgcgggaaggcagcaaaacctggtgatattaaacttcttctgccttctgtatgtcttattccccaactcaattcacactgcattgattttatttactaaacattttcagaatctgaccactactcttaattttaattgttcattacttctattcaggccaacaccctttctttctgaattacaccaagaaccttataaaccttctttttgtcctttctattctattcttcacaataaagagtgttcctatatctagatttgaccatgaaacgtctcagcttattctaacctaggccttctcattcagcctcatcttctgatactgtccccaccttgctcattacaattaaaatattctgctcttcatttaatgtctagtccagtctcccaccttctccttgcttcctattctcctatactttctgttcattctccaagtctaagaccagatggcatttttttttttcaggcaatcctctgattctctgaggggagacaatgtcagaggtacatgcccctagggcaccttgtttctctttagggtagcatagttttttacctttaattgtgatttccagcctaattctcagcatccaccattagattttatgctctgtgaggataggtggccataaactaggcctgcactacttctggcactcaagggaagtctaataattatctactgaatcactagttgagtgaatgtagaaacaaatgaataaattttaggtatggcccaactcttgaagaatatttaataaaaggtaagtaagtttgattttatttaatagacaataagcacacactggaagttttaagcagaaggaaggcatattcattctggaaaatttggtgagcaaaagtttgtgaaaaatactctgctagttgtgagggtaccattttgaggaaatgttcttacatgttcaagcttacagtcaagtggaaagatagatatgcaaatacatcaaataaaaaacattgtaagaatttaaataacgagcagatgctcaaaaaaaagcatgagcacactgtgtttcaggtagaagatagctgtccagagaagggagggcttggcactgagacctgaaagactaggaggaatttgccccttggacaagtgagggctggtcccctaacagagagcagtgtgggaagaaacacaaagattttagggtgtctaaagtaatcaggaagctgggctagctgggctttagaaagtattgaagtgtgcagccaggactgaagtgggcgtgatgagatagggccatcatttgaagatgtttgtttgcagaaaattgacagaacattagagtgttgagtttaagagtcaggccaacctagattcactcttctcaacagacattagaccaaaagaaaatttcgtagtccttttctagacaccttcctcaactataaaatggcaataatagcacaaacttaactgactggttttaaatattcagtcacagagagtgcaagagataccgatcacacagtattatttttaaaaaacagtttttattgattactttttgttattttagtaatcaatgaattgaagatgcagtgataataaaaacgaatggaataatttagaggccaaattcatcaagagcagttttggtcctaggcaaagtgatgtgatgttcttacacattttatataggatactgtttttcactagttttatttaacaaagaccaactacacatggttgtttataattattaacccacttaacttatttttgattagtgctcttcaatttctcctatctattatctaatgattctcctgactccagtctacgaccagtaaagtcagcctgcccggccaaagaggcagccatggctatgaatttgacttactcctccctggccaaatgctttttagtatcataaaatagacaaaaaaaaaaaaaatttaaaagcaagcaattcctgcattttaggagtttcagttaaatgttgtgaggtgagatgtaaaccttggagataattaagctagtgggagaatcgaataaagaaactcaacagcaaggaagtacaagtgaagtaaaatacagtaaacatttgcttctttttcttatgaacgtaaaaatcgtgccttagagtgattaatggaaaaatgaataagtatattttgaaagacagaaacaccatctaaaacactatctgaaagtttagatatttttaaaaaggcaatagggagccaatgtatgttgctgagtaagaaaattacattaatagatccctagcatgtgagaggtgagagttaactaactgaccacctttgctaatgatgctaacctgcagaagaacctgtgccaggctagcttcataagaattgtctgcagatctttaaaggttaataaatgcctacagtctgttaaagattgagctattcagggttgggaatgcagtggtaatctgatttttaaatatgactgcagggggaggcgccaagatggccgaataggaacagctccagtctacagctcccagcgtgagcgagcagaagacgggtgatttctgcatttccatctgaggtaccgggttcatctcactaaggagtgccagacagtgggcgcaggtcagtgggtgcgtgcaccgtgtgcaagccgaagcagggcgaggcattgcctcactcgggaagcgcaaggggtcagggagttccctttcctagtcaaagaaaggggtgacacacggcacctggaaaatcgggtcacttccacccgaatactgcgcttttccaaccggcttaaaaaatggcgcatcagattatatcctgcacctggctcggagggtcctacgcccacggagtctcgctgattgctagcacagcagtctgagatcaaactgcaaggcagcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgactcctgaccccccgagcagcctaactgggaggcaccccccagcaggggcagactgacacctcacacggccgggtactccaacagacctgcagctgagggtcctgtctgttagaaggaaaactaacaaacagaaaggacatccacaccaaaaacccatctgtacatcaccatcatcaaagaccaaaagtagaaaaaaccacaaagatggggaaaaaacagagcagaaaaactggaaactctaaaaagcagagcgactctcctcctccaaaggaacgcagttcctcgccagcaacggaacaaagctggatggagaatgactttgacaagctgagagaagaaggcttcagatgatcaaattactccgagctacgggaggacattcaaccaaaggcaaagaagttgaaaaccttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaagtgaatgaaatgaagcaagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatatagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcaggttaccctcaaagagaagcccatcagactaacagcagatctctcggcagaaactctacaagccagaagagaatgagggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggatagagtcaagacccaccagtgtgctgtattcaggaaacccatctcacatgcagagacacacataggctcaaaataaaaggatggaggaagatctgccaagcaaatggaaaacaaaaaaaggcaggggttgcagtcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcagcgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactatctctcagaccacagtgca

SEQ ID NO: 417 - DNA, 22757 bp, Homo sapiens
actggaaccagggagctggaggttgcagtgagctgagattgcaccactgcactccaacctggtgacagagcgagactccgtctcaaaaaaaaaaaaaaaaaaagaaaaaagaactccaagacttcaaggttcccctgaagcttggatgcaaacgtaaagcctgacctatcctcattgataaataggcccttattctcccttcccttccattacttccctccttctcataggaaggcattccatttcttcatcctgccatttgaggcctctgcctctgtgtcctgccctggctaaggcccctgcctctgtctccaccatgccttgtgaccctggagaggtccctcaattccttaagccacaggttcctcatctatataatggggatgataataatagaagctgcatccctgggctgctgtgagaattacagagttcaacccccaaggctatgacgaatctgcccgtagtaaagagtgaggctgggggcggtggctcacccctgtaatcccagcactttgggaggccaaggcaggtggatcacttgagatcaggagttcaagaccagccaggccaacatggtgaaaccccgtctctactaaaaatacaaaaattagccaggtgtggtggcaggagcctgtaatcccagccattagggaggccgagggcagaagaatcgcttgagcccgggaggcaaaggttgcagtgaaccgagatcgcttcactgccctccagcctgggtgacaaagcgagactccttctcaaaaacaaacaaacaaaaaaccaaactgttcccctgaacttgtttttttgtggcagcgggtggcagctgggcctgtcagatagaggctgatttggaatcaagacatcggtcttttggggcaaccgttcagattctgtgagtttgaaaccacaaatgccaaagtttaaattgggagactggaccctgcaggcactatttaaatccctttttgtgttacaaatagtgaaccccccctgctgccatctgcaggccactaaagtgtccattccacatctgagtcctgggcgattctgaagtgggatcccgaggacagagatactaataagttggctcacgcctgtaatcgcagcactttgggaggccgaggcacgcagatcacgaggtcaggagttcgagaccagcctggccaacatggtgaaacctcgtctctactaaaaatacaaaaaattagctgggtgaggtggcgggagcctgtaatcccagctactcaggaggctgaggtaggagaatcacttgaaaccagaaggcggaggttgcagtgagctgagattgtgccactgcactccagcctgggcgacagagcgagactccgtcaagaaaggaagggaggaagggaggaaggaaggaaggaagggagggagggaggaaggaaggaaggaagggaaaggaaggaaatgaaggaataagaaaaaagaaaataaaagcaaaggaaaagaaaagagaaaagaaaagaagaaagaaaaagttgtgtccattcccgagtcaaacttagactccggacctcttttcccagctgccgccagggggcgcaacgtggctcattgtctccaaaaaacagccgctgtcaattcttcccttccccgtatgcccctggtacctccccccgtcaagaggtgaagtctatttcccttccgcttgaatccagactagccttatgacttggtttgaccaagaagttgagtcccatcgaatgactcctcttctcttcaaatcctcttatggcttcctatgtcactaaaggtcaaagccagagtccttataacagggtctggacctgttcagtgcagcagccactactgacatggggatattttaatttcaatgtaactaaatacaattaaacatccacatcctgaagtcacagtagctacatcgcaagtgctcaagagccacacgtggccagtggctaccacatcacgcagtgctggtgcaggacactgccaccatcgcacgcagttctcttgcacagctcaggtctacacactccgcctccatctcaccccctgccttgtttcccacctccctctctgtgtctccccccgtggcttcagccacccaggtctccgggtcacaccaggcatattcctgcctcagggcctttgcactgctgttctctttcttcaaatgtcacattcccagggagggcttccctgaccacctataaaaatgtaacccaggctgggcgcagtggctcacccctgtaatcccagcactttgggaggctgaagcgggcggatcacctgaggttggaagttcaagaccagcctgaacaacacggagaaaccccgtctctactaaaaatataaaattagccgggcgtggtggtgcatgcctgtaatcccagctactcagaaggctgaagcaggagaatcgcttgaatccagaaggtggagattgcggtgagcggagatcgcggtgagcggagatcgcgccactgcactccagcctgggcaacaagagcgaaactgcatctcaaaaacaaacaaacaaacaaaccctagcctggctcggtggctcacgcctgtaatcccagcactttgggaggccgaggcgggtggatcacttaaggtcaggagttcgagaccagcctggccaacatggagaaactccgtctctattaaaatacacaaaaattagccacgcgtggtggcgcgcgcctgtaatcccagctactcgggaggctgaggcacgagaatcgcttgaacccgggaggcagaggggcagtgagctgagatcgtgccactgcactccagcctgggtgacagagcaagaccccgtctcaaaaagaaaaaaaaaaagtgaccttttctgcacttgctcgctttatttttcggagctctgattgccctggttcactcatttgtttctcaatagcacgccgacttgtcaggaaggttaatagaggaaattggtgacacagacattgcaatcaggaagggctgagagtagcaagtcaggtgggctcaccattagcaatgcagggagctgctgtctcgtgaggattggaggagccacgtggaaaatgctgctgcccggagcccaggtggctgcgctggccagggagaagcccctggttggcggcggtggccgtcactgctgctgctgcttctgcagccaccacggcccaagcatcccccagatggcgtccccttcctctggcttcctctcccgtagcaacagcagtccctgcagaggactctggagtggtggttgcggggtcctaccccgcagggggcaggtgggcgtggcggggagaggcagtagagtcgctcagggtcagctctgacctgtccccgcggtgttcccggccccagcagctgctcagttatttgtcgagtgctgacggtcggtcggaagaaaccacccggactgaggaaggctgaccccagatgcgcctagttgggaatgtgctggaaagatacgccccctggagggagtgcgcccaggaagtggggaggagcgtttgagatcgaaggagtggccgcgtaaaggccctgaggtctcgcaaggaagggtcccggggcgtcccaggccctgttctaggtgcaagaaacaggaacctcctggagcgagcatgcggtggggaggcagggggtacgcctcctacatgaggaggagatccacgcattaggaagtgaggcctgctggggacaaaagtctggcaggcagggccccaggagggccggggcaggagagggtttgcagtcatcgtaaacggggcggcatggaaagccctcactgagaaggtgccaaagaccccaaggaggtgaggggttgcggccggcagatgcctggggaaagcgcatgaccggaagcgcaggaagagccaggttaaaagccccaagccagagtgtgataatatggggctgttaatgtgtgactactgcccctcccgtgccaggctcggtgctggcgtaggggaggcagtggggccaaagaaggccacctgcctccatggtggtcgctgtcgggttggatttccacgtgcctggagtttaaaagtgaggcagcctggaaatgagcttgcagagttcgctgggggcgtgggggaggtttggccgtgcagactttcagatagcgggcccaggcagggacctcgatcctgaacccgcccccaccccgatcccggagccagctcagacacaggggcgcctgaaaactcctagggacatgaccaggtgctggagggagggagaagtctgggttccggggacagaaaaagacagtccctaccgccaacgggttccccagacccggtttccactgaggccccaccttccccagcgcagtcttcgccccttgcataggaggccacatctcctacacgtagatatgcagagagcgtgtcaacgcgcaagagctgcagcgccccatttaaccaccaagaggctccagggccgctggttaaaatcgtgcgggaagagatagcttgacgccaggagttcaagaccggcccgagcaaaatagtgacccacccccaacccccgctccccgcctctcgtctatacaaaaataaatatacataaataaaataaaataagcaaataaatattacatcgtgccggcgatggtgtttcccgagcactcgaagcgcctaagttttccctggcctttgaacgctagactgcagaaagcggcaggacagcggttctcaaagtcaggttctggaccagctgcgccaacgtctcctgggaactagatacacatgttcgggcccacccgagacctacagaacccctttgggcaggcagcccggcaagctgaattttcgaaggaccccccaggcacctgcgatacgggaccagttggagaaacggtccggcatcacagtttgagaccccagatgtggggtctgatggtctctaggacccctagggtcacagttgtcagccccggctgcccattgctgggaatcacctgggaagctttagggactgttgctgccccagcggaggcctggcaccatcccgagattcccagagtgggtcctgtgtgcatgctggacatgggctccgggtcatttcagggacagccggggcggggactgctgccctggggtctctgtcaaggccgatgtgtgcagtgaaaaactggccgctgctgatacctagcaggaataagacgagatgacgtctcctagggttgattggagcacgaacacatcacacccttttcagtaccctgagcaatgctggaaggaaagctctgctatgatccccctttcccatgaggacatggagtcacagagaggtcaagttaccagcccaaggtcacacagcttgcaaggagcggtgctgggggagccaggcagctgagctccaaattgctctcctgtcacaccctgtgggcctgggagggagacccacaaatcagaaatccttccacccccatgtctttttttttttttttttttttgacagaatctcgctctgtcacctaggctggagtgcagtggtgcaatctcggctcactgcaacctccgcctcctgggttcaaacaattctcatgcctcagcctcccaagtagctgggattacaagcacctgccatcacgtccagctaatttttgtatttacagtagagacggatttttgccatgttggccaggctggtctcaaactcctgacctcaagtgatctgcccatctcgaccccccaaagtgttggaattataggcgtgagacactgtacgcagcccctccacccccatgtctcagggtggcatccctcccttccatgtctgtgttctggaatcacctgtggcctcttattttcctctttggtaaaaatgaggagcagctgggtcgggcacggtggctcacgcctgtaatcccagtactttgggaggccgaggcgggcggatcacgaggtcaggagatcaagaccatcctaacacagtgaaaccccatctctactaaaaatacaaaaaaattagctgggcgtgatggagggtgcctgtagtcccagctactagggaggctgaggcaggagaatggcgtgaacccagcaggcggagtttgcagtaagccgagatcgcgccactgcactccagcctgggtgacagagcgagactctgtcacaaaaacaaacaaacaaacaaacaaacaaacaatgaggagcagctggactggtccagatgaaggctgattcagagaccaatctctggtttcctgggcttcctcttggaaaccttcgtgcatttgaaaccacaccccagaggcatcaagggactgactggccctgcaggtgctgtttgaaggcccctgcgctgaaatataatagcgaacactctgttctgtctcagttactagagggctcccctacctgtggggcctccctgaatgctcacggtggggatgctgggaacagttcagaaaaggttgtgttcactcggggggcaacaaattttgactcagtgggggatagacttgcccaaagcctcagggccacccagaaaggctatgcaaataagacccagggatggccgggtatacaagtaagactgggggggctgaggcacgagaattgcttgaacccgggaggcagaggttgcagtgagttgagatcccaccactgcactccagcctggttgacagagactctgcctaaaaacaaaaacaaaaacaaacaaaaaaacccagggagacggtgtgaaactgtttcttttttcttttttgagacagggttttgcttgttgcccaggttggagtacaatagcgcaatctcagctcgccgcaacctcctgggttcaactgatcctcctcctacctcagcctcccgagtagctgggattacaggcatgcaccatcatgcccagctaattttttgtatttttagtacagatggggtttcaccatgttggccaggctggtctcgaactcctgacttcaggtgatccacccacctcggcctcccaaaatgctgggattacaggcgtgagccaccgcgcccggctgtgaaactttctgcaagcatctgtgtgtctgtgactgcctggcttttgagtttgtgtgataacatgtgagtgtgtccatctggctgagggaatcaaagtgtccaacggcatctagcagtgtgtgacgggtcctgagtgggtgaacacgttgacatttccaagtatgtcagtgtttgtatgaatgggtctgtgaatgtgtgggggttggcttcccggagcacagtgggtctgtgcgcctctgtgagtacacgtgtgtgtactacatgtgtgtgtccgtgtctgtgtctatgtatgggcagattaatcataatttctgttggtgaatgtgggtctgccagtggtgcctgagtgtacatgtgtctgtggtatgtgctgtgcctgcgtgcctggatccgagtgtgcatgtgtctatgtgtgtgtccacacgtgtatggcagtgagagagactgacccagtgttgcctgatgtctgtgaaatccacgcagctcctcgtttaactccatcttgccacttgtttggggtccacaccactttccttctcatgggcccctgatgttcccccgagacccccccccccccatagctctgggcgctgcagggaggaggagcagagagactcgctctgagccttcatttcctgcattcatgccgtcggctcctccagtctccgaatccctccaaacatctgtctctgctgttcctttttaccttccagctcctcaggcaggccaggtccccatggtcacgagacctctgccctccgaagtgggcagcgacaaaggacagcctccctccccaccaaccagaaccttcccacccagcctgtcttcctccgcgcacctgcaaagcctcccctccaggtgaggtccacagcttgtatttcttccaaacctcccagggcctcgttcttgctgtgagccgtggactacacggccaagtatccaccagcatgcacaaagcggctctagcaaggccatgcggcgcgccaggcagcaagcagcaccagcagtaaccactccactcagaaaagagcaggggtggggcgcggtggctcactcccatagtcccagagctgaggccagaggatcgcttgatcccaagagtgcaagtgagccgtgattgcaacaccacactccagcctgggtgacagagccagaccctgtcttgaaagaaagaaaagagtaaagaaaagagagaaagagaaaggaaagaaagcaagagagagagagaaagagagagggagggagggaggaagaaagaaagagggaaggaaggaaggaaggaaaggagggagggtgggagggggaaggggagggagagggagaggggagggagagagggagaggggaggggagtggagggagagagggagaggggaggggagtggagggagagagggagaggggaggggagggagggaaggggaggggagggagggaaggagggaggagggtggaagagagaaaaacaaaaggagggtggtgggatagaattctttactttcctgaggaaaaaaataagaaacttaggccaggcctgcaaccagttaggaagacagactggcctttggacctccacgaactctcttttctcctgccctcagcaaggctagagtgtggtcatttgctgtttttcactgctaggggttgtggggacacaaggcaatacaggcccccagcttcctcctaacctccacagggctttagcaacccagtttcttcccaattataggaagcagttggccgcgtgcagtggctcatgcctgtaatcccagcactttgggaagcagaggtgggcagatcagctgaggttaggagttcaagacaagcttggccaatatggtgaaacctcatctctactaaaaatacaaaaattagccaggtgtggtggcacacacctgtagtcccagctattcgggaggctgagggaggagaatcgcttgaaccagggaggcggagatggcagtgagccgagatcgtgccactgcactccagcctgggagacagagagtgagattccatctccaaaaagaaaaaaaaaaatgcagcagcaattaatgcacaatacacacagcctctttttttttttttttttttttttttttttgagacagagtctcactgtgtcactaggctggagtgcaatggcacaatctcggctcactgcaacctccacctcctgggttcaagagattctcttgcctcagcctccagagtagctgggactacaggcgtgcgccacaaggccagtctaatttttgtatttttattagagacggggtttcaccacgttggccaggatggtctcgatctcttgacctcgtgatccacccgccttggcctccctaagtgctgggattacaggcgtgagccaccatgcccggccaaccacagcccctcttttgggccttttcctattgcaatgatttttcaatgtgtccagtggccgagttgcccagatgtccgtggagcttgatgcaaacagaattcagagccacacaggcaccgctagcaaatccacacctctggtgccgagggccccagaatctgtgttttgaatgcatttttcagacgcttttactgtaccttataaccaagatcgggtgaggtgtgcaaaccaagggccctgtcccctccaaaccagcagagcccggggcatgaggatggcaagcgaagtgacaacataaacacaggtgtctccatcatcaaggatgggagtggaacggacagcaagggccaggtcacccccagagcattcgtcagttgtcaagtccaaagctaagaaatcagttcataaatgttttttgatttgcatgttggctcaactctttttaagtccaaggaggcagtccacattaagtgtgcaggcaaaaaagagatggaaaaaggagtcagtttctcccctgccctccctctctccctttatcaagctgagcaccttgagttgcatttgaggaaatgaaaactataggtgacgcaaccccattgtgtcgaattctttctttacattttttgggttgctacaaggaatcagtattttttttttttaatcagatggtgtgtgtggtggctcacatctgtaatcccagcattttgggaggccgaggcaggaggatcacttgaggccagaagtttgaggctgcagtgagttatgatcatgccactgcactccagcctgggcaacagagtgagaccctgtctctaaaaaatttaaaaaaaaatcaaagcatgaacaaaactttaacaagagaataaagagggttgttaggtggagacgtggccagcactccacctccactttgaagttcagaggcagagcatctctccctcccacacttggagggagggcccgtgggctgtctctagccctcacctcacagctggtcttcttgctctccctgctcagcttctgctctggcctcggccctcagcaccctgaggttcctggcctctcctgccctggggactctcttgggcagggttggcaaccggggagtgtgccagaaggctctccggcgcttgcaaaaccacgaaaagcgtccaggggtctggaacctcactgtcttgacctgtttccgggccctggctcctggagctgttcctgtggtcccttgggcagctgagacttcagcttcctggatacctggggcccctgccctctgattatgtgcagcctctgccctctggccagcccgggcctgtgccctctgattatctgcaccctggacagctggggccctttccctctggtcatgtacggcctcttccctttgattatctgtaacctctgacccctggtcagctggggcctccgccctctgattatctgcagcctcttccctgtggttatctgtgccctgtgacctctggtcagctggggcctctgccctctgattatctgcagcctcttccctctggttatctgcagcctctgccccctcctcagctggggcccctgccctctgattatctgcagcctcttccctctgattatctgcagcctctgccccctggtcagctggggcccctgccctctgattacctgcagccccttcccgctggtcagctatggcctcttccctttgactatctgcagcctctcccccctgatcagcctcgatgtctgccccctgacctgtgggtgctgtctgctccttcctgcggcgccgaaaggaggcccagttgatcttgggcctccatcgcctaggggaagcctggggcacacaaacatctcccgcgtttcccaagcgatcccccgggctggtgccctctggcgccgatgatacccctgcgctctccactgcggtggaggccagccgggcctcgcccaccccggggcccgccctcggcgcccaacccttcaccctccgcttcagcttcccccaggacacctggctgacatactcccgccacctgtccgctttggacagctgaggccccaggttgtcctcaaacatgggcactggcaggttgacgcggcggcgggcaggcggcgcgctgggctgcttctcctgtcgccggaggaaggcctcgaccagttcctcatcatcctcactctccaggtcgcttcccaggaacttgctgcccaggtagctgacgggcattttgcgcaccttcttgccccgccgcgggccctggcggctcttgtctctggaggtctcgaagtcgctgaactcgctgtcgctggcgttgctgctgtcgtacgtgcccacgaccagccggggcggaggagtcaccatctgctgcactctcctcctcactcggggctccttgggctttttggggggctggggcgggtgcggggtgctcttctccatgatgcgggccacgtcctccagggtgcggccctcttcttccaggaactgggtcagccgctcccgaaattctgcttccttggtggcgggcttagagatgactctccagacgcccccagccagcctgacctcccgggggatgagcaaatagtcgacgtcctccccgatctgcagcatccccaccgtggagtcctcctccttgcggaacaccttgccgatcttcttaaatgtccccacgggctttagggcttccacgaggacgtccaaatccacatctttgcagacatcggggacgctccaaagaatgaggcagtcgggggacggcaggaagccccaggggaaccagccccccacgtggcttttctcgagagtctttaagatctccagggtgatatctggggtgagggggcaatgagccccaacaaactactgtagcccttagtcttgagggagggactggatggggggagttccagcaacgctgaccggagagtctcacctccctagccagggacgagccaaacgcctccaatctcttcgcctgcaacaagtacagtcttgaccaagtccggctcccccaccaaggacttgggggaatcaatttccaggatgcctacgtgagccgggggcgaggtcagtcccaaggctcaaggcccactccaagctggaaacgtggtgtcccagctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcctccagtagggtcccccgcccccaggcaggccgccacccagctccaggctgaccttgacgcgccgcagcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccccgggcctagctgggcccattgcttcccagcgaagcggcagtggcccacgtcagcacctttcctgaaaggcagcggttcccaaacctgccatccgaaatgtgcaagtttccagccaagtccgggaggtgggtgtgctagtggattctactttttgagagccactggcaccacagattagcattttaaattcacgcgactatcggtacccgtacacctatatgcgtgggtagagaaatgggtacctgactgcaacagtcccactgtggcgcttggcaggtcagggctcaatacatatttttgaggggatgaataaacccaaatgttcatggccaggcgcggtggctcatgcctgtaatgccagcactttgggaggcccaggtgggtggaacacttgaggccaggagttcgagaccagcctgcccaacatggtgaaaccctcgtctctaccccgggtgtggtggtgcgcgtgcgtagtcccaagctacgcgagaggctgaggcaggagaatggcgtgaacctgggaggtggaggttgcagagatcgcgccactgcactccggcctgcgcaacagagggagactgtctcaaaaaaacaaaagtgcaaaaaaacccctacaaataaacaacaacaaaaaaccctaaaagttcacgagtagagactgcctctattttatggtagtatcttacagtgaaatattttgcaacttcgaaaaaagaatgagatggctaaggataggcacggtttatgaggcgcttcctatgtagtaggcaccattcccagtgctttctatgaatgaactcaggaaatccttgctataacaggagactggtagcatgagtacaattcccattagacagctgaggaaactgaggcccaaggacataaaaccacactctcaaggtcacagccatggggagtggttgagtttggatttgaatccagaatagtctgccttttgtgtcgaccaaagagtcaagatggccaggcgcggtggctcacgcctgtaatcccagccctttgggaggctgaggcgggcagatcacgaggtcaggagatcaagacaagaccatcctggctaacgcggtgaaaccctgtctctactaaaaatgcaaaaaaattagccgcgcgtggtggtacgtgcctgtagtcccagctactcgggaggctgaggcagaagaatctcttgaacccgggaggcggaggttgcagtgagccgcgatcgcaccactgcactccagcctggacgacagagcaagactccgtctcaaaaaaaaaaaaagaaagaaagaaagaaaaaaaagaatcaagatgtgaaccaatgctagtcgcattcggccgggagctcggttcttgagacgcgagtctaccgaagctcccgccagttgagaggcgagtctgccgaagctcccggccgaaaaagccaaatccttccttaacccagtgtctgaggggttttgtccgtggctcctcctgctacaggacatgcgactagcattggtccacatctttggaaccaggcatccagagacatgttgaataggcctcgttgttaggaaccctcagaggtacatggtaaggccagtgccatcaatcatctttttacagacggtgaaactgaggctggtctgaagttgcacagctctgagtggtggatctaatataatattagaaccagatcttgggcactagcatttaaaacactagctgacgctaaagacacagctaatccccttctcctaaatgtgttgcaccatttaaccacttagcagccacaatacttgcagccactcttgcctggatgtgtacaaagccccctcactgggcttcccgcctccccatcactgcttgcaatccaggccccatccagaagctgggggcatcttttaaaaacttaggtccgatctgtctctactcttttgaaaattctccatctcaggctgggcgccgtggctcacgcctttaatccagcactttgggaggctgaggcgggcggatcacctgaggtccggagtttgagaccagcctggtcaacatggcaaaaccccatctctactaaaaaatacaaaaattgccgggcgcggtggctcacgcttgtaatcccagcattttgggaggctgaagcgggtggatcacctgaggtcagaagtttgagaccagcctggccaacatggtgaaaccccgcctctactaaaactacaaaactagcctgtcttggtggcgcatgcctgtaatcccagctactccggaggctcaggcaggagaatcgtttgaatccgggattcagaggttgcagtgagctgagaccgtgccattgcactccagcctgggcaacaagagcgaaactccgtctcaaaaacaaacaaacaaaaaaaagaaacgaacaaaaatataagaattagccgggcatggtgacacatgcctgtaatcccagctactggggaggctgaggcagaagaatcgcttgaactgggaggcggaggttgcagtgagccaagatcgcgccactgccctccaccttgggcgacagagcgagactccgtctcaaataaataaataaatgtgatcttatttaactcataaaggaaccaggcaaatttttaaagagggaacggaggaaaaagagacgggccagagggaaagaaaagatgtgggggcttaggggacgttaaggtctcagcgagcggcctgttcacaattaccggcttattcaggttgtttttctcttgcagagccaggtcgttgggcttcgctggatttttctcctctttctccctggctcagtcccagccgccgcgctcagcccccgggcctcccgcggccccgcccctcgcctcccccttcgcacagtttgtggcctccgcagtccggcggtctccatggcaaccacgggacgcgctcctccgcgcggatcaaaactaagcgggtggggcggaggcggaggcgaggctgcagggagatggtgggggtgggggcgccacggaggacgagggcaggagctcctcttttctgcccctggtgcctcccttaggcctcatccccaaagccagcttccctgaaaagctgtttgtagaaaccaaaaaatgaaaaatcctaaggacacctaggtttcaggaatgctgattaaagaatcgcaagtctgagggctcatgacagtgccttccaagtggtgacctcgcagatgagacgtttgggttttgtagtcataaaagggctttcgttttgtttgtttgttttgttttttgtttgtttttctttttttatttggtgggggagcagggagcggcgcaaggaggataatctaagaaatgaaaatcccaaatgttccatatttttgcaaaaatcgtcaacctccggccgggggcggtgactcatgcctgtaatcccagcactttgggaagccaaggcaggaggatcgcttgagcccaggaattggagaccagcctgggcaacatagcgagactccggtctccacaaaaaatttaaaaattagccgaatattatggtgtgcgcctgtggtctgagctactcgggagactgaggtgggcctatcgcttgagcccgggaggtcagggctgcaggaagcggagatcgcccatctgcacgccagcctgggcaacagagcgagactccatctcaaaaaaaaaaaaaattgccagcccctgaacggttcagctgtgggtgtttttaattgcacagatctctggcaggtgagacccttctccagccatcacagaataaaataataaaaacgagaactgtagcctcacttttgcatttgtttaaaataaatggaaagttggaaaagaatggggaagagaaacaaaacacggctgaaatccctctacccagctacattttgttgccatttaaaaaaaaaatgggacacgcgggccaggggcagtggctcaagcttgtaatccaagcaatttgggaggcctacgcgggcgatcgcctgaagtcaggagttcgagaccagcctggccaatatgatgaaaccccaccgtctctactaaaagtacaaaaattagctgggcacgatggcaggcgcccgtaatctcagctactagggaggctgaggcaggagaatcgcttgaacctgggaggcacaggttgcagtgagctgaggtggtgccactgtactccagcttgggcaacagagtaacaccctgtctcaaaaaaggatacacggtcagaaaaagcaaaagttacagaaaggtaaatttttttcaaaaaaggattcttctccccaaaccccaccttccagcctctccccaaaaagtaaccagttaaatatctctgtatttttccagagaaaaaatgcttgcattagtgtatgtgttaattttattttattttattaatttatttttttttttttgagacggagttttgctcttattgcccaggctagagtgcaatggcgcgatctccgactcaccacaacctccacctcccgcgttcaagcaattctcccgcctcagcctccagagcagctgggattacaggccaacccacccagctaattttgtatttttagtagagacgggatgtctccatgttgatcagggtggtctcgatctcgaacctcaggtgatccacccaccttggcctcccaaagtgctgggattacaggcgtgagccacttcacctggcttttttttttatgttaattttagaatttatctcacagagatttttttcccccatcatcctaaattattttcatcacagcacttaccactttctgtttttgtttttttttttctttgagacagggtctcactctgtcacccaggctgaagtgcagtggcatgatcatggctcactgtaacctcgaaatcctgggctcaagcaatcctcccacctcagccttctgagtgtctggggctacaggtgtgtgccaccatgcctggctatttttaaaaattttttgtagagaggtattctcattatgttgcccagaccggtcttgaactcctggcctcaactgatgctcctgcctctgggtctcaaagtgctgggattacaggcgagaggcaccacgctgggcctatttgtatgtacttatttattgtttcaccctattagaatactatccccatgaggtctgggatatgagtctggtttgttcactgctgaagtctcagcatctagaacacttcaggtaggagctacaaatatttattaactgaatgaatgctgagaattgcactagatttattactataaaatgtgttttcacttaatgtccttctgtatcagtgcttgccagtctgtttttgtttgtcacgacagcttccatctttattccttcaagccaggaacgtgatactgataataattcatttttactgagcacctactttatccttggccctgtgcattttctcattcagtccttagaacccttccttaagcaaatgttattcccatttttcagattaaaaaaaaaaactgagtccaaggaaagtcacacagctaggtagtggcagagccaagctttgaatcactcaggtttattagattccaatctccacacactttttgtttgtttgtttgttgtttgtttgtttgttttgagacagggtcttgctctgtcgcccagtgatacgatttctgctcacttcagcctcgacctcctgggctcaagctatcctcccatctcagcttcccaagtagctgggactacaggcccatgtcaccatgcccagctaattttttgtaaagttggagtttcgccatattttccaggctaatctcgaactcctgggctcaagtgatcctcctacctcagccttccaaagtgctggcattacagatggaagccaccatgcctggccccaatctccacactcagtggggtggatcgcttgagcccaggagttcaagaccagcctgggcaacatagcaaaaccccatctctacaaaaatagtacaaaaaattagctggacgtggtggtgcaagcctgtagtcccatctactcgggaggctgaggtgggaggagcatctgagcataggatgtccaggctgcagtgagccattatcgcaccactacaccccagcctgggtgacagagtgagacgctgtctcaaaaaagtttagaaaaaagaggccaagggctgggcacagtggctcgcgcctgtaatcccagcactttgagaggccgaggcgggcagatcacaaggtcaggagatcgagaccatcctggctaacacagtgaaaccccatctctaccaaaaatacaaaaaattagccggccgcggtgacaggtgcctgtagtcccagctactcgggaggctgaggcaggagaatggcgtgaacccgggaggcggaggttgcagtgagccgagatcgcaccaaggcactccagcctgggagacagagtgagactctgtttcaaaaaaaaaaagaaaagaaaagaaagaaagaaaaagaaaaaggaggccaaggaagataacacagaggcaaaggcgtacagagtggaggaggcgatgtggatgtaaccctgtaggcagaggctggagagatgcagtcagcagccaaggaactcctggagccaccggaagcttgaagaggcaagcaagttcctccgcctggagcctctggaaggagctcagccttgccaacagcttgattttggatttctgtcctccagaaccatgagagaatacatttgtgatgttttaagccatctagtatatggtaatgtgtcacaacagccacaggaaacgaatacagagcccgttgtgtggccacgaattcccctgagtccagtgagggcaattccaaattaaaacatgctaattttattctgtgaccttgtctctcaggaataattatccctgaagcgaaagaattcttgtacagtgtcctgcgccctaggaattacatatgggtgacgggcaccttggaagtggtggggtttttggttttttttttttttagactgagtctcgctgtgttgcccaggctagagtgcagtggccccatcttggctcactacaacttccacctcccgggttcaagcaattctgcctcagcctctggagtacgtgggattataggcatgcgctaccatgcccagttaatttttgtatttttagtagagacgggctttcaccatgttggccaggctggtctcaaactcctgacctcaagtgatccacccactgtggcctcccaaagtgctgggaatacaggcgtgagccactgtgcccaaccactgctctgatttctgtccctatagtgtttttttagttttatgtaaaaggaagtatatagtgtgtgtcctttttggtctgacttctttgactccgcataacgcttctgaggttcaccgatgttgctgtacgcatctgaggttcattccttttttttttttttttttttgagacggagtcttactctgtcaccaaactgtgacaggaggagtgctgtggcacaatcttggctcaccacaacctccgcctccccggttcaagcaattcttctgcctcagcctcccgagtagctgggactacaggcacccgccaccacgcccagctagtttttgtctttttagtagagacagggtttcaccatgttggccaggatggtctcgatctcttgacctcatgatctgcccgcctcagcctcccaaggtgctgggagggcgaccgcgcccggccagtacattcttttttgttgctaggtcatattctgttgcatgaatacattgcagtttgtttattcattcacctgtcgtcggccatcgagttgtttctagtttttggttcttagaaataaagctgctgccgggcgccgtggctcacgcctgtaatcccagcactttgggaggccgagacaggcggatcacgaggtcaggagatcgagaccatcctgactaacacagtgaaaccccgtctctactaaaaatacaaaaaaaattagctgggcgtggtggcgggcgcctgtagtcccagctactagggagactgaggcaggagaatggcgtgaaccctggaggcggagcttgcagtgagctgagatcgcgccactgcactccagcctgggtaacagagtgagactccgtctcaaaaaataaaaaagaaaaaaaaaaaaagaaagcctgaagggcgactgaaagtcagagggaacagcaggtgaagagctgtgtgctctgtgcccacctaggcacatatgcccaccccttccctgttccccccaacttcctgccccatcagccaggggtcccacagcaccagagggcacatgcagctgggatatacgtatatatatgtttttttcctttttgagacggagtcttactctgtcgcccaggctggagtgcagtagcatgatcttggctcactggaacctctgcctcccagctttatgctattctcccacctcagcctcccgagtagctgggattacaggtgcgcaacaccacgcccggctaatttttgtatttttagttgagacggggtttcaccatgttggccaggctggtctcaaactcctagcctcaagtgatccacctgcctcagcctccaaaagtgctgggattacaggcgtgaaccactgcacctggccggaatcacaagttatgtgtcggtcactcagagactcagagactgccttcagaatccctgtttctcaccaaggactgttgggaggaggcctcagggtgctgtctccctggatccaccaagacctcattcctctttgtgctgtgccagccctccatgtggtggagcacgtgggctctggagctaggctgcctgggttcaaattctggctctatcaccctgtggctgtgtgatcttgggtcagttccttcacctctctgagccttggcttccttctctgcaaaatggcagttgtaatgagacttaacctcatggagaggttgtgagcagttcacgagaccatgataggtattggcacagaacccagggatggtaaatgctcacagttattagaaaaggcagagtgggccaggcatggtggctcatgcctgtaatcccagcactttgggaggccaaggcgggcagatcacaaggtcaggagatcgagaccatcctggctaacatggtgacaccctgactctactaaaaatacaaaaaattagccgggcgtagtggcacgcgcctttagtcccagctacttgggaggctgaggcaggagaatcacttgaacctaggaggcggaggttgcagtgagccaagatcgcaccacaacactccagcctgggccacagagcgagactccatctcaaaaaaaaaaaaaaaaaaaaaagcagtgtggtctagctgtttgtagactcagttccggttcacatcctggctctgtttacaaatcgtgtggctctgtgcctcagtttccaaatctggagaatgagattgtatcagtctcatggtgttgagtcttatgaggattaaattgtttgtgtaaaatgcttagaatagtgcctggtagatatgattattcaatatgcacgaagattattctctgctctaagcccccacttagaaccagagcgtgtactgcagtttcaaacaggccctcagagtgccacccacctctggcttgtttctcaaggaatcctgaagaatttcttctgcccagccgtttaccagagaaatcatgctctatgactccgatgtcagctggggcctcccagactgagagagacccgaatcagtgtgaggagcacagaatgtggtcagaggcctgttttcaattcctgttgtgctttgctctgtagccttagacaagttacttagcctttctgagctttactttcttcatccatagaatgagatgatgatcttaataatagtacagtttgataatctaatctcttatctg

SEQ ID NO: 418 - DNA, 25354 bp, Homo sapiens
gaggttgcagtgagcagacatcgcgccattgcactacagcctgggcaacaagagcgaaaatccatctcaaaaaaaaaaacgcatttgcttcttagggggtttcagacatttaagagaatcctatgtattaaatgcaagattttttttttttttttaagatggagtcttgctcttgtcacccaggctggagtgcaatggcgcgatttcggctcactgcaacctctgcctcctgggttcaagcgattctgctgcctcagtctcctgagtagctgggattataggcgcttgccaccatgcccagctaatttgtatatttttagtagagacagggtttcaccatgttggtcagcctgttctcgaactcctgacctcaggtgatccacccgcctcggcctcctaaagtgctgggattacaggtatgagccactgtgcccagctaaatgaaagattttaattaaatgcttaaatgagtttaagtctaaaatcaatatttaggccgggcgcagtggctcacgcctgtaatcccagcactttgggaggctgaggtgggtggatcacaaggtcaggagatcgagaccatcctggctaacacggtgaaaccccatctctactaaaaatacagaaaaattagccaagcgtggtggtgggcacctgtagtcccagctactcaggaggctgaggcaggagaatggcgtgaacctgggaggcagaggttgcagtgagccgacatcacgccactgcactccagcctgggtgacagagaagactccgtctcaaaaaaataaataaataaataaataaataaataaataaataaataaaatcaataatgtgttttaatcagtttggattattaaatccataaatgtctatgtattagttgtgtacatagtgtataaatagaagaatatttaatgcttaaatgctatttgtttaataaattcataagagaaacaaaattacattaagtagaaataccttaatgacatttagacactgagagggtgtcccaggaaaagagaggggcacctgaacttgaaggctggtgacagatgtttaaggggccactaacataccagatagattttatcttcctagactcatcatctttgcacctattaatcatgaacagagttagttctcctgaattcatcatatgaaaatgtcacagtggacagagagactcaagagaagtgagttttgactgggtgagtcaagagggattatggtcctgagtagccagggagtgatttaagtacgggattcagagaaaggagggacagaggaagaggtgctaaagaaacaaccctctggccgggcggggtggctcacgcgtgtaatcccagcactttgggaggctgaggcgggcggatcacgaggtcaggagatcagaccatcctggccaacatggggaaaccccgtctctactgaaaaatacaaaaattagctggggatggtggcacatgcctgtaatcccagctactcgggaggctgaggcaggggaatcgcttgaaccagggagtcggaggttgtggtaagcagagatcacgccactgcactccagcctggcaacagagcgagactccgtctcaagaaaaaaaaaaaaaaaaagaaagaaagaaagagaaaaaaaaaacacctgctgcatcagtcacaactgccatcctgaggccaagaagaactaaatggtctcaaaattatttcacaacttgttgctaccacctttccacagtggggcttgtctagccagagaatcaaacattaattcactttaggctggtcatggtggctcatacctgtaatcccagcactttggaaggccgaggcaggaggatcacttgaggccaggagttcaagaccaacctgggcaacaagcgagacccccatctctacaaacaaacaaacaaacaaaagagtaagcacgtcatacacatcatagaattctaagaactgaagtaaccttgtaacatttagttcatggtaaatacataaaggaaactattattattatcacccaacagtgtgtgtgtaagtgaaaaatgtcttttttactgacaaatggctaagtgaatgctgtttgtttgagggatgaaatatttaaatgagaagccaactcaactcttcctcttgatcttagagtcattctctcaagtgtaactcccagtgcaaagcatcacatcaacttatcaatcgactgtgatgtcaactacagcctctgcaccagaccagccctcctctgtgggacgaagaactatcctgtggtcctgccaggactgcctcactgggacaacgcactgcattaggatctatcccttacgatggctcagggttttccagtctctaaggcaccttatcattatcttacctaaacttcctaataatcctgtgagggaggctggacatctgctttcatcccatgttacagatgagaaaacgaaggtccacagaggtcaatgacttgcctaaggtgacctggcacagaaagttgtgtggcagaaggggaacttctgtttcctaacttctggataagcgccctcctaggataggagaaatgaatgactcttgctactccagccaccacttccactaattaaccactaataaaaatgtaaaaatcagtatgccagcagtagtccctgttgcaaacattaggacctttctcatatcacagattactgaagacattccctctctttttgttgtagttgttgttgtttggtttttgggtgttgtttttgttgttgttgttgtttttctgagatggagtttccctcttgtcacctaggctggagtgcaatggtgcaatctcagctcactgcaacctctacctcccaggttcaagcgattctcctacctcagtctcccgagtagctgggattacaggcgcccaccaccacacctggctaactttttatttttagtagagacagggtagcaccatgttggccaggctggtcttgaactcctaatctcaggtgatccaccctccttagcctcccaaagtgctgggattacaggtgtaagccgcctttcttttcttttctttttttttcctttttagtcttgccctgtcacccaggctagagtgcagtggaatgatcatggctcactgcagcctcaacctcccaggctcgggtgatcctcccacctcagcctcccaagtagctggtaccacaggcataacaccatgccaagctaatattttattttttttaaagtttatttttgctcttatgatgatgattttttttttgagacagagtctcactctgttgcccaggctggagtgcagtggcacaatctcagctcactgcaacctccatctcccaagttcaagcaattcttatacctcagccttccctctagctgggattacaggcgtgcaacaccatgcctggctaatttttgtatttttagtagagatggggtttcaccacattggccaggctggtctccacctgccttggcctcccaaagtgttgggattacaggtgtgagccaccatgcccggcctactcttaattttttttttaagtgctcaagctaattttttaattactatttgtagagatgaggtctccctatgttgcccaggctggtctagaattcctgggctcaagtaatcctcctgcctcagctcccaaagtgctgaaattacagacatgagccaccatgcccagttccaccattttttaagcaacaactaacgttaatccaaagaccaccctgaggggactggccacatccccctgggaccctccactgttaaagtccatcttccctgagccatcagcaccaagcatcagatgaacttcactgccctggctcagtgttgcctgtgtgtgagcctcagctccccatcctctctgggcctcagtgtcttccctgtgcagtatgccccgcagtgcccacccaatggggttgttgtgaggatttgctggaagggtgtgtgtgcaagccccttgtccaggacctggcctatatgtaaatataataaaagttcgttgttatttctgttaattgcatattgtacttgaatactccctggacagataatgagaaaaatgaggtttgagtcaccacccctgtcacttgtaaccctgtgtgacttgcttaatccctctaaatctcagttcctccatctgtaaaaatctttttttttttttgagacggagtctcgctctgtcacccaggctggagtgcagtggcgcgatctcggctcactacaacctccaactcccgggttcaagcgattctccagcctcagcctcctaagtagctggcattacaggcaccatgcctggctaatttttgtgtttttagtagagatgaggtttcaccatgttccccatgttggactaggctgtctcgaactcctcaggtgatccgcctgcctcgttctcccaaagtgctgggattacaggtgtgagccaccgtgcctggccgcaaaaatcttataatgccttcctcacagagaataatgaaggttaaatgatgaaacgcacagagcattttaatgctgagaagggcttcatgaggttgttgaaaaatgtcagtgaggctctgggagggctacagccggagtgtagattagactctgggtgtagccgcatggctcaggaattgagtggaagaagagagatgatgagagagggggagggacagagagagaggatcagccattccttcgtgcctgctgagtgcctgccctggtccagaccctgttctttgtgctgggggtgcagcagtgaactaaagagacaaagcccctgtcctcgtggtgcttatgctctagtgagtctgtggaacagagcaggggactgttgacaccaaatttaaatgtgcgaataggaatgactatgcagaagaggccaccaggaagagggacagagagaaatgagactccaggcttgatagaatgaccttgggctggtggaagaggcaggtgctgaaaacaggcatggaaccccttgccctagggcagggagaaaccaagagagtccaagctgggaaaagaatcaggtgaggaggttgaggtgttgacgaagggagtgtgcttggtgatgggaaaggtgggctctgaggaaggtgttccaggaaggacttctcagtgtaggatggagccttatggcagacgctgggaccgggcatcttctccagaaatgcccatctgccactcaggcaggcaggcaggcagctccctaccccttgagttctggtgtttttcctactcctttctcccctcccacaagctgcccaactcccagggacctgactggatggagagtacatacacctggaccactgcaggcatggcacagggaagagagaatccagacccaaatcacctccaacccacacctgctgattcttccgtgcttttgtagcctgacccttcgctgccgtcactccaactcctgtgtgaggatgttgagctcctgggaaaaccgaagggagggcaggagagacaatactgtgaccaaaggctgagactgtgtcatcacttgggaatgaaagcatcaaatgccaccccaggtgggattgttggcttcaaggtttttttctccctttcctttctcccttttctcttttcctttatcgaggtctgctatttactcagcaactcttcaaagtctgtggttctgtgggacacaatgtgctaaatgatgcctgtaagggaggaggtcgatgtacctccacttccaagaagcttgactttccggggaagaaaagacaagtgaagcgtagacattgcgacttttggcttcctgtttctgtgagttgcaaggaatcctgtccacctggccctggagccgccttctgggacctcatccttgccccctgctgcaggtgccatctcaattagtcctgctgtccctcctccccctttcagattccagcacaattctggaacagctctcccacctggccggggtgagactgaggctccaccctcaagcacttgggcactgatcctttgtgaaggatggggatagcaagacagcgtctgcaggggcccctagagggccgtggggatggctagaaaacaggaatgaacagactcacttcagcttatgcccagactcacttcagcttatgcccagaaacaaagaaaccaaggagaagcaaattccataagtgcttttattttattggagatgagcaggggaggcactgaaaagtggggatagtgctggaaacatgctgacagggcctggattgagcccacacagcaaggggcgggagcaggactctaactcccaatgttgggtttccctctatcgtgctctagccccactgcaacctagggcttggaggattagggaagccagctgggatgttccaagaagagccaggagggcggaggactccaggaggaaatgggttattgatacctgggtatagatgaatattcccccagctgcctcctggataccgattaatattcccccagctgcctcctggataccgattaatatttccccagctgcctcctggataccgattaatatttccccagctggtacctgggggttgattattgataccccagattccctcagggtgtggcatgggcctcgttccccaaccagtcccagggcctccacctccccaggacacactgggattcagggtaccccaggggtgatcaggcagaaccctgtggatgagagaccagggagggcgttgggaaaggatttttcccccggctcccagtgaattagaacggggcagtcgtctggactccgagtcctggtggaggagtgaagccttgggtgagaggcctgtggcatcgggagaagactccccaggcaaagggccactgcccggagcgagggccgcagcactggagaggtaagagagttcttcaggcagcgcttcccccaggcggtcctcagccgcagcagccatcatctgccaaggatcctcagggggccaggaatccatggcaggcagcccccacgatggaggccacctctgcactgcagaacctcctgcaggtgggaagccatctgatgcaggcacgctgagcttcagaggaacccttgccaagtcattagacctagggtccagagcgggctgcggatgttcagagttagaggggccagtggaggaaggttgtccgagctgaggcaagttggtccccaagttttgggaaactttctcctccacaacaccgatgctccgggcaaagaggcctgagggaaagggaagataaagcaaccagtggtctccagtccccgagtccccagttccctttgcttcccctatgcctattcttccttttccctcagggacctaaatgtgtaccctcctgcctttacccctttccttaattcctgtttcctgggggacctccagtccctcctgcccaagggcatcacggcctccatacctgggagatgaagacagaccaggagcaggcccagaggagcgcagctccctgccacgcggccctgcatcctgctcagcacccgatctccctcagccccaagacagccagccctttatcctggtagtggggtgggggacagcagaaacaggctgggctagtggttgtgaagacaataaacctccacattccaccctcattcctaatgtggtctgtggcaacaggtgtcacttgaatgaatgtcccagaggaagctgggtgtctcccgccctggctcctttccttgacctccctgccccttcttggcccaggtgtcctggctcacagctcatccctggttgccagcctccccagccctgcttctctatacacaaggacctccaccctggggtcccactctcttaattgcctctctcagcaacagaaacacttgtttctttttgggagctggattgtttcctcccagcacccctttctcatgcatcctcatatctccttcaccttggccccaacctgcaggaggttctggggtgcagaagtggccccatctgaggagctgctcctacatgagaccctggatctagctagggaaatggacctggatgccatccttatgagatactgactaattcctgctgctgcagtgacaaattaccatgaaccgaatggcttacaacaacatggatttattactttacagttttggagatcagaagtctaaaacaggtctcagtggattaaaataaaggtgtcagcagggctgtgattctttctgggggcctcaggggaaaatccctttccctgctttttcaccttctagaggcatcctgtgttctttggctcatggtccccttcctccatctccaaagccaaaatcagccatttcttacactgtatcactcagacttcctcttctgcctcccatgtccacattaagggacctggtgactacactggacccacctgaataatccatgataatctctgtgaagtcagccgaatagcaaccttaatcccatctggaaccttaatttccctttgccatgtaacctaattcctacgttccagggattaggatgtggacatctttgatggtgttggggttgaagacatcattctgcctgctactggtggtcagatgtgccatagagtataagaaaccttgggagaaagtggctatttccaagtaacagtagaggagagcctttaaatgctgctgtcaaatggccaggacttgatccttgttgaagctgggcgatgagaatgtagagattcattaacagtttgttggcttttaaatatgtttgcaaattttattataaaaatgcaatggctttgttctctccatggcttccgggaggccccaggagtaggcttccctggctgcccaaggtctaaacatgagctgttggctgattctactgctgtgtcctccccacctgcccctgctggcttaaccactggaggagtgaagagctcctctccagaactggcagtggatggagcccagaggcctttttggatgacatgcatgagttttacacaagcttttaatttggagcacagcaggagactcgaggaaacaccacatcagagagccttctctccctgcaattcccattcatgaagcatctgaggacctcgattcctgccattggctgcagatcaggggccagatgctggaccaagggtgattcaatccctttctggtcaatgtaatacatttttgctgattccagacttggagtttcaacagttctaaattcaggaccagacagcaccaccctgataggagggaatgggttaagtgctacagtaggggtgaattcctttgcagccaagcagaggctctgagaggtggcctggggtggggggtggggctcctacagggacaagcacaatccactctgccctccttgggatgcgggaacttcgtccgcctcagcctctccctgcctgtctcaggacttaagtcgcatggaccccaccacacactccactttctctctcttctccagtggaagcgactcctctttcccactggggcactctgccttctcagccctcacctgagagccatgttgctcacactctcactctggaccccagcagagcagggagtgtgaagatggagagaccaccggcagctctgttctgccacaggctgggcctcttgatctaggccagtgagtcaccctgcttggctgcactccctgccctgctcccatcctctcagtcctttactctctccacccccagctccaggaacaacgcccaactggcctcctactcagctgacaggaatctggttggagttgttgtgtcccagccttcccaagcttccaggtgtcccagaaacccaggaaatcgagactcatgactcccagagaggatggcatctagaaggtgaggaatgctaatggtggaagaaaaggagtttgggtggggaggggaggggaggggagggagaggaaacactgagggccctaaataaggggaagggggaccccacggtgaatgaggaatgggaagagaatggatttcctggagcaatgagagaggagggaaatggcggaaggatctgggaggccaggcaatctctgctttcagttcaacaaatatttattgtcttcctcctctgtgggagcagctggaaggtagaagagaaacacagcccgcttttgaaggaaaatgaggaacacagagacctctagaggcgtaggaagagcaccacccagactctcagaggagacccaggactccaagaaggcaaaaagtctgcacctagtccccacagtttactgagccatctgtccaggatccagggacagcagggagcctgcttcaacctctgagggtgccccagtgtctccctcacccagggaatcatctgagcactgagggaagtggccacaggaaggggctgagataagggccttgagaggcaatgggtgtgttggggacggtgatctaggagggcgtggtgagctctgtaatggagggtggggtggaattgggagcgagagcccagtggcatattgggtgggttgactagatgtcgaagaaaggtcagtgaaaagtggccactgtttccagatgatggtttgactttgctttatttggtaaaggggaagaggaaggtataacttcttcaggcgtcagaggtgctctgagagcatttcaggggtttcccagttgagaagctgatgggggtgttactcaatggaccatttccacacagtagagggaattgtaaggggtggtgatctggctgaggggcactgtggtggaatgggaatttaaacagtaggagagaatcaagagaggagctttgaatctaccattttgagaagaggaaggaggaaggggtgataagagagagtctgcaaccttggggtagtggagaaagcagaaccactcttttgggaaggagggaaactgagctaaccctatgcctgggcactggacttctcccatatgggatatagtgtatgtgcttgtttgtgcccaaggcatgcacacacacaacagttgacttcttatggactgttgagtaactctccttggggtaggaaaacttcagggtcagctagctggggccccagaggcttcacttgggctaggatatcccggatggagcggcaggggatctttccagcactgctggagccacagggcttggcaccagcggagggatcaggatggggagagccatcggggcccccagtcagtgtcaaggaggagacagacatgcaagggtgaccagaagagctggacttgctgccacaaggctgaaggatgattttgccactggattgggaactggagctgctgctgaaggagccggtgcctggtggggagcaggggctctgggaagcactgccgcagggatggtagggtaaaccggagctgctggaaatgctagaactgctggggactcgagaactggagggagagcagggtcccttggagcccgtggagccgcctccacagagctggaccccaccagtccccactggctggaatgcaatggccgaggaagctgccgactggctggggatgatggggttgctggagaagtatttgccctcagagatggggggcccagctgcaaaggaagggacccctggagagcctttcacagggttctctttggtgaagtagcccacagggtagattttacccttactgtaggtcatgcctggaaccagataactgtcagaggagccacccaccacctcgtagccaccataggatttgtctacagaggtgattgggggacagggcttgcctggaaggccaccattgctacaggggggaccttgaaccactccaggggcaccagaaccgtgctggtccaccaccaccaccacaggcctctgaccccctgacacagagtgggagctggggatgtaggggccggagtgcgagacgatgggccctccactgcagggagagtcggggatgtccgaactacagggacgctggttggagctgacgctttggccactgctggataccccaaaggtctgggaagaggaagagctttgtccaggctgggaagggtttagtattccgcggtaagagttgtcattggttggcagagcagagccattccctacttggaagctgctgctgctgaactgaaagctgctgctgctgctcgaatgagagctgctgcttcccgagtgagagccgctgtttcccgagtgagagctgctgctccccagctgggaggaaccggatgcaccttgtagactagagccagatccggaggagtagctgacctgggaataccccgttcctggcttaaaagatcctgcagaaccaccctgggcaatgctggatccgctggagctaccactggagccaccaccagagcttctggcactggaaatggagctgccagaactgctggagccactgtagctactgaaaccgctggagtcacccttcccagtgaggcaggggtcgttaggggaggtgatacgcgtggggtccttacaagggtctgagaaggtgccaatgctcttagccaaggtccctgtggaggaaagcagtggttagtaagggccaaggaggcttggcttcctccctcacctttctgccttatctcagtcatcggcctctcgggtttctcccaagcagagcgcagggagagtttagggatggagaaaggaggaagaactggctattgtctctaaaggatattgaggtggccgaataaaggcatttctttgtttgggaagggtgggcaaacaccaaccagaaaaatagaaaattaggtgccaaagtgagtggcctcaaaggaatacattgaatataagagggggctgggcacagtggctcacgccggtaatcccagcactttgggaggccgaggtgggaggattgcatgcgccccagagttcaagaccagcctgggcaacatagaccccgtctgtattttgttttttaattaaaattttttttaaaaagaagagggaatggagaaggggcaggaacaagtaggtctaaaagaaaggaccctgaagagacagagaattggggaaactgaggctctgaggagtccaggcgtaaattcttaggggaaaaatcctgggccagacagtgggaccaaagggaagaagacaaaaggcaaaacaatggagggctgagaagtggagacacatatagaaggagacactggaaaaagacaaagctgggggcagaggggctgaaataaaggaaagggcactcgaggactaagatttggtcaccagcttcttcgtgagagcccaggctggggtcaggaatggaaaccctatttcctatctcagcactggccatgccagtaaagctgggtgggggccaggatgtggggtcactacctgttgcttcagaacctgctggtaccagtgtgtcaggacaccgcaccctgagccagccctgctctcgctggcccagcccagggaaccaggacgaaaccccacgaacctccgaggctcctggccacaatcagcttccctctctgagcacacctgcctctgtccagcccctcatctgacttctgctgccttgacttccctcagggatgtggagccacatctttccttatctttcctttcctttgctcaaaaccccaggcccaacttaccccgtggttcctccatgactctttcacctgcgttccttctgccttccctagcccctccaggtcccacgtgttacaaacagagccacatactagcaagttactgaacctctctgagctttagtttatacattcagaggggccaaattttccctgccttcccacagcattactatgaagaaaactaaatgagatcatccacctggaagttttttcttcttcttcttttttttttttttttttgtgagatggagtttcttgttgcccaggctaaagtgcaataacacggtctcagctcactgtaacctctgcctccttggtgcaagcgattctcctgcctcagcctcccaagtagctgggaccacaggtgcccgccaccacacccagctaattttttgtatttttagtagagagggggtttcaccatcttggccaggctggtcttgaactcctaacctcaggcgattcacctgccttggcctcctgaaatgttgggattacaggcacaagctatcatgtgcggccagatgttttagaaagtgtaaagcattatatattatgaattattactgccactcatcctgatccctccaccaacaaccagactgccatcctctgtgatgtccctgttctctcctcagaaagaaattctctgcatgcacctccacgccgaaccccagctgtgccaattcccttcagtcctctgcacgaatccaccatgcattgcctctctctttcgctattccctcagacaccaaccacccactagaccatgggaaggtcgcagaaattcctcaagggctataagtacccggtggtcaacaacacaggtccaggggttgcccggcctggggttgaaatcttggctttgctgccttctaatgcatgatcttgagctactttcctaacttctctgagcctcagtgtcctcatctgtagagtggaaatagcaaatctcctttcataccgttcttgtaatgatcaaaagtgctaatataggccgggtgtggtggctcatgcctgtaatcccagcaccttgggaggctgaggcgagcggatcacttgagtcaggagttcaagaccagcttgaccaaaatggtgaaaccctgtttctactaaaaatacaaaaaaaagaaaattagccaggtgtggtgatgggcacctgtagtcccagctactctagaggctgaggcatgagagtcgcttgaacctgagaggtggaagttgcagtgagccgagattacgccactgcactccagccttggagacagagtgggactccatctcacaaaaaaaaataaaaataaaagttctaatatataatccaaatgtgcttaaaacagagtctagcatataaaaaggctctaaaaatgatattattactattaaatgtccaatcattatcttgtagtgctcccataataaaaatcaccaccaccatttatataaacctctagaatttccaaagtacatatcacatacattatttaatttgagacacacagactagagttaggtgtcattaaccccacttcagagtttcagaaactggggctcaggaagtttaagaaacttacctgaggcgaccatacagtgaggagcaacccccagactcaaaaggcagattccagagcccctgcctgtccccttcgctgggtcctctcccggagtctccctcccgcctccctcctgttcccagggcccccagcctcctacctggcaggaggagaccagccagcagcagtgccatcatcccgtgcccacccacacgccccatccagggtgcccgagacgagcccatctcggactgcacggcctcctgactgatggcagctcaaggacacccgggtcctttatgccagagctggacattccctgggcaggagtcactgtggggagaggaggagaggtggagggggtgggtgccccaggggaagttggtgtggccgggaggagcgtggtaatcagcccggtgcatctgcctactcagcagcagcagtggctgcagtgtggggtacccatggccacggggctctaacgatcctgccacctgacaggcctggccccggctcctcattgcctaacccggaaccaggcgctctgccccacggccacccactctggggcggccactcttgccacgggacccagctgcctggctccttaactctcctgcctaccgtagcttggcctgtctctccatctgccctccactcgcagtcgtgggtgtttcagctttttcttccacacttgggtgcccgctccagccccacccacccaaccccaatgaggtcccattcacagcccctgatctgctccttccttaggaccccatcactccacctccactttcctccttcaaatatgagttctgcccccatcccccaggctccccctcccaccactccccaagtaccaggccagccacatacctattacgtgttccatcacctggggaactttctccttctcagaaatggggcaccacattcccaaaaccaactccctgacctgtcgcttctgggggcctctggggacggcatggtggcgggggtgggggggtgctgggagccagggctcagccaggggaggggcctgggctgatgacctctgtcaaagctgggccttggttactcacagggcactcacagcccctccccatggctggtaacccagacctcaagggtgagcaagaggctaagaaggctaattgggaaggtggtggccccatagcccatctgctggccctgggctggatgagcgagcaggaagcagcagccagctctgggcaggtcgaggagggccaggcaggctcccgggtcctcaaaggatgaaaggaggccaggagaaccggagccctgccatctgctgagagggtggtggcttctcctccattgcgttggcctccctcctgctctggcccctgccccgccccagccaattaattgctcactagtattgcgggagtatcagtatcggagggaggtgcctgggagtccagcaagctgccctctcctcccccaggcctcagacacccctgctcccctcacccaaactcacttcccaaacctcatctcctcacaaaggcagctctgtccctgggccccttggcctggtctctcccattccctctacctcctgaccgccctttaagttcagaccagcaggaggatggaaatgtttcctgtctgtgctgtccgatacggtagccactggccacatggagcaagtttaaccaccaaagatttggagctttaattttaattaattgtaatgatgtggttggccacgtgcagctagtggctgccatctagtcttgctcttgacttgctagtgacactcagaatgggagtgggaggaaagaggggctgagggagctgtggagagaggaagggataggacagggtcccctgaagggggctaatgccttgggaaaaacaaacaaacaaaaaacactggcttcagaatgaagatgacgtgggttcaagtcccagctaacctcttggctttgggcggctcttcaaacctttctgaacttccatctcctcatctgtgaaatgggggtattttaaataacacttatttcacaaggtttttgtgaacatcaaatgggaaattatcaaaaaggttaaatgggacaaggggtgcagtcccccagtaggaagcccagcaaatggagccctgcaggtgctcctgtcttcatccttccactgggggagacaaataggccagcttcacccccacagccccaggctccctttcctgagtctccagcccagccaatgctagcagagtgtcttctgctcccttcctgccttgtatagaggtgcaggcacaaatgtgagacagagataccatttaaagtgatgctgctcggctgggcacggtggctcacgcttgtaatcccagcactatgggaggccgatgcgggcggatcacttgaggccaggagttcgagatcagcctggccaacatggcgaaaccccgtctctaccaaaaatacaaaaaaaattagccaggcgtggtggtgggcgcctgtaatccctgctactcgggaggctgaggcaggagaatcacttgaaccctggaggcagaggttgcagtgagccaagattgcaccattgcactccagcctgggtgacaaaagggaaactccgtctcaaaaaataaagtgatgctgctctttccgaacatcatttcctcctgtgggcctccctagactctcaggcttggctccctggaggacctgggcaaggagggagggggcactggggtaatgaggggagtggcagagggcagggaggagtggactagaaggtgctgggccgtcccagggtgtgaggggagaaggcagcggaacagtggaatctgtggcttcttcttttccaacacaaacttcccctgaccagccagaggtagcaaagtttgtcttgttttctttgtcacattcctcctggctgccgtcagaacttggccaagacagccaggctggaggaggcacagtctctcctggcctcctgccaggtctccagccgcccacgtggactggcggtgcagccacgtccctcctcctggctactctctcctgtccactcctgtccaccccatcctgccaccctgggctgcccagttcctctactgtcctgcccacctgtgggcccttgagctctaatccgccgtgcttttggttttttactgaaaccctgccttctgtgctagattttactctggtgctcaccattaatctttctctcagtgcaggtggtggagacctaaagctaatggggcttaggagggaagaaaagggcatcagctgagtgcccacacaggccagggtcaccttcagtgaagctgccagtttggtgacgtccacagtagtgcaggcagctctgctgtgttctacagcaacagattctggccctgcccctgcccgtgcccgtgcattggaccgggtgagaaagtgtgggtggcgtagacactctacacccgagaaaatcaagctcaaagcacatgccttccataggcaaaaggtggggctcccagccatgtatcatgaagcaggcaggtcactgtcccctctggtcccctccacccctccagcagccctgtgctgctgtgtttgctgtgccagccttggcccccagtgcacgctcctctgctgtgttttggaagttgcactgagaaagaagagaaattgttccttgccctgaggagctgccatccagctggggacacacagcgtaagacagcagcctagagtggagaagcgggtaggcacttggcttcagggaggtggcaggactttccccgggccttgaggaatgatgagagaagcacagagcaggcagccagacgtggggccttgtggtgcttcaggtgtatttagaaccagcggatggcgtgggttggtgtgggacatgcatgtggaggacagtggtgtgggagaagggacaggctgcttggatcaggattgtagatgacctacaacaccaggttaaaagaatttggattctataggaattgcagtaaatgtgagagggtgcagggaaccaaacggctttgaatgatcacaaagggggctgaagcatggcgtgctatagtcccagctacccaggaggtggaggtgggaggaatccgaggccagctggggcaagttgagggactccataaagaggaggcttggggcacgagatccaccatgtactgactgcctgctgcaggcggacacggtgcctgggtatttaacatgagttgtcttgttcaatcttcacaacagccctacagggtaagtgctttttccccctgtttcacagatgagaaaactaagttgaaattatttgtccaaaccagctgctaacaagcaaaaatgtttgaaaaagattcaaacccaggcctgttggacttccaggcccacatagatcctattactctgcagctgacaccatgctataaatgaatggcagaggttcatggacaggcttaagaggctccctaaaccctgtaaggatgtgtgcaaaattccttatgtatatgaatatttctagagagaagatttctgctgtcaaagctggccaggtatggtggctcacgcctgtaatcccagcactctgggaggccaaggcaggtggatcacttgagctcaggaatttgaaaccagcctggccaacatggcaaaaccatctctactaaaaatacaaaaattagccgggtgcgggggcaggcacctgtaatcccagctactcaggaggctgaggcaggagaatcatttgaaccggcgaggcggaggctgcagtgagccgatttcatgccactgcactccagcctgggtgacagagtgagactccgtctcaaaaaaaaaaagtgaagaattcttaagtgaaggttactggctcatgaggtccctcctccacagctttcctcctctgggggcctgagagtcaggacagaagttctagcacaagtgtttcacataggggtccttggtagaccagggcttaggcttggaagaaggaaaatggagtgagcacgaggaagagaaaaagcctggaaaagcagcttattttgtgctgaggagagaaggaaaggggccacccagagctgctctggggctccagggcctgtgggctcctcccctcctttgttcctctctgcttggctccagcgagaggccgtttcctctcctctctctttctccatgacacccacgcttccctgtggactcacctctgcagccacaacaacaccctcctctccttggcgtggaagccagcgctcctggcccactcccagtaggggatgtcctctgagttgtttttcctgtgcggggaggggtggactgagtcatccacactcttcacctggttcctctggtgaccaagaacatagaaggagagggcacatccccaatcaggtgttccgaacatctctgcgaagactgaccctcctcagcccaggtgctcctatgggactggctacacttcttgactcagttttaatctctccttctctgccttcctgttgggaataccccctcacttctgtggcttctttcctgtagtagacgatcaagggtggaatctacagtccgtgagccctgacttcttgccttcgtctcaaatagactctgcagccagccatctatgcagcgccccagtggctttgaaatgcaacagaaaccatcacccccggaccgtgggctccatgccagtgggcaaagcacaggtgcgttcactgagttcccagcacatagctgtggcaggcacttggtgatattttgaaataaaagaatggaagaatgtgtccaggctgtgcttcccctttctaccttactcagggacatggtgccctcctctctggtttcctgccctgtgcccaccccccaccccctgcaagcacagctcttatgtgcaaagcccctgtaggtgctggagggattcactgatggccttggcggaggtggcagtgggcatgtgcacttggctctgacacagccactcatgcaacaccctgtgcaatctcggcctgggcctgtgtgtcctgccctcattcctcacgggtgactgtctcccctgagccactcttctctctattggattagctccttttatttccccctagggatgcaacacatttttatgaacaaacagcagtgttcacatggctgtgatgaggacgtactggggtttcccctggacatggcattcatctgatgccagtggtgggcaggaccgtgctgtatactttaaaaaaaccctagggggttctgttaggtgcccccactgcagcataacgagttgcccctagctgagaagccctgtcctggggcctgtccacaccatcctcttcctgagattattcctggtgtgggcggtgctcggctctacctttccttccttcttccctgcttggctcctggtccaatggctctctcctctatggaatggcctcctggagcttggctgggtcagcccccactttccactcttcccatgcctgtcctcaccctcccagcagccctgccagcctccgacgggcccagggcactgcagccggcacttgggagtgaagactggggccagagccaggctcacctttggccactgaatcctgaaagaggaggaatttggcaagtggggttctgcccaccaagctttcttccccccgctcccctgagtcttttcccttcacccccacttcccaaaagcagcagggagtcagctgtagggcagtcgctccctggccgaagccttcctggctgtttccgtcacaccctgaggccacccctcttatcttgcgaggagggaggcacacagaggctgtgattagctgtcacagtagcaagactgttcccctctctgtcctgcggagtgagtgtgagggaaaagagctctccttgtctgctcattatgtgcacctgttaaatagtcattctttccactagggctattagtggtttttattgttactggtcacccagaattagagtcacagcttcctcgacagggtgaaagagagcgccagggtgcagtctgaacgtgctctcgggagaggagaggccggaaagacttgtaccaggagggacttctaggctgggctggcccttggagcgcctaggaatgggactgtggtggcccatcttccctcctgtgttctgggctgtctgagtgcctctgggtgagagtcctcacaggagggagcttctcctactgcccagtgtctccctggcacctgaggcatcacccagcacacagaggtgaccaggaaacacagactcctgttagagaggcatctcgtgtcccgctctgttctcttgggccctgggactagaacatcttcaccagagaccggcgccgactccttggcagtgtgtaacattcagctcggtgccgaggtctgcccatgcaggactgatctccattctctcaatgaccctaggagacaggaattattattattattattattattattattttgagatggagtttcgctcgtagcccagcctggccaacatgatgaaaccccatctctactaaaaatacaaaaattagccgggtgtggtggtgaacacttgtaatcccagctacccgggaggctgagacaggagaatcacttgaacccgggaggtagaggttgcagtgagctgagatcgcaccactgcactccagcctgggcgacaagagcgaaactctgtctcaaaaaaacacacatacacacacacgtttgggaccatccctatttcctcgctctgcctaagctgcgtcacaccattcatcactaggtgacatcctactacagataccttgtaagcatctgtgtatctctctcctccctcactggaaggcagctccctgagggcagggccctgatccctttgactggctgtggtatcctctcctgtagaccgctggctcatgaaataatcagggagagaatgtgtaaatgatgatcgtgaggtccacttggacaggcagcctgtgcctgaattttcctgagggcttcagagcctgtctcgcctcgcctcacatgcctggctcaccttagaacggtcaccttgacggctaaagggacacctgtgtgccttgatggtggacccagggagtggatgacattagtgagggaaagagcaaaggctctggaggaaaacacctgagaggagtctctaggctgccctctggtggcagttcttggaacaagacctgagagccgctaccttggctctcagcattgcacgggagtttagaggttattaaagaaatccccctaaagtcccatcccaaggtcacatagagaacgaatggctaagtagcgacaagaacccaagtcacagtctgttgatctcactaccatgctatcctgcctgcccccatcacaggagttgagattatactgcaaaaggaaaggtggggatggggtggggactggggaatttggggagggaattgattactgcctctgaggatattagggggaaaaacccacaggaggtgcatttggcttaattcagcaagttttttgagttttgattcagtgccaggcacctggtgggcacttaattaaagattagcaggagaagaaaaatgtacagtaagagagcttaagtttataccaaagcgagtcttgggtctaataattttgaaacatgaaattggcagagaagttaggagtccctcctgggctcctacgtcagggtttgccccctctctaatttaactttttatcaaattttattgtcatgatgtatatgtttgtcctccctaaacacagagccccttgagggcagggaggactgaaactgcttcctgggactgtcaccatcacatagcaccccacagagcagatgctcaatgaatgttgattgtgtgggcaaatggatgaacaaatgaatggtttggagtttccctggccagagagcttcaaagcagggcagacaaccatctcttctgtctagtccaaagacatcattcgctgcccaaggctcagggctgtgcctggtgctttctcaaggtaacttagcttgtataattagattttaccgtgatactagttctaggttctttttttttcattggccaagcatttaataactatctgtcatgtccaaggttctgggctattgttctgtaaatctgtgatcctattctgttatttaattccgtgactctgtgttgacatagacgtgacggtgtccctggggcatttactcctaggtgagcttagccaaggcaggtagagaggaaccagcattgtctaatctgaatggataagccagcacaatgggtttccctctgcaaatacctccataccatccaggcccactcagtctcctccccagctaatgaagacagcctgtttgagtgccaaaatccactgcctattaataggtactaaaatctccaattgcctcatgcctcccccttctctttcccactcacctacctgccatgtcagcctgggaagaattggtttgcagccaggcagtcctccatccagtcttgactttggcacttgtgatatgacttgcacaggtgagttacctctctcagtgttggttcctcttctgtgaaatggggctaatcatttgctttattgagtgccttctaggctgggtactaggagagaaggaagggatacaaagaaagacaaggcacagttgctgtcttcaagaagctcatactttccaaggaaataaaggcatggaaacccacatagtgctgtggaattaaagaaggcagcatgctgtaaagagccccagctttttccctagacaacatcaggggctcagttcctttccctcctttctctcttctttaagaatttctcttagctggacatggtggcacatgcctgtggtcccagctactcaggacgctgtggtaggaggatcccttgagcccaggaggtcaaggctgcagtgagctgtaactgcacctctgcactgtccagcctgggcgacagagcaagaacctgtctcaaaaaataaaaaattaattaattaattaattttttttcctcctaactaattccacgttattggcttgagggtcagtttgaggggtccagacctccttcttcctttctatccttagcttcctgccacagtatacccagagatgtatgtgtttctccccaccctaggcacaattttttttttttttctgagacagctctgtcatccaagctggagtgcagtggtgcaatcatatctcactccagcttcaacctctcatgctcaggtgatcttcctgctgagtagctgggactacaggcatgcactaccatggcctggctaattgtttgttttttttttttgagatggagtctcactc

SEQ ID NO: 419 - DNA, 52103 bp, Homo sapiens
aacgttaaaaactgattcaattattgagaaaagcaatgatgttccagtagaaaagtacaagcataaataattcacacagttaaagcacaatagtcaacaagtaaatggaaagtgttcaaattaatttaagtaattttgaaaagaacagtagaatgtttaattataaaattagtaagattaaatatttaagcctatacagttatggtaaaatcagtttacatatacatagtttgagtcagcataaacagatacgtatggatttataaacaaaatgctgaggtttagccagaaccctaaaaatgcactaatattttgtcatttcctttttactacttaaaatttatgtaataaatttttaaaatatcatgtacaattaattttcctgcaactccattacaacaagaaaaactgagagaagtttcactatccaaaaagataataaattatattatagaagttataagtaagcatacattaaaataatcaaaataatattaatgatttcaaatataatatgaaatgtaaaatcttctatacagttcttaaatgatttttaaaactatccacaaatattcaagaaaatagaaaactattgaaagtgattgagagacaaagaaaggagaaagcgtaaagctggactgttttggaaacaaaaagttatcctgattgagttgaaaaaaggctgaagaaggtaatgaaggtgttttccattagcaaccatttgtaaattagtttcagggcacaaaacgtgatataaaacatctgagagcatttttagttaacttgcacagttctgctataagacatatttctaaaatggtttggtcctgagtgtcggtaggaagaatatgttctgtaagtaaagatgggatgtatggcagggactttatggagtacagctggagaaccctggagctctcagcaagggagaaggctatgtattaagtaaactcttgcatgatcatcttacgtgatccctggaggaaaatagtgggagtaggacatcacaacctgttctcatttctttgctcagttaggagattaaaagtcaaataattatccattaaaacttatcacctgcgatggctcaagtctgtacttgaggtggctcaagtacaagtacaagtctgtactgcggtggctcaagtcaaacccagcacttggggaggctgaggcaggcagatcatgaggtcaggagatcaagaccatcctggccaacatggtgaagccgtgtctctactaaaaatacaaaaattagctgggcatggtggtgcgtgcctgtagtcccagctactcaggaggctgaggcaggagaatcacttgaaccttggaggcagaggctgcagtgagccaaaatcacaccactactgcacttcagcttgggcaacagaacaagactctgcctcaaaaaaaacaaaaaacaaaaaacaaaacaaaaaaaaccttattaactgatgaaacacaatgggcaccaaaaacagagaacacaaaacaaacaaaaaagatgaaaataaaatgtgttgtagttagtaacattatatagaattttagaaataatttaatgtttgtacttaatatgtgcataaattaattaattaaaagtttctgaaggttttttcttttagacagggcctcattctgttgcccaggctggagtgcagcggcacggtcttggttcactgcagcctccacctcccgggtccaagagattctcgtgcctcagcatcctaagtagatgggattacaggagtgcgctaccagtcccggctaatttttttatatttttagtagagacagggactcgccatgttaaccaagctggtctcagactcctggcctcaagtattctgcccacttcggcctcccaaagtattgagattacaggtgtgagccactgcaactggcctaattaaaagtttaataggatttagcttcaggtctttgaagattggtttttctctttacttaagtaaatatttcagatttggtctttttattaggaaacttgttgaaaaaaattttcatcctatcaaatgatatcttaaaactgtgataaacattaattgtggagtaatgtacataaactatgtgttgacatacaaattatttatagttctttaccatatattacatttttatttatatattaatatttatttatatgttgcttatatgatgtgttatatccacacagatctatttttctagagacaatgccaattctaaattattttcatattttgccatcacaatatatacaaatgtatacacatgtacatacctattttctattcatcataatccagttgtaattatatctcggattttttatttggggtgagcttttgcttccttgttttatgattctttgttcattctaaattttcttcactgaaagtacattatgtttacagtcagaaaaatgatagtataaaaaacttacccaggcagtatcttagctgaactagcaggggcagacacggctcggctttctgctaaaagatttcatgacaggcaaagaaaagaaaggagaacggaattgaatagagatttaaaatctgtactcttatcccaacctacgtaaatcttaggcatgagaggactgcagtataaagctactcagatcctctaccttgatttttgtgttgttctgtattgttatcttcttggagacacttcaaaagagtttacacttgatttgactccaaaaatgttatagtgtcttctttaacaatgatgttattaaatacttttgcattctgggttacatatagttctctgtttcttaatcactaacgacaagtggtaatgagttaaatgaataaaatgcatcaatgacatcattgaaatataagctgtatattctttaattcaggatatttatttgtttttttctcccaagagaaatttgtagatatgcagaaataaaacaaggacaattatatgaccaagataaatataaaccaactttaccagttcacaagaaaaaaaaactgttctattactcctgtgaatatagctttgtatctccttcaaatcccctatagactcacgtaacatgcacagagaaagaatgggtatcaacagtgaagtgtcttagtaagtaaatgccctgatcattatctgcataaatcattcggtgagtagagagggatgcctcaaaagggatctgtgtcttgacaggggcaaggtctaaaagagcctgaagagatgacagatgtagcccttatattatttgggagcattttatgaaaatcaagtgagaaggaaagacgtaaagctttggggactatctattccccaaatataatatttctattcatagaaatatttgaattatttctaaaatggacaaaagccttgatacttgatacctattttctaatatgtatttttgtcaatatgaaaataagtatttcctaggaaaatcaaggaagaattaagtagagagcaataccatgttcttgggctagaatactcaacaggataaataaataaatttttctcaaattgtactataggcttaacataattacttattaaaatttcaagagaattctttgtaaatatagatcatttcatactaaatttatattaaaatgcacaggagttagaatggctgaaacatttttttaaaataataaagttgaaaggatcacacaaatcaaatttgaggcctcaaaatatagctaccatattaaaaacagtatagtattgatggagggatagacataaatcaatagaacagatacagaatccagaaaaggtcatataattgtccttgttttatttctgcatatccacaaatttctcttgggagaaaaaacaaataaatataatatttctattcatagaaatatttgtattatttctaaaatggacaaaagccttgatagttgatacctattttctaatatgtatttttgtcaatatgaaaagaagtattccctaggaaaatcaaggaagaattaaatagagagcaataccatgttcttgggctagaatactcaacaggataaataaataaatttttctcaaattgtactataggcttaacataattacttattaaaatttcaacagaattctttgtaaatatagatcattccatactaaatttatattaaaatgcacaggagttagaatggctgaaacatttttttaaaataataaagttgaaaggatcacaaaaatcaaatttgaggcctcaaaatatagctaccatattagaaacaatatagtattgatggagggatagacataaatcaatagaacagatacagaatccagaaatagacccacacaaatatgctcaagtaacttttaacaaagatgcacaaataattcaatacagaaaagatcctttttttttttttagttcagggctacctgtgcaggtttgttacataggtaaacttgtttcatgggagttagttttacagagtattctgtcacccaggtattcagcctggtagccattagttatttttcctattcctttccctcttcccacccttcaccgtccattaggccccagtgtgtgttgttcccctctatgtgttcatgttttctcatgattgagctcatacttagaagtgagaatgtgtggcatgtggttgagaaaagtttcttttcaacaaattgtgttggggactagcactttcttagccaaaaaattaattttgatttaatctcacatattttacaaaacctaactccaaatggttcctatatctaaatgcataatgtaaaacaatcaaacttgtagaggaagagaaaatctttgtgatctggggtttgatggaattgttcttaaacaggacacctaaaggatgacccataaaagagtgaaataataataatactttatcaacattaaacactttttatccatgaaagacattctatgagagtgaaaagataagctacttattagcaaaaaatatttgcaaataacgtatctgacagaggacttatacatggaatatataaagaatgctctaaacacaggtaaaacaatccaatcaataaaggtgccaaagccttgaacagatctaacaaaaaagatattcagatggaaaataaacatgtgaaaagttattcaatgtcattaaccattagggaatacacattaaaaccacaatgagatttactatgtatctaataaaatgctttaaaaaaattaaatgaaacacattggtaatagtaagtgcaagtgaaaatgcaatacaatggatctctcatacattgcttgtggaaatgtaaaatgtcatagccactatggaaaacagacaatttcttatagagttcaatagcacttttcataaaacccagtaatctcacccctgactgtttaccatagggcaggagatggcaaactatatcttaggaactagctatctattttcttaataaagatgtattggatgtgagccacacctttttatttatgtattgtctatcattattttggctctataactacaaagttaggtagttgtggcagaggccatatggttcacaaccttaaaatactaaacatatgacccttcgagaacaagtttgctgttcaagtaaaacattgcacaaaattgtccatcatagctttatgtgtaatagccaaaaagtagaagcaactcaaatgtcctcagatgagcgaaagaataaacaaacatgttacatccatacaatggagtacttcacagcaattaaaagaaatgaattacttataatacaacagcttggctacatttcaaggacattaccctgtgtgaaaaatatccaaatcaaaaagttgacttactgtataatccaatttatataacactcaaaatgactaaattacagttatgtagaacatactagtgatgactagcaatgaggggtgggggaatgtggggaccataaaaggacagcacacgggagttttctggaggtgatagaatagttctgtatacgactgagtagttctacatatgactgattgtggtgatggttacatgagtgcatacatgttgcaaaattaatataccacacaaacacaaacgcaagttcatgggagagaccatgaaattcagtaaggttggtagctgagttagtagtagagcactaatgtcaatttcctggtctcaattattgtactatagatataagagatgcaggaagttatagttattggaggaaactgggtaaagggtacatgggcattctctgtactatttttatgacttattatatgaatctaagattatttcaaaacaaaaattatttggattatataggctgggatgttttacttttatagcacttttggggaagagaattttcaatattcaagagttataaccaatttcagcaatttttctttgagatacttaaatctatctcaaattttatcagtaataacttctacaagccagtttcatatgtatttgaatgctataatttgccttttaaccctttcatattttttgtaacaacaaacagtttcagacttaatttactttccctgcactaaacctggaatccacaaaaaaaagaggtcccagtttcctagatttataatgctgtgtaagaaacttattggcataaaacagcaatcattttattatacttaaagatactgttaggaattgacgcagggcactgaggtgatgacttataactgttccacaatatttgagcctcaggtgaaaagatttaaatgggttaggactcaaataactgagatttggaatctgcaaatgtcactcacctgtatgacacctgggctattgcctgggccaactgggactatcaaccagaagatttacatatggcttctgcatacagattgaacttcttgccaaatggcaaaaggcttccaagatagtgtcagagagatagtcttccaaaatataaacccataactctctaatatctagcagagtcactaccactgtattgtatcaacaaaagcatgccactaaaaagtacagattttcaaaatgagggaaatgtgattccaaatcttgataggatcatggcaaaatcacatggcagaagaacaagtgagatgagacacagtggagtgagcatctttcaaaataaaattggccacaaaattgaagacaaagttattttctaaactgcccttttatttcttatcaagtatagtttccttctccttttatttgttgctaatgtttgcaggagggcataatctcctgaaattactcagaacaagaaacaaacaaaaaagggcaatctaagtttctgaattaggagaaatattcagcaaataaaaaggagaataattgttgagtactgggcttcaaaaaaaatagacaagagaagatagtgttaattcaactaaaaatcggcactagctctgtgaaaattaactctgtgcttacaaataaataacatcccctggattcagacaaaccaatgtttaaaggtcacagagattagaagaagccaacaaaagactgagatggtgaagcctttgagacagaagagaaaccaggagaatgtggtgttccatagaccatgtgaagcaggtatttccaaatggaaggggaaagtcatgaaatttttctgagtattcagttttgaccaatggatttgattagattgaagaaggcattggtgactgttacaagaggggtttaagcgtagtgttgggaatgaaaaaatgaattaaagtagagattgtagataacattggagtcatcgtattataaaatgagaagtgaattagattactagaaagagatttgggttctatgaacaatttttgagcttttgttgttgctcttcatgatgaaagatgtttggtatgtttgcatattggtggaaataatttggaaaatggagaaattaatgatacaggtgagaaggaataattgaaagagcaaaatccttgcacagaaaagatgggatcaaatctggtagagaccataacaagataggagtaaagatcaacatccagtgaagcaagagacaatgcagaaaaggatgcgtgtgaacagcaggtagttttcttctgattgattctatatctagatgaaaaaataaatgaagtcattagcaaagcacaaagtgaggattggtggttaaggagggagataatgaaaacaggagaggggaaaagcagtgtggaaattatttaggaccgtgttcattaatttaaagcaaggcaagtcagcacagttgcctttgtttttcttgtagacacactctgctgcttcaattcaggcacagggcaggtagagaatttatttgcaaaggattgaggttttctaagacttggattacagatagaaaggaacgaatgggcaggagagtgtgtgcaagggactgactgacagtgatgagccatggaatctaatttagatgtggtgggaagagagaaaatgaagggaagagaatagtgaaaaagtgtcagggtcattgaatgtttggaacaaatttagtagagtaagtgagctaaaaagattgttgaaatggtctagagtgtgatgcttaatatttagatactttaggtagtgtagtaattggaaatgacaaggtttagatagactagaatcaatagtggagactactaatagctcacagggacttctctggtttcttgattggacatagctatgtgcattcccattgacttctgaaccaccataagtaagtttcctcttagtgagatcattaggctgtttctgtaaatttccccattaaatgttaaatttctctcaggctgggcactttgttgcttgcttcagctagtatcctctagtcttctctgattgtttcccactgtaatctctttgtattcaataggatcctcgggcatggacctttccaagctataaagtcactcttctccagcaggggagcagagcttccagtccacatagcctgcctgcccatccagggttcaacttctgagccacggaattgggctgcgagacagaggtggatgaaagcatccgctctcttttactgaattttatggagactttctggaaaaaatatttcccaacattatgctgtttggccaatttccagagacaaccaatggttacttttaaatttttatccagttttattgctgccttttggttgggagtgaatataccaagaccctcacatagccattctcgaagtcccacctgaacaaaatgattttgaattataattctgttcttcaaacatttcaggaaacgttacttggcaaaaattattctttttttttttttttttttttttgagacagagtctcgctctgtcgcccaggctggagtgcagtggcgcgatctccactcacggcaagctctgcctcccggttttacgccattctcctgcctcagcctcccgagtagctgggactacaggcgcccgccaccacgcctggctaaattttttttgtatttttcagtagagacgggtttcaccgtgttagccaggatggtctcgatctcctgaccttgtgatccacccgcctcggcctcccaaagtgctgggattacaggcttgagccattgcgcccggccagcaaaaataattcttgattagaccttttatagtttatgaaatattaaaactgttaagaaggtacctaattcttagtgccagttttaaaagggaatttacaactacaaaagtgatattgttgtattaagatgaggactgatgacttgcacttgcttgccttttgaaacagctgaacccttggctagaaaaaaaaaaaaaacccagggggccggcggtggggagcttcctctctcctctaaacagtccatttctgattgttccaaactcagagactcggtgactacaacaaggaaattgaacagcagttattttgcttaaataaatattacataacgagctgagaatattattgtgaagacactgattagatactatttgcttatttcacacaaccctccatgaactttgatgttttccacaaagggctttactaaactagcttccccttagtacattgaaattcaaagtcatgcttgtaactgttaatgaaagcagatttaaagcaacaccaccatcactggagtatttttagttatatacgattgagactaccaagcatgttgctcttattcagtgtaatcctaatctcatgggtatccactgttgggggagaaggtaagttgaaaacagatccgaatattttagttccttttcaaatgtatttattgattgtgtgtgtgtatgcatacaaatatttttaaatgaataaatagctgaggataatttgaaggggtatcacaatattcatctattttctggaaatattttccaacatgcaattagcaggaaaattgaatgaaattaattctctccgttctctagtttgctaagggtaaatggtcaccaaatagataatgtaaagagaaatcaaaggagagaaaatctgctataataaagatgacaaggtgaaatattagtgtaattctgcataaactctgcaatgccactgactagaaaaatcaaccccaaaagatttggccaccttcattatgttttgagaattttattttcatagatttgataatttacattttaaatgttattaaaatgaaggaattctcatttcagcctaattatcattcaacagggaaatatattttaatgaaacaatagaaaatattatttttatatataaaccagtgaactgccaaaaaattgtttcttctgagctcttccacaaatttcaaaagtgaaataatatatcacttctttattaatactataaactgattcttataacattataaactatcccattttatttcatgtggaaattaaagccactatatcaaaaggattgcaaacaaaatctctaacaaggtctaggatactgattaaactatgtgtgtacgtgaagtttcaatcattgtgctatatactctttgatttccagaaagtttttattttactgctttactgctttctaatgtttacagatctttaaattttttgaacactttcttctcagtcctgacataagagaaaaatatgaaccataaaatgctttctttttaagatatgcccttacaaatgttgcaaaacattatttctatgggcctaaaattcattttattttgttttcacttttagtactgagctataatcacaagagtgcgattgcatgagtgtatttgatttttcttaagtctgtgtttatgatatttattaagtggcttaaacatctgttacaaatggcattacacaaggatttctaaaggggggtggaagcagaggaagataagtgaaaattatgaggataatatgtagaattttgacaattcctaaccccacaaaactttcaagcttcagtccagtcccaggataaactttagtgaaattctattaaaagttgtctaggtgttaaatgacctgtaagtgtgcattacacttttgttttggtgtctatttagaaactggccaaacagcagaaataacagacgaaagcaacacttttgtacaaatagaaaactgcatgcttccagtagcaaaacatgaatcaagcaatatattgtgcttcatgctgtagcaaagaagctggaaagaatatgacaacgccacccacccctcactactacttagagtgtcctaaaagaaaagcaaaatgtaaataggcaaataaattgcaaggttttatatataggtaattgtctgtgtgtgtgtgtgtgtgtgtgtgtgtgtgtacactcatacatcacttaatgataggaaaacgttctgagaagtgtgtctataggcaatttcgtcctcctgcaaacatcatagagtgtacttacacaaacctagattgtatagcctactacctaactaagctatacggcctgtcactcctagactgcaaacctgtacagcatgttactgtactgaatactgtgggcaactgtagcacaaatgtaagaatgtgtttacctaaacatataaaaggtacaataaaaatacaatataaaatattaagaatggcagacttgtatagggctcttaccgtcaatagggtttgcaggactgaaagttgttctgggtaagtcactgagtgagtggtgtgcaaatatgaaggcttagcacattaccatacactactgtaaacttcatgaacactgaatacttgagctaggtaaatttattttatttatatatttatttcaatattttggggggagcaggtggtttttggttacatggataagttctttagtgctaattactgagcttctggtgcacccaggatagactaaatttatttttaaaacttttcttcaataataaattaatttatgataagctttctactttatcaactgaaaatcttttaacttgtaactcttttgttttagcttaaaacacaccttgtatagatgtacaaaatattttttctttctatccttattctgtaagatttttatcttttaaattatttatttatttaccttctacacctttttgttaaaagcagacacaaacacacacattaacctcggcctacggagggtcaggatcatcagtatcactgtcttcctcctcactcttgttccactagaaggtctttagggcagtaacatgcatggagctgtcctctcctatgataacaaagccttcttctggaatagttcctgaaggacccgcctgaggatgttttacagttatttttttttaataagtagaagaagtgaactataaaataatgataacaactatagtacattaaatacattaaccagtaccatggtcatttattatcattatcaagtattgtgtactatacataattgtgtgtgctattgtttatatgactggcaatgctgtaagtttgtttataccagcactgccacaaacatgtgagtaatacattggattatgatgttgtggtggtcatcagttgataggaatttttcagctacattataatcttatgggaccactgtgatataagtgatcagtcattgaccaaaacgtcattatgtggtaaatgactgtatgtctgtatatatacgtgtgtgtgtgtgtgtgtgtgtgtgtgtgtgtgtgtgtatcccagaagaaatatattcacagtattctatcagaatgtcgagacaaggaaaattattttctgcttttggagtgggttgttgtgtaacggcaggcttgccaaaggacgataacactcctagcaccattgcggatgtgcacaatggttatacgatgaatgttgtagagcaagttctaaaggataggtagaatacaactggatggtgagaactaagttattctggatagcgaagaatatgtaagtacatatgcatgaaaatcaagtactataattttgcaattttcaaaaagtaaatgatatttaaaaggagttatgataggttaatactatcaagacacgagggagtctttccctcagtatcttctccaaaactatctaatgtcaatttttaaacagttaggtaataaatttaaggtttcacaaggttaaataccacaagaattatttcaaatattgtgcaacattaaatattacttctaggtagttaaaaaagagaaatttcccttgatttgtcagctgaatttctgcatgctttttctaaataaggtgaaaaacaaaacaatttcttatgcagcaatgctatattcaggaaatatcttgagctaaaaaatgagcacactatattgaggaaatatctcgagctaaaacagcattcaaagataaagtacatcaaatccatagaatgtacaatatcaagagtaaaccctaatgtaaactatgggctttaatgacaataatactgatagtgaagggggctattcatgtggcagggaagaggaagtggtatataggaaatctctgtaccttccactcaattttacagtaaaaaaactgtaaataaaaaattaagtctaataaaaaatatgtgtatatataaatatatatatacacaagaaaaaatagagtcaaaacatgaatatttcacccattttctacattgttttaccatatcttgcaccatagtgcatatggatgtatgtgtgagtgtctatataaatatatccagtagtatcctcagtatcattagtatccttaaggaattgttccaggactcttttcacccccagcagataccaaaatccacagatgctcaagtctctaagagagaatggcgtagtatttgcatataacatatgcacatcctctcatataatttaaatcatctctagattatttataatatctaacataatgtaaatactatataaataattgttatattgtatttttaattgcattgtttttattgttttattatctttttattgttttttctttttcagatattttggacttgcagtataataaacatttatgtatacagcatttaccagaatttagctctaattttatctcggttgagttgttcttagtgattttcttatactctttaaattatttccactgaaaccacataaactttgtaaccagaaagtaatcagaatattaataaacaaaaaatcaaattacctacccaacatttttactgcaccagaaaaaaaaataggacagatttttctggtggaaatacctatgacagttgatgagaatagaaaaagaaataaatctgagagctgagaacaatcctatcactcctctactgtacactacatagaccagggagatttgctactcttacagtctgccttcattcttaaattgttgtgtgaggatattgttcttgaagacattgcagaagagttcatatttcatatcattccaaaatataaattttatattcattaacaatgacctcgtcggtccggcatggtggttcatgcctgtaatcccggcagtttgggaggccgaggcgcatggatcacctgaggtcaggagtttgacaccagtctggccaatatggtgaaaccttgtctctaccaaaaatacaaaaaattagtcaggtgtggtggcaggcacctgtaatctcaggtactcaggaggctgaggcaggagaatcacttgaacccagtggaggctgcagtgagccaagatttgcgtgattgtacttcagcctgggcaacaagagtaaaacctgaaactccctctcaaaaaaaaaaagatctcctcaaatactcttctattcttatttagggatctttcttcattccaaattagtacactggaaagcatttaagctaaaggcatttaagctgaatgaaaaacaaaactataaatgagatgactaaaatataatctagtgattcatcgatgtagctctttatttaattcttcagttttgtgttatttttcccaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagtgagtaaatgccctgttcattaaatggatgtcattcagtgaatagagaaggatgtgccggacaagatcataaggtcttgataatcacaagggcaatgaccagaggagctggaaaaatgggagatgtagtcctcctattttgagacccctcctatgagaatcaatgaagaataaatatatcaactgtcttgcattacctggaaatgccctacatgttgaaatacattaatttttttaaactgatgattaatatatttgactgctaatagttctttactaatattcattcggtagcagcctgatcatagttttcctttaaaataagtcattttatatagatattctgttttgaatttaccgttctcttgcatattgcgaggtaaggtttggtattttaacttttatattttcaataaatcatttatttggtccttcaaagtgtagctatattaatcctccaataaatgtagagaccagactccaatgataacaggtgcattaaaaaagaaaaacaatgggagagagaatagatgaggcaacaaaggagatagtaatggtctttctccttttgtaagaaacatttatgagaattgcgagaaatatttatatgaagatattgttttggtgctagaagagtttataaacacaagatttttattataaaaaccatacagcaacaacatgaaatattaactttcgtatatatatatataggaacaaaaaatatatttcatcatttatacggtagcatgacccaaattcttttgaaaatatttacacatgatgtcagttttcaaagttttcctttcttaatgaaatatttttaaatgcactttttttgctacttccatcttgtacattaatcaatttttgttccttaggaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactagtaagcaaaataccactctctcagttttgctaattatttaaagaaataaatctatagtttatagattaaatataggttaaatataggtttcaccactacttctatcattatttatttgattttcggttccaattgtgtctaagtagatgtgcaataacatagtttgcctacctatataaatcaaatgtacgtaataagaagaaatattagagaagaatacactttgaagataatccattaatgtaacaactgtttgttgtttatattgtcaggttagttgacaataaatggttacaaaactgaggtattaaagtgcaaattagtccaattacagttaaaatgtcttataaggaagtttttaatatttatctttatttaaattaatatgcttgagtcaataaatcattttctaagttgtaaaaagtccatacttctgagaggtatgtgtatttgtgagcggcttagaatttggaaaacgattcttttggaagcctgtggtataaatgatggcacctcacagtcctgtgtgaactcttgtaattcttcatctttatagctcttcagtaattgttctttgcccagcccaatgcgattccatcctatgcttacacacctcagtattcaaccaaacactcaaggaaacttccatagtctttctcttcataccactttctctctgctactatgtccagtaacttctggccaccatagtcaccaagactgaccttactagtctcaactaaagaagaccactgagttcttcctgggttctccctccttgcacagtctagaaaaggcttcccaataaacagctgggctttcattgactttgctttattattttgaagtattgagggttttttccttttttcagtcatcacagttctgtactgggtgatttccagcattctgaaaataaattttgtaaaattttctaaattttttttcagtgggatgctatgttgatagcagctactccatcctatcaagaaatagaatctgtggtaggtttttcaaaagatgttatgttatcaaatattattccacatcttcaactcttaatttaaacctctagagccaggcacagtgatgtgcacctgtagtccccgccactggcaaggctgaaataggagttcaaagcttcagtgagttatgactgcaccagtgcactccaacccaggcaacaaagtgagacccttccccactagaaaaacaaaacaaagtaaagcaaaatgaaatttaaacctctagaaatggagtctttttaaaacagctggaactgcgatagtttttcagtaaacagttacgtcatggtctctttcaattacaaggggttaaaacattattaacatttgcaaaaaaaaaaaataacaaatgttactaacactagaaaattccagtgattgaaaagggttcaaaatgtataggcttcagttatggtataaatatttccatgctttctcttatccatacctgttcatgtcatgaacaagctctcttcattttgagagatgatggctattgtcagaccaacaattatattttagaagcttgacaaattaagtttggccagcgtaacccatacaagctggctctgtgtacagtctgtaagattttgttagtctttgaacaattcggttgctttgtgacacaaaaaatatcccaggcttaactcatgtttccactgccccagaactagaatcagccatacctccaataagtcctggttccatttagtgggcaatgacatttagaaactaagttgtcaaaataaacttgtttcaaaatttagcacattttatttaatcagaaaaagcacatatcttattgttcaagttctcagaatattgctgcctttccctttctgcccgttgcttattccaaaagcacaagacaacatattgaggttatcagagtagatggacagatggaccaagtcagagtctccaaagtgaaagaattcagcagaacactctgtgcctaaggttgaatggtagctcacgaacactgtggaaagttaataaagtttcagggcaactagactcctaatgatagcggcacagtctgtttattcatgtaaggtaacatcttgcaagttatggtaatccatgttgcagggattagtatggcgtcatctctgggggccgttattccatttacaacaccatgcaataaccatatatgaataaagcagctggaaaaccctacattggccaagatcgattattttctttttatatatatatatatactttaagttctagggtacatgcgcacaacatgcaggtttgttacataggtatacatgtgtcatattggtttgctgcacccattaactcgtgatttacattatgtattttgcctaatgctacccctcccctacctcccaccctacaacaggccccagtgtgtgatgttccccaccctgtgtccaagtgttcccattgttcaattcccacctgtgagtgagaacatgcagtgtttggttttctgtccttgtgatagttttctcagaatgatggtttccaggttcatccatgaccctgcaaaggacaagaactcatccttttttatggctgcatagtattccatggtgtatgtgtgccgcattttcttaatccagtctatcacttacggacatttgggctagttccaggtctttgctattgtgaatactgccacaataaacctatgtgtgcatgtatctttatagcagcatgatttataatcttatgggtatatacccagtaatgagatcactgggtcaaatggtatttctggttctagatccttgaggaattgccacactgtctaccacaatggttgaactagtttacactcccaacaacagtgtaaaagagttcctatttctccacatcctctctagaatctgttgttccctgactttttaatgatcgccattctaactggtgtgagatggtatctcattgtggttttgatttgcatttctctgatgaccagtgatgatcagcattttttcatgtgtctgttggctgaataaatgtcttcttttaagaagtgtctgttcatatcctttgcccactttttgatggggttttttcttgtagatttgtttaagttctttgtagattctggctatcagccctttatcagatgggtagattgcaaagattttctcccattctgtacgttgcctgttcactctgatggtagtttcttttgctgtgcagaagctctttagtttaattagattccatttgtctattttggcttttgttgccattgctttttgtgttttagtcatgaagtacttgcccatgcctttgtcctgaatgctaaggcctaggttttcttctagggtttttatggtttttaggtctaacatttaagtctttaatccatcttgaattaatttttgtataaggtgtaagtaagggatccagtttcagctttctacatatggccaggcagttttcccagcaccatttattaaatagggaatcctttccccatttcttgtttttctcaggtttgtcaaagatcaaatggttgtagatgtgtggtgttatttctgaggcctctgttctgttccattggtctatatctctgttttggtaccagtaccatgctgttttggttacttgtagtatagccttgtagtatagtttgaagttaggtagcctgatgcctccagctttgttctttttgcttaggattgtcttggcaatgcagccccttttttgattccatatgaactttaaagtagttttgtcctattctgtgaagaaagttagtggtaacttgatgcggatggcattgactctataaattaccttgggcagtatggccattttcacgatattgattcttcctctccatgagcatggaaagttcttccatttgtttgtgtcctcttttatttcgctgagcagtggtttgtagttctccttgaagagattcttcacatcccttgtaaataggattcctaggtattttattctctttgaagtaattgagaaggggagttcactcatgatttggctctctgtctgtctgttattggtgtataggaatgcttgtgatttttgcacattgattttgtatcctgagactttgctgaagttgcttatcagcttaaggagattttgggctgagacgatggggttttctaaatatacaatcatgtcatctgcaaacagcaacaatttgacttcctcttttcctaattgaatacccttgatttctttctcctgcctgattgccctggccagaacttccaacactatgttgaataggagtggtaagagagggcatccctgtcttgtgctgattttcaaagggaatgcttccagtttttgcccattcagtatgatattggctgtgggtttgtcatgagtagctcttattattttgccatatgttccatcaatacctagtttactgagagtttttagcatgaagcgctgttgaattttgtcaaaggccttttctgcatctattgagataatcacgtgtttttgtcattggttctgtttatgtgatggattacatttattagtttgtatatgttgaaccagccttgcatcccaaggatgaagccaacttgattgtggtggataagctttttgatgtgctgctggatttggtttgccagtattttattgaggattttcacatcgatgttcatcagggatatgggtctaaaattctcttttttttgttgtgtctctgccagtctttggtaccaggatgatgctggcctcataaaatgagttagggagtattcactctttttctattgattggaatagtttcagaaggaatgtgaccagctcctctttgaacctctggtagaattctgctgtgaatctgtctggtcctgaacttttttgggtggtaggcaattaattattgcctcaatttcagagcctgttattggtctattcagagattcaacttcttcttggtttagtcttgggaggatgtatgtgtcgaggaatttatccatttcttctagattttctagtttatttgcgtagaggtgtttatagtattctctgatggtagtttgtatttctgtgggatcggtggtgatatcccctttatcattttttattgcatctgcttgattcatctctcttttcttctttattagtcttgctagcagtctgtctattttgttaatcttttcaaaaaaccagctcctggattcattgattttctgaagggcttttgttgtctctatctccttcagttctgttctgatcttagttatttcttgccttctgctagcttttgaatgtgtttgctcttgcttctctagttctttcaattgtgatcttagagtgttgactttagatctttccttctttctcttgtggtcatttagtactataaatttccctctacacactgctttaaatgtgtcccagagattctggtaagttgtggctttgttctccttggtttcaaagaacatcgttatttctgccttcattttgttatttacctggtagtcattcaggagcagggtgttcagtttccatgtagtggtgcggttttgagtgagtttcttaatcctgggttctaacttgcttgcactgtggtatgagagacagtttgttgtgatttctgttcttttacatttgctgaggagtgctttacttccaactatgtggtcaattttgggataagtgctatgtgatgctgagaagaatgtatattctgttgatttgaagtggagagttctgtagatgtctattaggtccgcttggtgcagagctgatttcaagtcctggataaccttgttaaccttttgtctcattaatctgtctaataatgacagtggggtgttaaagtctcccattattattgtgcaggagtctaagtctcttcgtaggtctctaaggactggctttattaatctgggttctcctgttgggtgcatatatatttcggatagttagctcttcttgttgaattgatccctttaccattatgtaatggccttctttgtctcttttcatccttgttggtttaaattctgttttatcagaggctaggattacaacccctgcttttttttttcctttccatttgcttggtagatattcctccatccctttattttgagcctatgtgtgtctctgcacgtgagataggtctccggaatacagcacactgatgggtcttgactctttatacaatttgccagtctgtgtcttttaattggagcacttagcccatttacatttaaggttaatattgttatgtgtgaatttgatcctgttattgtgatgttagctagttattttgcccgttagttgatgcagtttctacctagcatagatggtctttacaatttggcatgtttttgcaggggctggtaccggttgttctttttcatgtttagtgcttccttcaggagctcttgtaaggcagacctggtggtgacaaaatctctcagcatttgcttgtctgtaaaggattttaattcttcttcacttatgaagcttagtttggctggatatgagattctgggttgaaaattcttgtctttaggaatgtcgaatattggcccccactctcttctggcttgtagagtttctgccgagagatccactattagtctgatgggcttccctttgtgggtaacccaacctttctctctggctgccattaacatattttccttcatttcaaccttggtgaatctgacaattatgtgtcctgctcttctcgaggagtatttttttggtgttctctgcatttcttgaaattgaatgttgacctgccttgctaggttaaggaagttcccctggataatatcctgaagagtgttttccaacttgattccattatcgccctcactttcaggtacagcaatcaaacgtagatttggtttttcacatagtcccatatttctcggaggctttgttcatttctttttactcttttttctctaaactttcttctctctttatttcattaatttgatcttcaatcactgataccatttcttccacatgatcaaatcggctattgaagcttgtacatgcatcacgtagttctcgtgccatggttttcagctccatcaggtcatttaaggtcttctctacactgtttattctagttagccatccatctaatcttttttcaaggtttttagcttccttgcgatgggttcaaacatcctcctttagcttggagaagtttgttattaccaatcttctgaagcctacttccgtcagcttatcaaagtcattctctgtccagctttcttctattgctggtgaggagctatgatcctttggaggagaagagacactctggtttttagaattttcagtttttctgctctggtttctccccatctttgtggttttatctacctttggtctttgatgttggtgacctacagatggggttttgttgtggatgtcctttttgtggatgttgatgctatttctttcgttttttagttttccttctaacaatcaggtccctcagctgcaggtctgttggattttgctggaggtccagtccagaccctgtttgcctgggtatcaccagcagaggctgcagaacagcaaatattgcagaacagcaaatattgctgcctgctccttcctctggaagcttcatcccagcggggcacccacctgtatgaggtgtcagttttccccctactgggaggtgtctcccagttaggctacacgtgggacggggacccacttgaggaggcaatctgtccgttctcagagctcaaacaccatgctgggagaaccactgctctcttcagagctgtcagacagggacatttatgtctacagaagtttctgctgccttttgttcagctatgccctgcccccagaggtggagtttacagaagcagcaggccttgctgagctgcagtggtctctgcccagttcaagcttttccagctgctttgtttacctactcaagcctcagcattggcggacgcccctccccctgccaggctgctgcctcacaggtcgatctcagactgccacactagcagtgagcaaggctctgtgggcgtggtaactgccaagccaggcacaggatacagtctcctggtgtgtcctggagactggacacaccactaagaccactggaaaagtgcagtatttgtgtgtgagtgtcccgattttccaggtacagtctgtcacgggtttccttggctaggaaagggaaatcccccaaccccttgcacttctattttttctaagaccactggaaaagtgcagtatttgtgtgtgagtgtcccgattttccaggtacagtctgtcagggcctcccttggctaggaaaggaaaatcccccaaccccttgcacttcccagggaggcaatgccctgctttgctttggctccccctccatggactgcacccgctgtccaaccagtcccagtgagatgaaccagatacctcagttggaaatgtagaaatcacccatcttctgcatcgatcacgctgggagctgcagaccagagctgttcctattcggccatcttggaacagaatcaagatcaattattttcaatggcattttgtttttaacaattagttaaaaaaagactataaacaaccaataaagaactgtcatgcaaaatactggaataacaaacagagatttagagatacacattttattttagtgaattaagacacattctcttgggatttgctcaagtaaactgtgatcaatacattaaagtgccaataacagtatataaaactagctagtttgaaaatatttatgagattattagttagaacatatttcaattttatttttgtgtatgcttgatttattcagattatttttgtcttgaatgtcaattatttattttacacaagaattaatatataattttataaactaaccattaatgaaagattattaaatgagaaaaacacacatattcatatacatatctatttctaattgaatcagaatatattcataatgagttagtttttacaaacatattagtgatagagttgagtataagggaaagattcaaaaaacctagatgggttttttaaaagtctttgatatttagttacccttttgtaaaactgggaataatctgcttttaaatattcccttcaacttaacatttattagttgtatcctgtttgggtgtttcacatatctactgttttttgagacagtgtctcactctgtcacccaggctggagtgtagtggtgcgatctcggctcactgcaacctccgcctcctgggttcaagtgattcacctgcctcagcctccctagtagttgggactataggcgcccaccaccccatgcctggctaatttttgtattttcagtagaggcagggtttcaccatgttggccaggctagtcttgaactcctgacctcaggtgatctgcccaccttggcctcccaaagtgctgggattacagacatgacccaccatgtcaggcccacatatctactttttatacatcattttttttatttgacaaaaagtaattaaatatgttgcaattttattttgttacttgaaggaattttttgtgatttagtgagaaaaaaatattcctattctgtattataaacaaataatgttattaaacttatttattaaacaataaaattagaactaatattgctaattaaacaaattaaataatttactgtatgagtaacttcacaggacattcttactacaatcctgaaaagattctcatagaaaatgttaccttgctatatacagtttcccaatttgcctgaggggtcttagatatatttattgggtataaataattagtctatatgttttctcgaaggcaagaatatattttatactctgtatatgaagccccttgcatcttatttttatatagcacacattaaatttgtttctgcaatgaaaattcacatatgttcatttaattttatttttagaaggagaatgtcatgttccaattttagaagccaatgtagatgctcagccaaaaaaagaaagctacaaagttggagacgtgttgaaattctcctgcagaaaaaatcttataagagttggatcagactcagttcaatgttaccaatttgggtggtcacctaactttccaacatgcaaaggtcagtatttattttagaagtgatgaaacaagaatttgatttttataataatgcccatatatttttattggagcttatattacatctataatctgacaaagtggtaaaatggcaaaggagaaaggatgcagttctatagtaattgagctgcatagattatttaggtgtccgtaatcaaggagtaattctacttctgtgttttacaatacataataggattttataggtcaaaatatagtagctggaattgagacgtcttaggatttttccatctagctcaataaaaaatttatactttttagaaatattgtacgaacaatgttatattttattaagtaattaagaaaataagtcattgcatatacgaattattcattagaaaacagtgatgatttatacctgcttcagatggcactatttttatcaaaaatggcttatcacattatttgaagtatgtattagtcccttttcacaatgctgataaacacatacccaagactgggcaatttacaaaagaaagagttttaatggactcacagtttcacgtggctggggagacctcacaatcatggcagaaggtgaaaggcacatctcgaatgatggcagacaagagaagagagtttgtgcagggaaacctccctttataaaaccatcagagctcgtgagacttattcactatcatgagaatagcacaggaaagatccgccccataattcaattacctcccaccaggttcttcccacaacacataggaattgtgggagctacaattcaagatgagatttgggtgaggacacagccaatccatatcaaagtatttatagatattaataaaagttataactatacattgcatatgtatattatatcacatatttgataactatttacttttatataactttcagattattgacctacttaaaaatcttcaagggtacaacttaatatcctgattataataaacagcctacaaaatattgggaaagatggacaatcaggatgtttaaatatagagaggatataagattgtactaagaaaatattattaatttggtgaaatgtaaaagatattttgtatatgtaggcaaatgtctttatgagatagcattctgaagaatttaggactaaaatttcactgtcatttactttcaattacttcacaaaaaataagtaaatagggcaaagtgtaacatttttatatctaggtaatcagtttataagtgttcattatgcattctttctcctttcatttgctcaaaattgttcatcatgaaaagtgtcaatatttgaggaaacgaatgcagtcaatacactatgtacactgcaaaaaacacatgtccccaaaaatagaagtgcaatataaaggcaattaatttctaagtcaaaaatttagtaactccacatttttctatacttataagaccatttaagcattatttatggtttctttataataggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttggtaaataaatattaacatttaaacaggacagttactattactttgcacttatatataaatacacatgtaaacagatttaaaatattttcagagtaagcactcattttattacattttcttagaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttggtgagaaaacattcctaaactttatatttgattatttatcattttgattgggattgtataaagtgtataaatctggctagaattacaattttattgatactgactcttccttccacaagtaaaatatgtcaatccatttattcaggtcttacattaaactttaccatatggttttatgaatttcttgttattactgcacagatttcttcaccaatttatttgggatttttctggcatgatgaatggaaacttttattaatgtatatgcttgaatagttatactttctatatgcaagaatgtgatttaattgcatacattatttttgtttccagtaaccttgttgaatttctgtattagttctaatatttaattgggatattgtatttctacaaatgatggcgatttaatttcttttatttcattgctttaacttagtctttacctcagcatgttccagatagaacaacctaaaaaatagcaatgtagcttgagttctattaaattccagagtgtttggaatcccttcatagaagaagagtaggggactaggacccaggaactaggcatgatccttgctctttctggtcccataattctcttatttctattcctaattatctacttagtttgtcggtttcctccacagaagtagtaagtagtaagtagtaagtaagtagtaagtagtaagtagtagtagtctatcagcctgtgtgctctactcttaccttgcagcctcaggacttccagccttgacacttaagtacttgcaggtattttttttcccgacaccctcagatcctggcctcttttgtcctatctctagcaacctcaatacattaaagcctctaattttgaactttaaagacaagcagactttccgccgctgttctcctccttacagaaactgaaacagaaccgcctctctctccatctcctggacttttggataatcaactggcccactcattgctgggaaaaattactgtaggtgttgccagccgttgtcccagcaaatacctggtcagtggccatccgtgatgacctattgtgagggaatgttttccactaccaggagccagaacgctgttatgggaagatgtagatcatatatcttcatggtcatcaacttttatgcaaggagtacataaatatcaacctctagccccatatggggtgaattaaaaatagaaactattgcagaaaacacctgtaagcatagaagtagcagagcacactccatgtctcattatcccatccttttacacactaaggaaaaggctccataactatctacatgtttatgggaaacgggaaaaaaatgtaacaatgagaactacttagacaagcaagaggcttagtaggaatttatgttctgaagctcagttgtgttattatcagtgagttcttcccctgagaatactctgacttactgagtcagagtttttgctgagcttttgaaatgtgagtcattgaacctcaagggggacccagatctatctcttactgatgctttgcttcctgcagacttacccatgtattgcctctttttattatttaaatgttttgaagatatttaagatagtttagtgcaaaacaatcatacatgtgtacattttcagagcctctaacaattcatttgtagcttcctaagaactatctttcagtcaaaactcccactaggaaaacctatcttgcactttcatttcccagaaaactttctgacctactttcctgtcattcaaagatgggatacagttttttgttttattttttctttttccaacagcattgtctattttgtgcaatgagattaagaataagttttgtgatgttgcttaaaagcatcaaacataattatgctattaatattgcagatattttattgacataattgtttagtttctatttaatattattttttatagcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacaggtaagatttgtttaaaacattttgttgatcttgttgcttctttacaagaaaaattattttgaaattagaatgtttttaaattaaatatttattgtggcatataatttctatgctaatagtaaagtagaaactagttataatactctttccagacaaatgttattctttaaaagccttggctttctggtaaagatgagagagtaaagctgtttttactctattacagtctcacaaaaccttgaaagaaaaaaagaaataaagaactgtaaaaaaagaacaaaacttaatcttcaatgacattaagaaacaattaaaaccccaattatgcactgtgaaacaaaactaacagatattgccaattctggaccagacagtaggctgagtaaaaagtaggctgagaaagaaaatatatttgagtaatcaattatttccctaagaaaaagtctcacattcctcgaaggcttatattcaaatcatttactttgagtaataggattataaattacaagtaattataaaatggggcaccatattagattaaaataaaccagaactagagaaaacaaagtgcttataaaggaatgacaataaaagagagaagatagactgcagacttctcatcagcaacgtcaaaagccgaagaaaataaggtaatctcttcaaagtgcttagtgaaagtaactggcaaccagtcattctatgtaccaatataattcactaatgattccaaaataaagaaatttgcaaccacaggaaggataggagtttacacacaaggtcatagtttgaaagaaatcatataaaatacacattaatgatataaaatactaatttatagcaaaaagtgtgatgtcattagaaattgtgaggaaaaatactggaatatattcttaaacttaaatacataaggatttcaaaaagataagataactacaatttgtttaaagcaactggaacatttttatgtttataaaatatttgatttcattatatattttttctatttgaggaagagaaatattctgatagttgaaagaagtttgaagccttttatgtgtccatgaaatgtttacttaaattggccagtcattctgcccaaaataattctcacaacttcaaatattaaagccctatagatgactttttgtaaccacaaacaaataacattaaaagtgtataaaaagttatccacttccttacctttcattttgggtaagcaaataatttacttccaaataacctagtgatgtaatgtttaaaatattaagaactatgttataattacaaggatacgtagtaaaacctatgagatgcaacctaagcaaaatttagaatgatgtggcattcatagtcttaaacttatctattttgggaaaaagtatatatatatatatatatatatatatatatatatatatacacacacacacatatatatacacacacatatgtatatacacacacacatatatgtatatatgtatatatgtgtgtatatatatgtgtgtgtgtgtgtgtgtgtgtatatatataatatatatgtatatcctaaaaagctagggggaaaatgaattcagatattaggaggaaaaggaaataataaaagtaaaagcagaagaaaatgaaatagaaccttgtatttccaactaatccaagatatgaaactaatgttttgaaaagattaataagcagagctgtctaaatgagttgactctaatcaagaatggtgtgcatacacaaataaacatttctacaaccaaagagtagatgaaaactgaaatacagggaataataatatgagttcaattttttaaataaataaattacaagcataaagagaaggaaaatactatgagtcataggtatcaaaataaggaagaagccttatttaaagttttgagaagagctggtagctagtagtctggaaattaggtaagaacgttattaggtggcaaatatttgttacacaccttgcttgttcttgagaaaaataataaaatttctcattttatgcatcagaaatacatggcttcaagaagttatttggtcaaaatcaagactggaacttgtttccagatttttatatcagtgctgtttcaactagactctgtctttactagacagaaatttctaaacagatgtccaattctaaaaggaaagtaaggtgggcaactgagatcattatgtgtaatgttctttttacctaaaatataaaaacaatagtatatgtgtgatatttgaatatctaactcacttagttgggactttgttgatgaaattctcattattatttgtacatttgagattacagacaccttcagcttccctatttcctggcactgggacatctaggaggctcatagcaggtaactgctgagtccctagattggcagcacaggccttgaggctcattcaaaagagtcttgatgatactcaataagtattcatctttgtgactatgtatttaaataaaaatacttaaaccaccaaacagaaattcataaacaacaaaaatgtttagtttccaaaatgtttacaaaatacctaaacaaagaggtaataagacattaagtagaagagcttctaaataataaataatattgaaaactgacccatctatctatcaaatgtgcctgatatcctcttttcatgtgcttctcatagactttcttcaaactcatgaccaaactttgctaatcaaaaatgtatactaacaataataatatcaggctaattttattttcttttgcagttaattactgaaacaacactgatcacaaaagactggtcttgttaatggttgactagaataagatgcatctggaactaagtactttaagttcacgcttttcttaaaccagtaaataagtaggacgagtcatataaaacataaaatacgcatcagtgggccccagtcccagatatctatctagatttccacaggaacagtttctgtttagatttgcactattttgcctttctgaccttgaaaaaataaggaaaaatccagtataaaattcctattttagacaatatgtatgttttggcttattttatactgacctcaggttctgttcaaataatttattaaagatctgttgtatataattattatattttttaatctagctaaaccaggaaagagtagatatgcactcttctgtcttgatttttaaatgaaaatagtatagcgaggaaaaaaaatagcactttcaatgcaataattttttttttcactgaatatgttttttttaattattgttatactttaagttttagggtacatgtgcacaacgtgcaggtttgttacaaatgtatacatgtgtcatgttggtgtgctgcacccattaactcgtcatttagcattagatatatctcctaatgctatccctcccccctccccccaccccacaacagcccccggtgtgtgatgttccccttcctgtgtccatgtgttctcattgttcaattcccaccattttgaagggaagtgttagtagacagtagccaccactctggaaaaacatgagatgaaggagatcactgtaagggcatgagcccaggtcaggaggtttagaaaacgctttggcatccaagttgaccatttaaaacttttccctaagaataagccaagcaaccaaaaaagaatttaattcctagtccaacggaggcattccagttatgttcattaccagccattctcatgtttacaagaaaatgcaagtcatggaaatcctttattgagatctagggttcagttattaggggaagtcatagttatttctgattgttgtcatttttatttttaaattgtttaaattcaatgtacataactttttgaatcatatgggttagttagaaaaaaattaaagaaatttatttgtaaattatacaagagaattgacaggaataatgaataggagatacaagagagcatctgaaaaattttaaactaatggttataacaaaaagaatcgctttttaaactgtaaactatagtgacacaaaaaatatttgttattataacatttatatatagggagagagaaagagaaagtgatagagagacatagtgtgtgtgtgtcattgaatcttccattttcctgaaacactaccctattgagctgtttttacttaacttttattaatcatataatttaattccaatattttgtagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttggttagtagtttatttctaagtaatttcacttaaaaagaggttattaatcccctttgctttatctaaagaaagaaacaagaacttatgactaatctgttgcactgtaccccaaagccttaaattgctaagtaaccaattctgtcatttaaaaaagtttctctaagagttatctccaacagtgttcatagaagaaacaagtttgaaatttctacatcttcttaaaaatcttttctatcatatttttactgtaccttttctatgtttaaatatgtttagatatgcaaatacttaccatcatgtcacaatggcctatagtattcagtatggtagcatgctgtacaggtttgtggcctaggacagcaatacccaacctttttagcatcagggacatgttttgtggaagacaatttttccatggactgaggaggttgggggatggtttcaggatgaaactcctgtgcctcagatcatcaggcattagattctcataaggagcatgcaacctaggtcccttgcatgtgcagttcacaatagggttcaagatcctatgagaatctagtgccctggttgatctgacaggaggtagtaatgctggcagtaatgctcattcgcctgcctctcacttcctgtcatgcagcccggttcctaagaggccacagagggtactggtctgcagccaggggtttggggacaataggagcaataggctgcaccatatagcctaggtgtgtagtaggcaacattatctaggtttgtgtaggctcactccatgatgctcacacaaggaaaaaagagcctaatgacacatttctcagaatatcttcttgtcattaagtgctacatggctgcatttcaaaagcacatatttcaaaatattacttgacaaaacatcagatatggcaaagagtgcttagagctggacaagatgcctgataattgaacaatctatttatctaaataaaaaccattggtaattttgcctagagatatttccatagggggtaagtaattgcagtgtgttcaagaaagaatgtggggtgataaagtaagatcatggaggatgagaaacaagtaaatgtgttcaaaagggaatagagaaatgaggcagttaccggatagaagatatggagaaagtgaaattttaccttattgaattgtgacattttcagcatgtttgtaggttggtgaatgattaagtggaaagggagacattgatgttacagaagaaaggagataattcatgaagaaggatcttttacaagtttaaaggtgaaagaatctagtgtcatcatgaagaagtcaatctgagaaagcaaggacagtaactcaatgaaactagaggatgtacaagcaatttgggataggattacttagtgatttcatatttatgttcttggtgatatataaagggagatcagtcagtacaattgaacgtattccagccaatcttagcatgaagttgttactttttttagttttccccaaaatctcttcattagcatgaagttgaaacatttattgatagggaaagatgcctacaatattatttggtatcaaaaaagtaaatgcagaagagtgtgtctgcaattcattttcagtaaaactacaagtttatgatcatatactagttggtatatgctatttgcataaagtaataattaccctgagactagaaacagtaagaaagttatttacttttacctttcctctttaagtgacaattgaatattaaggggtggaggaggaacctagaccagaagtttactcacctgtctctcctgccttcaataaaaagtattcccggtattttatatgaatttcactttaacatgaaaggagctacaatatgttttgaatcagactttatgacagaaatactgtaattaattatttgaatttccagacaccttatattaaagatatgatacatgatgcttcattatattattttgtttaaactaacataatgtctcaacaaataaatgctgttttccagagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctaggtgagttcttaatattctcttggaatctgagatttaatatttatagtgtaatttttttggactaatttcatagaataacccttacttaagtttcattcagtcaaaatctttcctgtcaaatgtaaatacatacaaggaaacatttgaaaaatttgctttatgcaaagtgagaaaaatttatttaaaaactataaataaaattttaaagacctacatgtgataaggtgcattatgaaattctgtagagtccagagctatttatggggcctattcgcactccattaaattgtttcatgttataagcatctacctgagaacttctcacagagaccctttgaaaaacactggtctaggaaaactgtcatttaatactatataaggttctacttgtaaacctgaaagctttccctagtagaacacctagttgactaatactgacatggctttttacttgcatgttggcagaatttctagcaggagagatagaaaatctggaagagttactgagccactttctaaatcttcactatcccttcttttcaccctatttttttctactacaaaataatgccaatatacatattaagtttccacaaattcatgtgcactttgtggcattaaaaaaattaacatcgtagactccttatgaaaatttggagattcacttttagggcttaaaaggagattcttttatcggtcatgacaaactaaaagggacaaaatacaaagatatggggcgaattaataacaccaattatgggaaaagcatgaacgtcagtttactctataataagtggaagaaaactggaatttccataaacccctctgttttctggtgtccaaaagagacaccatggtaataaggatctgttcctgcaacagttctcactgttgcccaatacctcacagggctagaccagaagtttgttatagtcttgaaaattcatccttctgacgatgtctctttcttccaccttctgtagtaacaaattaccccaatgccactatggcctatacagtgcttcaaaccactactctgtgtgagcccctctcccaggatatcattaaaattgtgtgggaactgaactcagaaagtgttgagttagtataaggcagaagtatcatctgaacaattttgctagaatgaagaaaaactaggtttcaaagataacttctaggatttaacttggagtgattgatggatagacaaaaatgccattatctaatattttaagtacagccaagttttagatggtccaataatttaaaattcgcagaaattatcatggccagtgatcataaaataaatttccaaaagaaaagtaagaacaaaatttgtaacctaaaaagtgtgtaccatgttgacaatcagagtttgtgggaagggcattctagcaaaaagaaacagtattttgaacaataacaaacacaaacacacaatcacgaaaacaaacaagcaaaaaaacccatcatagatatctggaaaattcaaggaaacatgatctaactatgaaatgtaaaataattttatttcccatgagataggagattaagattagacagctctgaagaaataattttttccagccaggcatggtggctcacgcctgtattcccagcactttgggaggccaaggcaggaagaatcacctgaggtcgggagttcgagactagcctgaccaatatggagaaaccccatctctactaaaaatacaaaattagacaggcatgggtggcacgtgcctgtaatctcagctactcgggaggctgaggcaggagaatcatttgaacctgggaggtggaggttgcagtgagccgagattgcaccattgcactccagcctgggcaacaagagtgaaactccgtcaaaaaaaaaaaaagatataattttttccaaaaccagacataaatttatttggatggttcatgggtattgaatgaagtagggagccattacatatttttaatagcagttttttgacatagcatctttttttatttttattttttcaagacaaagtcttgctctgtcacccaggctggagcgcagtggcgtgatctcggctcattgcaacctccgcctcctgggttcaagcgattctcctgcctcagcctcccgagtagttgggattacaggcacatgccaccatgcccggctaatttttgtattcttagtagagacagggtttcaccctgttggccaggctggtcttgaactcttgacctcatgatccacccgcctcggcctcccaaagtgctgtgattacaggcgtgagccaccacgcccggcccaatgtagtatttttaaattatcagttgactaagaacatgtggttattttacaccgagaaaacatgcaatatggggaaattgtttaaggccctggcagagatagattagagtcttgactagtaggtaaaaaacaggaaccaaatgaaagaggggttaaagataacttcaaaatttctcgatttatggagaatattctcaggtgcttaacacataagaatttttacaaatcaatcaaaattcagtataaaaattatgtaaggtacataaacagaaaatgaaaaacatatggcaaacatgaaagaatgcttgtctacacgaacataaaatttcagtgaagtgtcaatgttcaactaggagatcggcaaaaagaaaaaagtatataacataaagacttggcaaggatgtggagagttaagcactctaatatacatacaagtgtataattacatatacatgtgtgtatatgtaatataaatatattacatattacatatatttttaacatatatgtatacacatatacatatgtaacatatctaaatatacataagtatgtatgtataatatatgtatacttatatacacatgatacatatacatacaatatatgtatacatataatatacatataatatgttatgtataatatattatattatacattatatataatccatatattatacataatataccgatatatatttatacattagatataaattgattacattacattagatataaattgtatgtaacatgtatacaattaacgtacatatattacaattaacatacatataaatgtatgttatatatacacattatattatgtattatgtattatatattatatataagatatatataaatatatatataaagtgctgattttaagaaagagtgagtgatatctggggtcagggaagaagataacattgttttttctacagaaatcaaggtttcacaaagttaagattcacaaataattacattataaaaagggatatctaaacaaacaacattcatgctggtagaatttttagtaaagtatagcaattaagagctcaggttctgaactcatactggcaggatgcatattctggctcaaaacactcactaaactgtgtagccttgagaaaatctcttagcatttatttcctcatatgtagcccatacacagtgctaagaacagtaccaagaataactcaataaatattattttttaaataaatattaatatttttcatcattttaattccaaaatattcttaaatgcaatttcactattctatgaaaggtaaagatgtattattatttatttattttattttaccatttcttctttcagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctatgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggcggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagtacttaattcatctaatccctcctgtttgtctcaaattataggataactttgaaactttctgaattaacgttatttaaaaggaaatgtagatgttattttagtctctatcttcatgttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaaaagaatagactttgaaatgggttttttttgtttttttttttttgagacggagtctccctctcgcccaggctggagtgcagtggcgcgatctcggctcactgcaagctccgcctcccaagttcacgccattctcctgcctcggcctcccgagtagctgggactacaggcacccgctaccatgcccggctaatttttttgtatttttagtagagacggggtttcatcatgttagccaggatggtctcgatctcctgaccttgtgatccgcccacctcggcctcccaaagtgctgggattacaggcgtgagccaccgcgcccagccaaaagaatagactttgaagttttaaccagtctttctgtggagtttctaatctagtcaagaggtgatgtacatatacaaaaaggtgaaaattattaggttacaaaattgcatatatagaattatctggatgtgtataaatggttatagaagaaagagtgagagaaaaaaaatgatggctttaataattctatgtggtttaggtttaaaaaattaaaatagtctgggcacagtggctcaaacctgtaatcctagaactttagaaggccaaggcaggtggattgcttgaggccaggagttcaagaccagcctgtccaacatggcaaaaccttgtctctaatataatacaaaaaaatagccagacagggtagtgcacacccgcgattccacctacttgggaggctgaggcatgagaaccacttgaacctgggaagcaaaggttgcagcgtgccgagatcatgccactgcactctatcctgggtgacagagcaagactctgtcccagagaaacaaagaaaggaagggaaagagagagagagaagaagaaaaagaaagagagaggaaggaaggaaggagggaaggaaggaagcagggaaagaaggatgggagggaaggaggaagggagggagggaggaatattttcaaattcttcacgttgtcccaaatttcatatttttcattttgaacatatattactttcatattcagaagagagtgatcaaaactgtcactaacgaacaaggcaatagaagatgggtataaagaccatgttggtcatgatgctgatttcatgcaacaactttattatttttttatgtaccatagtttgggaaaatactacacaggaagtattagaaatatactttagatattcctgtatttcacacagcatttcttagttaaaatatttttggtcagaaggtttttttaagtagcctgggacggaggttgcagtgagccaagatggtgccactgcactccagcctgggcaacacagtgagactctgtctcaaaaaacaaaaaaggtttttttaaagtatctattaaaaatatgactactaatacaggtaaaaattaagacttaaaatattcatcaccacagatttgacaatggattcttagatatcacaccaaaaccacaaataagaaaatacaaagtacagaaattggattttctcaaaatttaaaatgtcatgcttcaaaggatactattaaaaaaggaaaatagaactcacacaatgggaaaaaatatttgcaaaattgcatatgtcataaaggacttgtatctagaatatatgtaaggaacttttacaacacagaaaaaaagagaaataagacaatttcaaaataagcaaaggattcaaatagatatttctctaaagaagatatataaattgccattaggcacatgaaaagatgtataacatcattaattattaagtaaatatgaatcaaaaccacagtgagataacacttcacaccctcaaagatgggtgtcatcaagaagtcagataataacaaatgatgtcaaggaagttggaagcaacatacacttctggtggggatattaaatggtttggtcaatttggaaaacaacctgcagtttttaaaaaagttaaacaataggattgccattaactcagcagtctactcctagatacatacccaagataaatttttaaaaatgtgtccacgaaaacacttgtacacatatgtttatggcagcattatttgtgttagccaaaaggaggaaacaatctaaatgctcatcaattgatgaatgggtaaacaaaatgtggtatatctaaacaatggaatattatttgggcatgaaaagggaatgaagtaataatagatgctataacatggatgaaccttgaaaatattctgctaagtgtaggaagccagtcacaaatgaccacatattatgattccatttttatggcatgtccagactaggcaaacctatagagatagaaggtagacctgtggttggttagggttggagctgaggaagagaggttagaagctgatagccaaagtgtacagagtttcttttttgaggcgatattctaaagttgattgtggtaattgttgtaatactctgtgattacactaaaaaaaacattaaattatacccattaagtgggtgaattgtatgttatgtaaattatatctcaaagacattacaaaaaatagtagtcaatgtttaaaattcatgaggatacattggaaatttaaaaactaaaaatgattttaaaatttaggcttagtagcagaatgtagaaaaaattatctggggttgaataaaaaaataagaatttgttacttacactttctatctatctgaaacagctggcttcatgtctaggaagaaggcaggtaacagttttcaattctgagggggaaatcttgaatacaaatattaccaaaaacttaaaaaaagcataaaagtgttttattccaagtacaatcttaaccttattttattttattttattttactttattttattttttatttttgtagtgatgaggccttactatgttacccagggtggtctcaaagtcctggcctcaagccatcctcccacctcagtctcccaaagtgttgggattacaggcaagtgcaccacactgttcctgtaacagtattttaaacttgaacattccctctcagttcctgagaatttttctaagtttttcaagctattctgtgacacattccaaatcaaggtgtttgaacaacaatatagggcttgttgataatgtttgctacctttaccttactacttccctgtataaaggataaaggaagccaaacaagcaaaaggactaaaattagaagttacagaaaatattttcttgcagatatttgtcaggcattgtgagtaccacaaccacttttcttggggaagatgggtagagcttcattccccattccctccagtctaataagaagggcttcaaagagattacttgggtggattaatcaagaaaagattgacaaagtacccctacttggctcacccccctactggaaatctaaatcctttttttacaagagagtaaaatggtatgcaggtgaaaaaaatgaattcctggaaccaaaacataaaatgcaaaggttgataggactataaaatgaaagttgaaatgtttaagcaggttttatgtaaagtagttgtgtatcctttaactaaatgtttcgtggaaatggatattatgcctgactgaggaatgtttcccctacctagtactgtaaaacaggacatataaatccaccctatgagcaatattaactgaacatgctaagtgggagctagtaagattgtccaaggctagagtttagggtgaaagctgagagtgctggtagggatgaatcctccacttgatagccctttgtggaatgttcactaggactgatggcaaaagcctgtgagtgcctcccaacagcgactactagcgctttggaggagagaatttccactttaggggcatttacggcattgctatgggaaaatacccctctgcaagtgaaaacagcagtgcacagaagacttccatgataaaatggaaatgattcttataggatcttgctacttggggagcacaaggaggagattctaagaatcagggagctattttttcctctaggactgactttttcccctgtgattcaattcccacttgacttatggatgacaatttaaaggtgaacaaacgacatcctgtttagaagctgctactctgtttgaaaaagcgtcaagaaaacctttctcttttgagctatttatagcttaccaagcttgagtacagtattttttgcgagcaaaatttaccttctctctatccaagatctccaaaacttggaaactattcataagtattcttcttttagagaaatataattatttccataagttcagtaagaatctgttttattttgtaacaggatataactggagacactagttattttatcaagactttgacttaaatggcatattttcagatatgaccagactgaggaattgaggccaactttatagagccaataaaaagccccttggaaaggctggcctagtaccttgtctaagtgattcccatgcaaggtttctgacttgtagtaagtaaaaacaatgtcactttcaaaaaggcccaggagcctcaggatatttggggaccccaagaggcatggaatttgtacatgtataagaagcacagtctaatggtgagtccttggcttagcttctggccttgaggcttttaaaaagtcaaatctaggccaggcgcggtggctcatgcctgtaatcccagcactttgggaggccgaggcgagcagatgacaaggtcaggagatcgagaccaacctggctaacacagtgaaaccctgtctctactaaatatacaaaaaaattagctgggcatggtggcgggcacctgtagtcccagctactcgggaggctgaggcaggagaatggtatgaacccaggaggcagagcatgcagtgagctgagattgtgccactgcactccagcctgggcaacagagcgagactccatctcacacacacacaaaagaagtcaaatctaaaactccttacaaaagttccagccaaaccaacttaaaagacttctaaatggctgatcgctattcttgctgtacttcatgcaaatgaccagggcaaatataatgagaccaaaatttattttgcaaataaattggcctgctttcatttattattggtagaaatgggaaaactggagagagaaaaatttagattctagccctggcaactgtttctgaatttttattatctgtctacaatctgggctaaatcctgaattatttcctggctgcaacaagtctcaagaagaaccaggttttaattttccttgtgatgctttaagttgactcctttatggaatgggttcttttttgttgttattctggcatacaaattctctctttattgtaatcctctgtgcatagtatttctaccattcaaattattattgttatgtatctctcattgttttacttctttcaagaaaatggaagtcatggtatcctagagatgattcaacagagcctgtgaatctcacccatttgaaatcttactgggccccgactcgtttttcactgccaatacactgctgctaaagctatatagtatcaagcaccttccctaaagtttcagggatcatcttagaagaggagggcgcttgagattgtaagagctggactagatgagtggaatgtggaggccaaagtaactccgtcttagaagctaaactgccttgttggcttctgattaacttcagaagcaacttctgttgctccttgtgtaagagcaggtacttaccatcaatcctgtccttaggtaaaacaaccttgaagttattgtacttcaattgtcctacacatcccttctgaaccacccctcctgtggggtatgtaagccctgagactgagggataatggctcagagatccaccatcttgtctctctgccacttctgacacagacatggctctgttcattaaatctgtattaaatgtttctttctaagaaaaaaaaaagagattacatggaagccttgatatttatttcaccagacctgtctggcttatgactgagagaaattaaagaaaaacataaagagaaacaggcagagaaaatagtcagagacaaaggagagataaattgtcttgaagccaacttaaaagtacattgtccaaaaggcagcatattctaattagaaaaagaagagtcagcaaggcattggaatgcagtgaaagcaccaggttccaaagggctgagttgttttaataactatccacaaatgtatcaccctaacttttcttcttctactatggccccgaaggagttgaaggccataataagttggaggggacagtgagtgggaaaaacttccagggataaaagaagagtccaccatatcccctattcccactacatcttccatttcaggagatcagtgttggagggaaagagaaactttaccttgaaccaaactcagatgtctgattattatattgaattggacttacaaatattttttgtcataaaggtctaatagacaatgttgcagatttcctatggtatcacaccacaaatttctgatgcaaagattgagcctgaataaggttgaggaaggactgagttgtacagtcatgttttttcttctgtctataaaaaaataaactgtgtgctgttgcaagtgaacagagcaaatgtccagttcctgtgatatatttatgtattaacccacattgagttctaaagaacagcaacatggtaaagcctacttttctgtctattatacattttcccaccaacattctgttatgataagtattcatatagaatatttgaacaaacatccccacttaacaattgttgaatcatctaaattcatcaatcattaatgttttaccctatttgctttttcaatggcttcagttatctatccagtaatagaaatctgtctatactttcattgaaccaaatcaaactaagttgctgacattctgacaattcatcgtatcatattccacattttcaaaaatgcattatttaaaatcataagaataggagttcctccatcagtggtgcactgcattattttggcttaaccctcttgttggccgcactacaaatatttgaaaaatatttgtaaaatttgttggaagtcagcagtgcactactgagacatttaagcattacagggccaagacataatagagaaattacctcagcatttagggggcactttttctctcatagcaattgctgatttgaaagtagcagtataaagactaagaagattaacatctatttttccaaaatagagatcttctgcatgaatcttaagccatggtatttacagaagatggagtggaatgccagtttagcaggattatggctccctctgcctttgtggcctaaaccgatgccattgggattgcctttccttttccaggaagagcttccttccttcctttggtcaaagacagaaacttttaaaatgtagcctttcaacatcctcatagtttaggtattcttttggaactcagatattttagtttaatttaaaatttctaacatggatttattttctctcttctttcctcctagtgattgtcttctctctaccaacaaaggtttttccgaggtattccttcaaactccgcgccattacctagtccactgttatcaacaaaatcacagtaatttactaggggctgtgtcatttctgcacaataattttttttcacagaatcacagtatttcctcaagatgtattgtcaaaaattagtcaataatgaatctcatccctcaatttcaatgtataagtaatgcagtttctcttatagaattttatttacatcctaaatccttattcttttgagagagaaactaaatctcaatcaagttgggattaactactatttcagaagctgctaaaaataattccccaatatttgctctctatttcttccttttataaataaaaccctccaagtttctctgcctaggtatatgacacaatagtggaacactgcagtttcctccttttttctaggtccacactggtttgagttctggccaatgccatatgagtggaaataatttgttcccttgtttgtcacagcattaaaaggaatctcgttgcttgtcacttcctctttcctttttccgaaggggtagaacacagatgtactggcggtgagccatctcggatcatgttgataaagcagcccgctgaagaatagtaaagcaataagacagaagatacttgaatccctagctggtatgatccaagcttgtatgatccaaactatgccatgtcagtttctggacccaaatcttaaagactgtggccgcttccacttcctgtctcttggaatacttcctatcagagaaagtccaaacagccctgttgagaggctcatgtgcagtggaactgcagctcctactgtacagcctcagctgatcttccagccaacagccagcaccatcttgctagccatgtgagtcagccatcttaaaaatagatattccggtcctagtcacgtcacctcaactgaaagcttgtggattagagaagcaccatcctgtcaatccctgcccaaatttcaggtttgtgagtaaatttgctttttgttttaagccaatcttataagtttgcagcggtttgttatgcagtaatagatagctagaatgccattaaatacattattaaatgaaaaatgcattgaataattccctgtaaatgttaagaataatgaatacatacttgacaaagagcatcggtagctactttttaatcaaaggacagcttacccttagaatgatgagaattaagaaaaataaggtttagtaacgtcagttacttacgaataattgcaaactccatttatgacatacaaggcccttcttgtttgacttcaaattacttatccaactctaccttccattagtctccaaaaatatgccataaaataattaatattgttctgccagttctctatgctttttcactttgatcatgttattctctctcaaggctcctcctaaattcccacatgcagactgaataattcctgttgacatatgttacactgacagtataactaaatccaaacctgattaaatcccaggaattgatgttatctcccctcgcaatcagaaaaaaatatctgtttagttgcataccaagcagaagacgtggtgattatttatttggtaatgatgatctgagaaaaatcaaatgattgctttagccttggtttttgttttatacccatttattaatattttcttttgctttcgagactaatgtatagtttaaaagtcttagagcaaaaattatgtatcaaaaaaatttatcaaataaaactgttgcaagtatgcttctttgcagagcaaatggtaacctgtaatttcaggatattgttcatatccatcagtttggatttttgttggtgttttataaaaggcacttgatttttgtcattctttttttttttttttttttttctgcaagacaagagtctcactctgtcgcccaggcttgagtgcaatggcacgatcttggctcactgcaacctccacctcccacgttcaagcaattcttctgtctcagcctcctgagcagctggaaccacaggcatgcaccaccacacctggctaagtttttgtatttttagtagagaagggggtttcaccatgttggccaggctagtcttgaactcctgacctcaggtgatctgcccatgtctgcctcccaaaatgctaggactacaggtgtgagccacagtgcctggcccagttgttgtcattctttattccctaagaaatatttctttttaaaagacatagaaataaaatgagataaaatacaaaacttaagttggtattagacagagataataatctaccttaaatatcccttgatttaatttttttagatttttacatatataatacaaaagaggagacaagatattttagactagaaagaacaagatgacatatgataagttataaagtattttatgtggggaaatattattgaattttattaattagtaaaatacatattttttctctcaattattttattggcagtgacttaacctcttttaacattt

SEQ ID NO: 420 - DNA, 45614 bp, Homo sapiens
cctgggtgatagagtgagactttgtctcaaaaaaaaaaaaaaaaaaaaaaaaagtcttagagaccagaagtctttgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctgttacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattaagcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacagttggctgagccctgtttttgtgaataaatgttatcagaacacagccacacccatttgcttctttgtcttctgtggctgcttttgcaatgtgacggccgagttgaggagctgcaacaggcgatgacttgtaaagctgaaaatattttttggcccttgaataagaggtttgctgacttctgacttagggtatcagttgttctgttatcccagtaaaactcaaggcattaggggagaaatgttaatattaatacttaagttgatttgatttagggaaatctttgaagatttctaagtcttaagcagtagaacctgttaatggttttagtttcagcagtaaggacattttacaagtaaagttttaaatgaaaacattttgtatgaagccacaagtcgtctggcctcttgctggtgtccagatattaacactgatcctatttctccttgctgaccaagtctgtcctttgtagtaagaaaggaagaaacgttgactctgtccgatctctggacttagtgttgtagcgagcatgcacctggaagggacttgccagaggacctcctcatgcttctccagtgcttagtgggggcttggagtgcagccccaggtcttcacgagcagttggccacactgcagggccctcaccccactctggagcagcctctgcttcaaaccagcctggatgcttgtcagctggggagaagatcaacctgctattttgggatagaaataaatgctcagccaaacggccagaaacccccattcccctctctgccaaagtgaattccttggcagggagaatcttgttcgtgtctctgcacacttcctgtgccctcctgtggttaagtcagagaatcatccggctctttgagccccaggtgcctagctgctcaaggatggtccccagccagcagctgccaggaatcacctgggagcccattaagacatccagcccccacccaaacgtatcgaatcagaatctgcctttttttcccaaatgatgtttttgctttaatggaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggaggttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagtgcgaaaccagcctgacttatgtgatgaaaccctgtctctactaaaaaaaaaaaaaaaaaaaaaaaatacaaaagttagttgggcatggtggcaggtgcctgtaatcccacctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggccacctctctgctcctcagggccacctttcataaggctccttgaaggtccctcaagatcaagccaactcaacacatccttgataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttgagacttgggggcctaggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgcacatacttgggaggcttgtggaggagtggggagggaggcacagggaggactccagggtggttcatacggctccctgcttctgttcctgtccccctttgtcaagctgtggtctgtactgcgtgttccatcttgtttctaagctgcttttgcccagtctttccagcatttccctttcgtcatgttagtctgtgcctgtctacgtgaactatggtgacgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttatcattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagtacagttcgcttgaaagcctgcctgactgtggaaaagatggagctcaagaatggagttgatggcccagcgtggtggctcatgcctgtaatcccagcactttgggaggctgaggcggtcggatcacgacattaggggatcgagaccatcctggctaacacggtgaaaccccgtctctactaaaaaaaaaaaaaattagccaggcgtggtggcgggtgcctgtagttccagctactcgggaggctgaggcaggagaatggcttaaacccgggaggcggagcttgcagtgagctcagatcgcgccactgcactccagtctgggcaacagagcgagactccatctcaaaaaaaggaaaaaattgtaaaaaaaaaaaaaaaaaaaaaaaaaaaaaaaaaaaaaaaatttcccccagcagtttttgttttctaaagttatcagtttatatattcaggtcttaagaaaggcaaaagctgtcttcaggtgattggcttgggggcagaacagtacttctgctcggggtttcaccttcctctctactccagtgcagcagagcttgtgatgtgctctcactgaggtgctcagtgcagcaaggaggcctgtggaccctcgagttgagaattggtgtactagggcattcggtactttctagaagccattaatgctacaggtactcataaagtctactcttctgcagcccatcgtggatggtggcttaatcattgaatttgagttgtttcgagctgcagcgttggatttgcattgttgtaagcacactttcttgctgtgaccactgacaccaaaattagtttgggcccagggagacttcagttaattggttcatttgaggcttagccctggactcatttgtcaccagccaagataacttgccacatggaatacagccagaccaggggtccccgacccccaggcctaggaccggcactaaaccttctgttacgtggcctgttaggaaccgggcatcacagcaggaggtgagcggcgggtgagtgaacattatcacgtgagctccactcggcgttagattctcataggtgcgattgcgcgtgtgagggatctgggttgcatgctccttgtgagaatctagtccctgatgatctgaggtggcagtttcatcccaaaaccattttcctccctctgtccttgggaaaattgtctttatgaaaccggtccctggtgccaaaaagcttggggaccactgagctagactcgacagtattttccaaggaattaaagcctcaaaacttggtttgagatttcagggtaggttgttaaaaatctgtgtgttgaaatctaagatttaattctgccaaagttcacgttaagacagaacaacctgctggaaagagatttggtctgagtggggcctgtggaaatcttctttcctgacttggtcattacctgtgggaccacttcctgagctgtgtggtttgggtgatctcagattttttctatctataaagctatgtgcttttttctactcactgagttgtagaaaggtatccgctctcattccattctgaagctctttgaaagcttgttttccttctaagtatcttctctactaaggttgccagatataataggggatgctgggcatggcggctcacacctgtggtctcagctactcggagggtgttggggctgaggcaggaggatcccttgagctcaagaggttgaggcagaggttgtggtgagccaagatcacgccattgcactccagcctgggcgacagagtgagactctgtctcaaaaaacaaacaaacttgcataactgaaaattcagaagtagttggccatcttgtatttctgtttggtaactctggcaacactaccctctactccccacttctaatataattttatagcatctctggcatacagtctatttggatccgacctaatggtgcaatattttgttttcctcagaggagcctctgacccatgtgaatctaggaccataaacaattagaatgcttgggagcaagagctttatatctgcatatgggaacttccggatccctgtgggcaagtgcagggagggccccttcttccatctactgagccatttcccaggggctcgggtgtgtataggaggaagagggcgagtcaggcatgttaacaaacattctaggttattcttggcagttttggaaacagttctaaggctgtggttctcagactttatatcagaattgcctgattgctgggaacagagactgatacagtaggtctgatggggtgcccaagaggttgcattcctaaattctcatgcagttttctaatcagggagcagctggaaaggtattgtgagcttgaatgtacctgggaaactacctggggtcttgggagatgcaaatgctggttcagaggtctggccctctgacactctgatgagcatttctaacaggctctcaggtgacggccgtgctcctggtctgtggaccacttcagtatggctgaagcacaataaaagagggcaaattactgctttctttaaaaagagtggcagccgggcacagtggctcacgcctataatcctagcactttgggaggccaaggcaggtggatcacttgaagtcaggagttccagaccagcctggccaacatggtgaaactctatctctactaaaaatataaacattaggccaggtgtggtggcaggtgcctgtaatcccagctactcgggaggctgaggcaggagaatcccttgaacccaggaggcggaggctgcagtgagccaagatcatgccactgcactccagcctgggtgacagagagagactcccatctcaaaatttttttttttaaatgcagaggttggactgcctacctatactctaatttctattctggagtgattctctggagaggctaggtaaagactgaaaaggcattgttacgtccacctgtcatctcacttggacaagaatccaggagaaactattgaactgaggtgacaaagttatgatcaatgtggtgatctgaggtgtattaaaacactgagctctttcccagtcacaaacactgcaaggcaggtgtttctaacaaagccttaagctgatgtcgacatgccccacaattccttgtcactcaccagcacatccccgctggctccatgctagaagcaggcaaggagctgcaggtgcgtatacgatggaggtgagggagacagtgcgcatggaatgaatcaactcagtttgggagcagggagaactttattgaggttatgaatatattctacttgaaactggaaggataagtggttatgaatttgtggcttatggtaacctttgttaagcatctttctttttctttttttttttggtgagacacagattcactcttgtcccccaggctggagtgcaatggcgtgatctcggctcactgcatcctctgcctcccaggttcaagcgattctcgtacctcagcctcccgagtagctgggattacaggcatgtgccagcatgcttggctaattttgtatttttagtagagatggggtttcaccgtgttgccaaggctgatctcaaaactcctgacctcaggtgatctgcccgcctcagcctcccaaagtgctgggattacaggcttgagccactgcgcccggcctttttttttttttttttttttttaattattgagacggagccttgcgctgtcaccgaggctggagtgcactggcactgtcttggctcactgcaacctccgcctcccgggttcaagcgattctcctgcctcagcctcccaagtagctgggattacaggcatgtgccaccatgcccagctaatttttgtatttttagtagaggtgaggtttcagcatgttggccaggctggtcttgaactcctgaccttgtcatcctcccaccttggcctcccaaagtgctgggattacaggcgtgagccacgacggccggctgttatgctcatcatggcacttaagagatgcttaacaaacctttcctacaatgttcctcagattttcagagcttatttgatctagcatctggttcctaaattctgagtcacatcagaagccaaacttgaatgcttttggaaagagctagcctcataccacttcagttgggaaggggagtactgaggtgtaccttggcaggacagtggaatgattgctggttcttctagtttgctctataccaagaactgctataacatgtttctaaaccagggctatgcaaagcactagagttcctgaccagcaatgcaaaccagtggcatacaaattcaaaatactgtatacaggccctgactccagcccaaaccaaggctggagggcatccagggggatgtggttccccacggggtagcatcttggttatgtgagatcaccaagacaccaagcctgttttatgagctgaatcctcagcttgttgctggatttgtggctgataaaaaatacaggcagggcccagtggctcacgcctgtaatcccaacactttgggaggctgaggcaggcagaccacctgaggccgggagtttgaaactagcctggccaacatggtgaaatcctgtatgtacttaaaaatacaaaaattacccaggcatattggtgagtgcctgtcatcccagctactcggaaggctgaagcaggagaatcgcttgaatctaggaggctgcaggttgcagtgagctgagaaggcgccactgcactccagcctgggagacggaatctcactctgtcagtcacaacaacaacaaaaaaatagagcacagctatgttttgagttcttaagcaagggcaagcttaccaggcacttacagagaaggttgacgaggatgacagggaactaattgggggagggatgccatggttgaaaacatggctggggcagcgagaagttaagatgaagtcccaagagtcgcaagaacatgcagttccaggacgtgattctctgcagggacaaagagagacagcagctacaagtctataggcagtgacaaaggatctgagatcccatcagagtagacttcaagttggagaaaacttttattggcacaggcattccttgttaacttgacagggtgaagctgtaatttttcaaaaacagtaaaagctggtttctcctaaactattttccttgtggtagtagagatcagtgggtcagaaacaactcctgaccacttggtttccttttgagccgcgtcataaggaggcaatctgtaaaactagcacaggtctcccgctgttccactggctcacccacatgattagcagagtgcacgaaaaaataaaacttctattaaagaatcatgctgagcacaagatcagagaggttgtgacattgcaaactcgatagatgcagggggcctgggagactggcgttctccaaagggctcccaacaccgtctctcctctgatttctgtgacaaatgtggaaagctacttgcttggaggtactgggggaactgatgggggaactttcatcctgttaggaactccgctttccattcctgcgtctctgtcttgctccctggagatggatggatcacggagggggccacagtcagctggggcagcaggtactccctacggcactagtctacagggggaaggacgctctgtgctggcagcggtggctcacatggcctgtctgcactgtaaccacaggctgggatgtagccaggacttggtctccttggaagacaggtctgatgtttggccaatccagtccttcagaccctgtctgaaacttgtatcttacgtgaacttaaagaataaaatgcatttctaccccgatctcgcccccaggactggcacgacaggcccacggcagattagatcttttcccagtactgatcggtgcgtggaattccagccaccacttctgattcgattccacagtgatcctgtcctctgagtattttaaagaagcctgggaataaaaagtaaggtgcttttaaagtgtgacaagggtcaaccaatatagtcagactcatccttaaaagaccttaagtcactcatccctggccactcctgctgttggcccactagcacagtcctcaacaccacaaggcttctggagccgtggggcacacctccacgggcaagccccctgcccggtcacccttcccatcacaggatctggcgcgatgctgtgggaactgttgcaggcgttggctctgaagctgctcagagtctgccctcacagcaaaagggaactcctgactgcctggcacttaggaggagctcacagcctggccgtaggtccagggtttaaggctgtgcggtgggtagaacagagaaagccgagatggccacggggtgtggctcacaattcactgttcttggcaggaagggggcagccactcaccattgtcaccccagtcagtgttccaggagttggcaaccagccagtagggtgtgccattctccactccccagcccaggatgcggatggcatggccacccatcatctctccggtgacgtgttggtacactcctgaaaagggaagaactggctgagaccgagaccgggccactgtcccacgccccacagcaccccccacactcagctggtcatgctccgggaaggagaaacagcttccagagggaacctgctgctccaccaggaggctccagggggggtcccacaatactggggaattaaatatatttttgaaggcccaacacactcaaagttgttgagtaaatattgaaatagattcctacaaaatgtgcttgttggctttaaaaatagaatttctaatacattctaattgataaaacatttaatgctagatgactgattcatctgttctttatactgggattccatgtaagtaagggtttgtcaaaagcgttacacggcttaaagagttttaatagctgctccaggtacaccctgaagaggtgagggaggagaagggaggactggtggcagctaatgctagctgatgggaaagatactggctaaggggctcagggctgcccaaccaggctctcgggtggggaaatcactgtcaaagtggaaatgcatcttttaataataagggcgaggactatgctaagaagtgccatcttcacagaaactttttcttgccagaatcatcttcctttgtcaaactgttgttttacaagtttccaatctagcaaaatattaatgggatagatgcagtcagcaaagactgttcatctggagcaagggatttctaagacaggacttggggatggggactgtccagattccttggttggagtccctatggcactacccagggcaaggtcctccctgtgtgttcatccactggtgtgaggcacgatctaggcctttgcaaagagaaagatgaagaaaatgtgtcagccagtgcaaacacgaacggcctgccattataacagaaacatgctggtaaagcaatgcaaagccaggaaggcgagggcaggcgtggccagccaccagggaggggggcgttcccacagagaacatgtatgagctggacgctaatggatgggaaggaactagcccagaggctctgggagaggcctctggaattgtgtgtgttggcacaacacctggacaaagacagtcaggtgccaggctggtccacagaggagtgagcctatatggaaggccccacacagccctcttccccagcccctcacctgcctgcccaatccagccctattggtcaacatgaaccatcctggcacccaggctcccctcccgacccccaccctctattgccatcagccatcagcacgcacctgacttgtagagcaggaagtccgaatacacagagaaagctccctccacggggccgtttttgtagatctcggccatgatgtccttctcgctattggagacgctgtaggaattgtatcctggaaaatgaaccgagctcggggttggggagggcagtgaccgtgcctcgtggcacgccacggtcagccagtcactgatttctggtggcctccaggggaagactgcatctaaggggacttgccctgccaggggagctcaaggaaggctcccctgaagaactaaggacagggctggggctggaagctcagaaatgggagaacggagcaatgagcacgaggccccggaagaggccaggatacctcaagactccaggacacgccactcccttgtaaaaggagggctttggtcccttccagtttggaagggctgaggctgagttcagggtggaacaggcagaaagtggagagtgtgctgcttctcctggcaagagggcatcactccccctcctctatcctagagttccgggaccccaaggctcctcagccctgacctcttcgctgcagcgtgaggagggatgcagcagctccccagcctccacgtgcgccgtggccaggccccaggccccttaccgtagtgcttgtcctgtttgtaggtcgggctgtagccaggctcacagatcttgctacacttgggggtatctccctcccccgtgcatgggggccgggagccgttgacgtggtgctcacagggagggatggagtacggtctgcaccctgatgggacgcgggagaaagcggagtcaacctacagcccccacggagaagacctggggcaaggcaagcctcgtgcctgcagcatggacgccaggcaggtcctgccagaggcctgtgcacctggctagcacctctcagcagcccctctgtctcaacccccagtttataaaggcaaataaagccatgatggttaattgctcaaacaatccatctggccagaaagtggccaaggggacacacttacctacatgggattcatagaggccaccagaaaccaggccttttcttgtccagaagttccaagcttcagcaggatagccaccattacagctgaaaagacagcctctaatgaaaacctctgagagaagcaccaccagctctccagaccactgtgtgctacccaagtgcccgaggccactcgtggacccacccccagctgcagcaagtggtgcgagcagacctcccagaccccaaaccctccaagggacgctccctagataagcacagcttgcagggaataaccgccagccccacccctgcccacaaagatccgggagaagacaggaggctctcctgttcatgtccataccagaccaggctacgagtgcccttccgggtagaacactgattctcaactgagcagacgctaaacttccctaaggtacttaaaaacaccaccagttctctgaaatgagaatcgccagtgattcccatttaactagttaggggagaagcccatgcatttttttaagccctcaggcatttcggatctgcagccgccagtgaacaccgctactgcggaaccaaggcgaggctgcaggcagctggagcagaaagttctgtgccaccaccttgttgttaaggtggagccatccccgctaactacacataaggaaatgccccaaactggttccccaagcaggaaaaaggaacatgcgatgacacaaaccagaccaggggccagacattccaccacattttctgaaactgactgttttgctgggatgccacccctcagacagctctgccgggccagccttggttcaggcacctcccaggaagcagcagccttgccaggccctgcctgccagactctcggagtctccccgaaacacttctgactcgcagcagtcccaggaagtcctcaaagtcccctccactgagaagctggggcccagggtctctcagcactaaacccgctgtggaagcacagcctgactcacccgtccccacacatgctgccacagcatgtgagcaggtcctccgccgacacctccacgctgacgtgcgcattggtgtggatgcagatccggtcagagatggcttccacagccccgaaggcctgcaggaacgagccccaccgggtgaggctgccatgtccgggctgggccctctgcagcagtcccctcaaagggccacaggggcacctcagaccttgtaggcaactgatctctcaacaccaggggacgctcctggggctcaaactcagcttttattttctttggtagaaatggggtcttgctacgttggccagactggtcttgaactcccgggttcaagtgatttgcccaccttggcctcccaaagtgctgggattagaggcgtgatgagccacttgccccactctcctgcctcaacgatttgcccaactcagcttttaaagcaagagaagcacccccgtgaacctctgcctggaaactgggttcatttctgaaatctgcaaaatgtgtagtattagtttgtatgtgtgtgtgtggttttttttttttttcctggaggcggagtttcacttttgttgcccaggctggaatgcagtggcgcaatctcagctcactgcaacctacgcctcctgggttcaagcaattctcctgcctcagcctctatagtagctgggattataggtgcctgccaccaggcccagctaagttttgtctttttagtagagacagggtttcaccatgttggccaggttggtctcaaactcctgacctcaggtgatccgcctgcctcagcctcccaaagtgttgagattacaggcgtgagctaccgtacctggctgtgtttttttcttaacaaaaaacacagctcacccagaaaataaatactgttgtgatccacttgtatgaggtccctaggagtcaaattcatagagacagaaagtagagtggggcttaccaggggctacaatattggtgttaatggggacagagtttctgtcttgcgagctgaaaaagagttcgggggacagatggtggtggtggctgagcaacactgtgaatgtacttaatgctacagaactgtacacttgaaaatagttgctgggcacggtggctcacgcctgtaatcccagcattttgcgaggccgaggaaggcagatcaacaggtgaggcgtttgagaccaggctgtccaacatggcaaaaccccatctctactaaaaatacaaaaattagctgggcgtggtggcacatgcctgtagtcttagctactggggagactgaggcaggagaattgcttgaacccaggaggcagaggttgcagtgagccaatatcccaccactgcactccagcctgggtgacagagcaagactccatctccaaaaaaaaaaaaaaaaaaaaaagaaagaaaaagaaaacaaaagaagattgctaagattattacatttctgttacgtgtattttaccacaattaaatgacaaaattaagacagctcactgacactaaagggatgctttcttgaagcagagtagcagtgagagctcctggtatttgcggacgggccagcatgtcagggaaagggagctgcttcgccacctgtacacgtggacttgcaatctgctggatgctctgcccgccactccacctaatcctcgccatcattcatggccagagggattgtgatttttgtactgatggaaactgggactcagaaagtttctataacttgccttgtcagagttgtccccaccccgaatcccccaagactctccagtgttgctcccactttctctccagcgcttccccgccagccagcagggccttacccagcaggagccacaggagccctggtctctgatctctttgatggtgggacactgtggccattgttcccgtgcatcgaagcttgcaggcagcttcaggtcctcggtaaacataactctggataaaggaaggtcttcattacaagctctgatcccacaactccctccccaatccctgcaaaggccactttggctgggccacactcccctaacaaggaaatgagcacaagacatgccgaagaaggctgcagacaggtgtccttggtaatttcataaaacaaaaggaaattctgttgctcaatgcaccttttgattttttttttgggtgggacgggagggtgggagtggacagaatttcactgtgtcatccaggctggagtgcagtggcgagatctctgcccactgcaacctctgcctcctgagttcaatcgattctcgtgcctcagcctcctgagtagctgggattacaggcatgcaccaccacacccggctaatttttgtatttttagtaaagacagggtttcaccatgttggccaggctggtcttaaactcctggcttcaaatgatctgcctgccttggcctcccaaagtgctgggattacaggcatgatccaccacacctggcctgacttgcgatattgtacgcttctttctaggcttatgtaatggattttttaagatgaatttatccacaaattataaactcatttttaaataagtttattcagtccagatagtgtttcttgccctgctctcctgcctcaacctctgcccaggatcctctcatcatttctcatatcatccccattgtgcagaaggcagtgtcgtgcaacttaactaccccatcctcacgtgggaagtggcatcatctcagctcaccgcaacctctgcctcccgggttcatgcgattctctagcctcagcctcccgagtagctgggattacaggcgcccgccaccacgcctggcaaagttttttatttttagtagagacggggtttcatcatgttggtcagactggtctcgaactcctgacctcaggtgatccgcttgccttggcatcccaaagtgctgggattacaggcgtgagccaccatacttggcctcatctggcttttcttagatttcccttaaattactcaagattgagtctgcccacatagtggggacccagaccttgtctgtcacatctgcggctgagacaccttggagaagcacaatagaaaacactgggggtggctcatgccggtaatcccagcactctgggatgccgagttgggcagatgacttgctgaggccaagagttcgagacgagcctggccagtatggcgaaacccagtctctactaaaaatacaaatattagccgtgcacggtggtgcaagcctgtggccccagctactcaggaggctgtggcatgagaatcgcttgaacccgggagacagagtttgcagtgagccaagatcgtgccactgcactccagcctgggtgacagagtgagactctctcaaaaaccaaaaaaaagcaccagcatcttctctactaataacttgagaaggaaaaaataaaataaaaagagaaagtaatataaaaatgaaaagaaacaagtactgtacctcaagcggtgtcggcagccctgggcagcatgagccctgcggacgccagagaggccttcactctcccacttcccactgccccaaaccaacgcctgccactcacattacagcggtgcagaggagcaggcactcacctctggggtggcttgggcccacccaggaaggtaccacatagcctcttcaagtagctcatgtccacgttgtagaagttgtgcccggcctggaagagagtcacccactgactgaagggtctcccgggatggcggtggatgggcacgctgcccacacacgaagcccaacccagggaaaaccagagaccctacccaattcaagggcccaagggttggggggcactggggaacagcccagagtgacacacgggcagagtgggtgtctcccctgatctgctcccatttgctgacaatcagagaccctctccagccctcaacatggctcactcctcattcttggttctcagtccgagggtcagggctgggcagagacaaagggaatcaggggcgggactgataaactgccactgtgccacggcgggcgtcacaggggctagctggttttgaacacttccgaagctcacttactcccccacacacctccacgtgcacacaaccatatattcatacacatgcacacacactcatgcacacacgtggggtatgggacaaaggagggaggcgtggtccagagccgacatgactcagggtcagggccatttttcaacagtccaggacaatgttctgtgggccacagtgagggctggcttcccattcctggagtcagtgtgcacagaccgacctgggaggggacatacataggacgcagccccacagcctacctgccacgtggtattccgtttgttgacatagttgaccagctcatccgacaggggatggaaagagggcctgctccgggcattggccaacaccagcaggcagcagagggaggcccagagctgccacatgttggaagccggatcctagatccacctggagaggacagagggcatcaggacacctctctgttatgtgggtcgagggctcacacacacaggggcaccgtctcgggcatcagtggggacccccatgctcgtcctggcccaggcggagaactcttaaggagctgaggtgtctatgggatccccgcccccctgcccgaagcacgccatgacctcgtgtgggtccccgggggccaggcggccagagcccagagagagagccaaggggctgtgctggacgagaccgagtccagggccttcgctgctatttttaaacggcctttgcatggatttgtagaacagcttgagacactttcccaagtgagtgatatgaaacagttaagagcctgtctgtgtgattacaccctaagtggaggacccaggggacagggaaatgtaagaaaagttacaatccaggagtcctagtttcgacaggacacagacaaacaagctcggtgtgggctggtggaggttgaggctgagaggtggggctgggctggccatccacccactcccggggcctctctggtttttccagtcagccaagggctctgcttccggctgcggagatgaggcttctgagaaggaaaactctcacctcgatgccccagccgtttgatcttgcactggctcatgagtcacaagccagtgctttccagcttgaactctgagtcaccctcctaagtgagcagctcaacaaaagcaatacatgtctcctgggcgcctgcatccagggctggggagagccgcggcgcggggagctgggtgaggcaggggttcctgtcagtcactccaggggctcccacgggtgggtgaggtgttctacctcccacaggtcacaggtcgtcatgaaagtcacaggactgcggtgtcagtgcttaacaaactgcctggcacctaggggttctatctgaagaacaatttaaacttcattgttgcttaagcaacaattcatctaggagaataaatatatgaggacagcaagatggctctggaaaaaagctttttttttttttttgagacagggtcttggtctgtgggccatgtcacccagtctggggtacagtggcacaatcttggctcactgcagcctccacctcccaggttcttagcctcccaagtagctgggattacaggtgtgcgccaccacacgcacctaatttctgtatttttagtagagatggggttttaccatgttagccaggctggtctcgaactcctgacctcaggtgatccactggcctcagcctcccaaagtgctgggattacaggtgtgagccaccgcacccagccagtggaaaagagctctgacgggagcccagccctctggggcagcacatgtgtcgtaaaatgctgggtgatgctcatcagcacagcacccaacggaccactcagaagcacatcctccgtggaggaatcagcgttacctaggtgaggccagagaggaaacaggacagtgcttgtacaagtggctgcctgaagtctgaatcttcacactggactcctcacacacaaaaagtaccacatgcaacacagaattgttttgtttttttgagacggagtcttactctgtcccccaggctggagtgcaatggcatgatctcggctcactgcaacctctgcctcctgggttcaagctattctcctacctcagcttcccgagcagcgggattacaggcatgtgccatcatgcccagctaattttcatatttttagtaaagacagggtttcaccattttggccaggctggtctcgaacgcctgacctcgtgatccacctgactcagcctcccaaagtgctgcgatgacaggcgtgaggcaccgcaccaggcccacagatcttaatttaaaaagttttatgaaaaaaatcaatgccctttgaaaaacaggctgggtgcggtggctgatgcctataatcccagtactttgggaggccaaggcaagtggatcacttgaggccaggtgttcaacaccagcctggacaacattgtgagaccccatcaatatagaaaataaagttttttaaaaaggtaatgctggaggaaagcttaggattgacaggaaacacagccttcaagggaaaatgcttgcattacactgaaaagtctctttaaaacaaaaactgacgaaacaaagcagtactcacatatactttaggcttcgtttccacaaaaggctcttcaaagtcagaaaaatggaaccagcataatagaaaaactacaaatggccaacacagataaaaataagttcaaccggcatggtggctcaagcttgtaatctcagcactttgggaggctgaggcaggtggatcgcctgaggtcaggagtttgagaccagcctggccaacatggtgaaaccccgtctccactaaaaatacaaaaattacccaggtgtggtggcaggtgcctgtaatcgcagctacttgggaggctgagacaggagaattgcttcaactcacttgaacccaggaggtggagattgcagtgagccaagatttcaccactgcattcctgcctgggtgacagtgagactctgcctcaaaaataaaataaaataaagtaaaataagttcaacctcagggaggtgcagataaaatcaaggaggtattcagcatgtatcagattggcaagggctggacagtttggcacttcttgcagggcttaggaagtggggaaacggaaggcatgataatgagtgcctggggtgggtgggcacaaccaccgagacatcaaccagcaacgcccaccagtttctaaatctgcatgtcctggaaatgaatcaagtatccaataacagagtaactgttaaattacggtaagtggttaaatagaatatgaagcaaccattaaaaaagcaattagttggtggggcacggtggcgcatgcctgtagccgaggcggttggatcacctgaggtcaggagttagagaccagcctgactaaggtggtgaaaccctgtatctactaaatacaaaaaattagccaggcgtggtggcgcatgcctgtaatcccagctacttgggaggctgaggcagtagaatcacttgaacccaggaggcagaggctgcactccagcctggacgacagattgagacttcatctaaaaataataataataaaataaaagtaaaaaaccaactagttgaagtgaattctattgtattaacagagtaaaaatgccccaagtcccaatgttaagtggggaaaaagcaagctgtgggtgactgaggaccataagcatctgaccctctcagcaatctacacatgtaggaacactcctgccactacatgcaaaatgccaaggaagatgcacggcagtcggtcactacggtggggagactttttttcacaacatacccttacttttaagaaaaaaaaaaaagtgagtatgttcctattatttcagttttgtttcttctaggaaaaatagttggcagtattactaaaggccctgagccaccaaactgataaaaggacatttgttttaatgattcctcagagcatttccaatttggtcttccttcccaccaatgaggcttcctccctagtgactttgagatgggagtctcgctctgtggcacatgctggagtacagtggcgcaatcttggctcactgaaacctctacctcccaggttcaagtgattcttgtgcctcagcctcctgagtagctgggattacaggcctgtgctaccacgtttggctaatttttgtagtatagtccgtgtttcgttatgttggccaggctggtcttgaactcctggcttcaagggatctaactgcctcagcttcccaaagtgctaggattacaggcatgagccactggacctggcccctagtgactttcttaataatcttccccttttccgtgactcgtgggtaggcagcgtctcacgtggccatgcatgtcagtgacccacacagcctccacactgtgaggttagcatgtctcgtgggcagacagcagtgtccttggatgtacccgggggctttgtgctgtagagatgttattttaaataataagccaagtcgaggatgggagcgtttccatggcaacttgaattttaaaaccaagatttctttggttactgtggtggctgagaacacaggcagctgccatgtccagtggctctcaactcctggaggacaacctgccgtggccattccctggagtcccacagggccccctcgccacttcactagcaggcgacttccctgcacccgccctccttttcatggttcccaggccctcccacacctccctgtgctccctactcattcccaggctccccggggccaccgctgccagccccagggcccagcccattccactagtcccaggctgagcgctgggaagttctttcagccccgcaccttggcccagggctgtggtgttcctggcttctctgctcctcccctatggtatccaggttggggctcaaggggccgccagcgtgctgcaaccggacgataaaatgagccctgcacttggagtcaggagacctgcatttggatctggctctgccactgactaaatggcacccttggggtctgaccttccccaagcctcagtttcaccacctataaaatggagctagtaaccatcgtgtctcaggtggcagtcaagaatgaaatgaggaggaccaaagcgccggcacatgcctggcatgcagtgataaggtaggaagggcactcgctccagcgggctctgttccctccctctctcctctaacacttctagctctcagttcacactaaacctattccaataggtccccaacgccaggaagagtctaaatgaaaacaagtttgttttttttgtttgttttaagacaggatctcactctgttgcccaggctggagtgcagtggcacgatcatggctcactgcaaactctgcctcctgggctcaagagatctgctcccctcagcctcctaaggagctgggactacaggcatacaccactacgcccagctttgtattttttgtagagatggggttttgctatgttgcccaggctggtctcaaactcctggactcaagtgatctgcccgccttggcctcccaaagtgtcgggattataggtgtgagccaccatgcccagtaaaacaagctcttaacttcaattaaccccagcatttaacatccaaaaatgcttccactcttgagggtcccgagactgctgagaactcaaaaagtgtcaagccaaacacagaggtcctgacagcagtggcaatctcactccattgtgcaacaggcgcctttctctccacaacaacgcaaatctcaatcactctggacaaatgcagatggtgaaagtgacaagctgagctgttaacagctttccagggtctttgcatgggacagcaacccattttcacttccctttatataggcacccacttcccttttatttcttaattctgtgctttctgctctgcttcttacaagagatgatgaacacaaagtccttatttcacgagggaaggatgtgaactcttgtgtgccacaagacccctttccaggatgcgggctggtggaagaacagctgcgagcagatgtcatctctagaccttggtctgctgtgctgcttaggcagacctgagttccagtgcacccctctgccccttttccaagctaatctttgggttaaaaaaaacagaaaagggtgctcctcatatcctctctctccaaacctgcagagcacttatgagaaagcacgctccaccccggctctgtagaacgttgttatgtgccaaaaagagtgtgcggccaggcgactctatcaaccagagcaccttcctcccccggcaaacggcaccctagactaccttgaagccgtttccaggacaaatagggaccttgcgatcctggaaggaggtggaatgaaagtcaaaggagaggaggtgcggctaagtcacaggaggtgttaagtcctgacacccttaaagaatcagttttgggctgccaccaagctcaataaagaaggctttctggccaggcacagtggctcatgcctgtaatcccagcgctttgggaggtcaaggcaggcggatcacctgaggtcaggagttcgagaccagcctgtctctactaaacaaggtgaaactcctgtctctactaaaaatacaaaaattagccaggcacggtggtgggtgcctgtaatcccacctacttgggaggctgaggcaggagaatcacttgaatccaggaagcggaggttgcagtaagctgaggtcacaccactgcactccagcctgggcaacagagcgagactctgtctcaaaaaaaaaaaaaaaaaaaaaaaaaggccggacacaatggctcacgcatgtaatcccagcactttgggaggctgaggcaggcggatcacgaggtcaggagttcaagaccagcctggccaacatggtgaaaccctgtctctactaaaaatacaaaactcagccgggcatggtggtgctgcctgtagtcccagctactcaggaagctgaggcaggaaaattgcttgaacccaggaggcagaggttgcagtgagccaagatcacaccactgcactccagcctgggcgacagagcaacactctgtctcagagaaaaaaaaagaaagaaaaagctttcttacatggtcacagagccctcaggtagactgcactttaaatctgtaaaggatttaaggagacaggatatgtacacttaaaatttccaaataagccaagttgctagctcctggctgatagacaaaaaaagtgaaagaattcttagcaaagctgtcatgcagtattttgctcttcctcattcgttggtgctgtggctatactgctggctcctctcatagtcagctctaaagaattgaaagttggccgggcacagtggcacacacctgtaatcccagcactttgggaggccaaggaggtggatcacctgaggtcaggagttcgagaccagcctggctaacatggtgaaatcccatttctactaaaaatacaaaaaattagccaggcgtggtggttgtgcacctataatcccaactactcgggaggctgaagcaggacaattgcttgaacccaggaggtggaggctgcagtgggctgagatcgcaccattgcactccaccttgggcaacaagagggaaactccgtctcaaaaaaacaaaacaaaacaaaacaaaaacaaaagtcaagtgcttacattttgccagaagccacaaatgaagactgtgccttataggccagcagagcggctaagagcacgggaacagtggaaaggtggggagactgtgaaggctcagtaagaccttcccagagtactttgtttctttctcttctataaaaactagtcttggcactcaccgctaataacggcagttgctcctgaagttttgaccacttaagtgcaaccacaaaacaagacttcggcgagtttcatcttcccctacttcaacctgccagacacacctcaatgctggagcagccctgcactgggtgggagtgtgctgacctcaactatgctctgttgtgacccagagacctttcctttttgagtatgaatcacagccttgctgtggcctctgatgtgttacgtctttgcccctaatggaactgtgtttagtagattcttggcttatgattaaattaaggacaaaaacaaaatccaaagggctctcaggcctcggtctcatcagtcccctgatgaacgggcaccagaggcccatctgtcccatggagcaggctccctgcagctgtagccccgaagcaactgaaaacctgtcagaaaacccacccagcacacaggtgtgcagaggcagcagtgatgctcaccagccttggaggcttccagggaaccaggggaagcagagaagccccactccacctccctcacctgaaccaggttggccactcacaggtccttccccgtgctgcccacctgccaatcatctatgcaaaccaggtactgcaggcccagcccacgcaagctgctctccataggcctgaagacacctatgagtggaatattgtacaaggtcagccacagcaaccccacatcctgcagacaaaatgactactgtacacttgaaacagcagacactacgaaggccctcagcagttattttttgttgtcgttgttggttgtaaacaagacaatttagtcaatattctggaaagttctgaaagcttttactccccatttctgttactgacttgctcagatgctgacagagccaatgcattcaccacgtctgcatcggataccaaaggaccttgggcctgctttataaaagcttttagagatcctttgagattgcaatgagattagtgttctgctcattagtgttctgcctctccagcttgcagaacacggcggttccctaattcaaccgcaggcgagattacaccagggtagttgaggctgacgcgaaggccagccacagaaaggcctagctctgggccgggcatgctggctcacgcctgtaatcccagtactttgggaggctgaggtgggcgaatcacgaggtcaggagatcgagaccatcctggataacacggtgaaaccccgtttctactaaaaatacaaaaaaatagccaggcatggtggcaggcgcctgtagtcccagctactcgggaggctgaggcaggagaatggcgtgaacccgggaggcggagtttgcagtgagccgagatcacgccactgcactccagcctgggcgacagagtcagactccatctcaaaaaaaaaaaaaaaaagaaaggcctagctcttggatccagctaggtcctgttttcctcccttggggccctgggaacagatacccatctcgcaaggctgatggaagatacaaggagacactcttttgaaagtgcctaccctgcaccaggctcagagcagcgccatctgggagaaacttcctcagtcactgggagcgtgaaaagccatctccttatacataggacagccaacgtttgcatcccagagtcatcatttctattttcagaagtatcctaatttggatgaaaaataatggaaattgtactatcagtgacaaggccttaaaagttgatttgttctgctgtcttgactgccaaagcaaagcatgtcccaaacaccaggaaggctgagtgggttgggaatgggtggcaggtggcccccagcactctgatgtggtttgatgatacgcttccaaccctcgaatgggaaaagcctgtggctggcaccgccctcctgggacttgcgcaagccaggaagctgtgtgactgtgtgtgtgcacattctgccagagtccaggtcagcacgtcagagggtcatgagacagcccggccctccgggctcttagggcagaatatctagatgtcttctacagggctctctactggtcccgttaccatcttggccacattgggcccatccttctccatgcatgcttgctggtgatgctagattatcttgatgaccagaccaaagaagttactggcctggtaaagacagataacacagtcaagactgccagccacacatccttctcagcacccagcatttagaaaacatcagttctgggctgagcacagtggctcacatctataattctgacacttcgggaggccaaggtgggaagattgactgaacccaggagattaagaccagcctgggcaggatagtgacctcgtctctatatagaaaattaaaatttaaaataaaaaataaataggctagcggtggctcaggcctgtaatctcagcacttagggaagccaagacaggcagatcatgagctcaggagttcaacaccagcccgacaaacatagtgacatcccgtctctactaaaaatacaaaaattagctgggcgtggtggcacacgcctgtaatcccagctactcagggggctgaggcaggagaatcacttgaacccgggaggcggaggttacagtgagccgagattacaccactgcactccagcctggcgacacagtgagactccgtttcaaaaaaaaaacaaaaaaacccagcaaatatgccatcactgaccaacaataaaaacaggaaaagtgtcactcaacccatttatgccagaggttgcaattttttaaatttttgcacgagtaaaaacatcagaccttggcgatgaccttgagcagtatgatgtaaaaactcccacatgcttagcgttctaataatggaacactaggcataagtgggttactgttgtcctacagcaaagattaaatttgaatttctggtcatgaaattaaaacaggggtaccacttcaaacccatcagattggcaaaaatcaaagtctggtactatctagtgttggtaaatgtgaggaacaggaactctgcacactgctgggcgagtaaattgatgcaaccacactggagaaccctttgccagcatctagcaagatggaagatgaacacacctcatgacccagaaacaaactctcccacatgtgccctgcagaaactcttctaagtatctgggagacacaggatatttattgtagcatgggataatagtgaacacgaaataacataactgtccctcagtagataaacacactgggcacttaacacaaatggactagaactggatgtagcaacagaaataaatctcacaaccgtgagtgaaaaaggatccatgtagtgtaactgaagtcatataaactttaataacattgtttatacactgatgcagagttttaaaagtacaaaaaggcctggaggtgactcatgccttgtaatcccagcatttggaaggcctaagtgggaggaggcaaggggatcacttgaaaccaggagtttcagagcagtcctggcaacagtgagaccctgtctctaccaacgaaaaaaaaaaaaaaaaaaaaaaaaacctgggcaccgcctgtggtcccagctacttactactcgggaggctgaggtgggaaccagatcgcttacatctgggtggctgaggctgccgtgagccgtggtcgcaccactgcacaccagcctgggagacaaagcaagaccctgtcattaatcaaacaataaatgaatgaatgcatgaacaaaaaaatgtgcagaagaatccaaaagaggggcagcagacagggaatacaatggcccttggaaggatcaggaaacaggcacaggagtggtctacagaggcggacgataaggcttgaaactaaaaaagagattagttaaaagtctaaacacatggctgggcacagtgactcacacctgtaatcccaacactttgggaggcgaggcgggcagatcatttgaggtctctactaaaaatacaaaaattagccaggcatggtggtgcatgcctctaatcccagctactccggaggctgaggcaggaacattgcttgaacctgggaggtgaggttgcagtgagctgagattgtgccacggcattccagcctgggtgacagagtgaaactgtctcaaaaaaaaaaagaaagaaaaaaatgtctaaacacagagtggaatttgatccctaaacctcctaccccacacaagctagggtaaatataaacattaacaaccatgccagggcgcaaggtttgcctcccacatgctctttctcaggcagcctgggaccagacgtagagactgctgcctgccaccctgatatcccagaggcacagcacatctgtacatgcctcccctagactcaactgcctgtcaccccaaccatctccctttacatggaccatgtggaagtgcccagtaaatatcactcaaccgcacatgtttccaataatttccttaggccagaccattgaaaagaggcagcagactgggcgcagtggctcatacctgtaatcccagcgctttgggaggccgaggtgggcggatcacgaggtcaggagttcgagaccagcctggccaacgtggcaaaacccccacattgggatttttttacattggatttttttaggagagacaaaaaatctctactaaaaataaaaaaattagctgagtgtggaggcacatgcctgtaatcgcagctagttgagagactgaggcaggagaatggcttgaacacaggaagcggagttgcagtgagctgagatcttgccactgcactccagcctgggtgagagagtcagactccacctcaaaaaaaaaaaggagagagagaaaagaagaatcgacatacctgtaactcctccctctcaatgtttcagtccatatctcgaaaggacggtatgttactctacacaaccacaactcattaccagatttaagaaaattacccctccaccgcgcggtggctcatgcctgtaatcctaccactttgggaggctgaggcggatcacttgagatcaggagttcgaaaaccagcctggctaacatggtgaaagcccgtctctactaaaaatacaaaaaaaaaaaaaaaagccaggtgtggtgatgggcactggcaatcccagctacttgggagggaggctgagacaggagaattgcttcaacatgagaggcggaggtggcagtgaaccgagatcgcaccactgcactccagcctgagcgatagagggagtgtgtctcaaaaaaaaaaaaaaaagaaagaaaaagaaattaagaaagaaaagaaaatcactgacagacatcccaaggcacccctgaaacgtgacctcccttcaattcacttcccaatccaaccaagagcaacagaaaatatctgttacccctaaaatgggtgcaacttctcttccaactcccaggtccagcagctggggaaagaaaagaacctgcctacaaaaagagcctccccagtctgctaaatcagcaccacatgggcagtttcaacctggaaccaaagggccaccacccctcaccgcctaaccagttggaaacagggctgtcctgagccaacacccaggagagctgtgccagggccgtgtctggcctgcgttgccacctggggagcaagggacctgtgcctttccaccagggggtacccccagctagaggacaaatgaccaaagacgaagggaagcctctgttctccaggagacgtttgactctgtctttgggaaagctacacagggtgggcggcccagcccctttctccaggagctggcgggttctaagtcaccagcaccagagccaacaagaaacagttcttggccaggcaccgtgactcaccgggaggccgagacaggcggatcacctgaggtcaggaggtcaagatctgcctggtcaacatggtgaaaccccatctctactaaaaatacaaaaattagctgggcgtggtggcgggcacctgtaatcccagctactcgggaggctgaggcaggagaatagcttgaatttgggaggcggaagttgtagtgagccgagatcgcgccactgtgctccagcctgagagacagagccagccaacgccctcttaggcctcttcgccttacgttcctgaacgtttggattcaaagagagtgcatctcagctatcctctcctccggcagcaggcagtgggaatgtttttccaggctacaaaaaggtgccaggtctgcatttgaaccccacagcgtcacttctccagtgggtttggggggtctctcgtccgttaggaggaggagtgtggggcctgcgctagggtccttttctttgccagcctgctggctttctcagcgcctgggaagggggtgacagaggcccaccaggaagccaagtgcaattcacttccacctgggtcgcccaccccagcctgcctgcaacgccccacacccagcacccactgctccccagaggccaactccccccggcctccagggctactaaccgagggggaggtggcgccccagggactctgcccggcctccctttactggagtccaggagcagggtgcgcccccggccttctccccaccggcatccaatcgcccattcgcctcttggtttcgctgtctggtttctcttcctgtttatggatttaacaccgtgcggcttcctccccagcccacccagtgccagattcctgttcttcaacaggacctgtcttctggggtcccaggaattgcgtgggatcttgcgcagaaagttggccaggcaaatccttcgcaatgagggggaaataaaccgaaaatagatgccggcagatgcgattatgtcggcagtttggcccggagacaccgaggcccaggcgctgggagcgcggtcccaggcagcagtctccggacccggccgagctcttcctcgcaggcgcctccctcggcggtcctggccgcgtccccgctccgagggccggggtccggcgcacagcccggggaggggagcggagggcagagggctggcgggcggagctgttttctgcttttctcgccgacgcttcggagcgcgcggactcccaccccagcccgcccgtcagggacagtcccgagggtcccggctccccgccggcccccagggacgccgcggggccgcgcctgggcccgactgagggcgcagaggaacccgtctcggcggccgggtagcaccgtccccgccaaggtcacttacgctgcggtggccccgggtccccagcactcacccagcgctgcagccgagagcctgcagcccagcctgcgcgcagcggagcggttggcgttgccggagcggttgccggagccctgcagccgccgtagcctgggccagccccggccctaagtaccctcccggccccgccccacgtgaccaccgcgcagccccgcccgggccctcccgccgcccgcgcacggtgcttcccagcccccaccccctcccgccaccttccgccgcccgcgctccccgcttcccggccccgcacaccccccgcccccttccgctcggggtccggggccaccgccgggggcgggcgggggcctgagcgcgcgggctggggaagaagggcttggagccctgcgggccctgggtggcgaaacgctgcgaattggggccaggggatggggaaaaagcccctaaaggtggtcccaaggcccccaccccgcctagaaaagtccccccgcctcgcgggaccgcctccgccagaacccgcgcctgggatccctgcctgccgagttggcgggggtggggtggtggagagggcgccgtcgcttatttcattcattcagaagccgctgcagaggctgggggtggcgaggctgtggaccccacagaacagcctttagaagggccactttgttgttcagagaacgtacccacaaaacactacagctacgtacaaatagaaaagagtggctgtcactgcgaaggaacctaggagctgcgtcaggatttctaagaggagaaggaccttgggggcggaaatcggtttggcacaggagtacccggagacctgctccgagaggacggacaaagtgcacatttacttggggtttattaccgggaggccctggaagggagatgcaggggttggctcaagactcaccctcctccagacactccccaaacagctttaatccttaagacaaacctgcaaagcaggcatgaccccagttgtattcaagaggctcagaggggctgggttcggtggctcacgcctgtaatcccagcattttgggaggccgaggccggtgagtcacctgaggtcgggagttcgagaccatcctgaccaacatggagaaaccccgtctctactaaaaatacaaaactagccgggcgtggtggcgcgtgtcagtaatcccagctactcgggagactgaagcaggagaatcgcttgaacccgggaggcggaggttgcggtgaccagagatcgcactattgcactccagcctaggcaacaagagtgaaactctgtattaaaaaaaaaaaaaaggctcagaagaatcgtattttatccaggctgtggcgacagtaagaaggcagtagccgggtgcagtggctcacgcctgtaatcccagcactttgggaggccgaggcgggcggatcacgaggtcaggagatcaagattatcctggctaacacggtgaaaccccgtctctagtaaaaatacaaaaaattagccgggcgtggtggcgggcgcctgtagtcccagctactcgggaggcggaggcaggagaatggcgtgaacccgtgagctgagatcgtgccactgcactccagcctgggcgaaaagcgagactccgcctcaaaaaaaaaaaaaaaaaaaaaaaaaaaggcagtaggactgcatgggacctggttccctgcagcctggtcgtcagctgtcacacagccctgagcctgtcttcagagacatgcctgtactcccgcctggttagtaacaaactaaggataggagtggaaggaaaaaataatctctggagcccaaacatggtcactaagcccccagcagagtgggatacccgaggaactgaggaccaggaggctggaggtcaaggtggtcccaactgcctgctcaccctagtcatatcctgacagccatggactctggactccaaatcatttcagacctctataaggagctcataagatggccaaaatggggaggacacagccagaaccaggataactctcccctctctcatccttagagtgtgacagaaggtatgcagagcagagtgcttgacatgcgttatggctatttgatggaattttccatcagtgtcattatagaaatcacttttgagaggtaaaaatcacttttgaaacaaaagaaacaggctaggcgcggtggttcaccactgtaatcctagcactttgggaggctgaggcaggcagatcacctgaggtcgggagttccagaccagcctggcccaaatggtgaaacccagtctctactaaaaatacaaaaattagctgggcgtggtggttcacgcgcctgtaatcccagctacttgagaggctgaggcaggagaatcgcttgagcccgggaggtggaggttgcggtgagccaaaatcacgccattgcactccaacccgggcaagattccatctcaaaagaaaagaaaagaaaaaaagaaataggccaggcgcagtggctcacgcctgtaatcccagcactttgggaggccaaggcaggcggatcacgacgttggaagttcaagaccagcctggccaacatggtgaaaccccgtctctactaaaaatacaaaaattagctgggtgtggcattgcgggcctgtaatcccagctactcgagcgctgaggcaggaggatcccttgaaccagggagtcagaggttgtagtgagccgagatcacgccattgcactccaacatgggcaagactcctcaaaagacaagaaaagaaatatattactaccagagtagaattcgtcccttcctggaacatccaggaaagcttcatggagaaaggaacatacagcatatttacttgtatatgttccttcctgccctcactggatcttaagccccacccaggcaagcatttttacctgcggtgttcccctgcttcatcccagctcattgcagggtgtctggcccatagcagaggatagagaaatgtgagttgagtggatgcataatgaatgaagtaggccttgaagttgaggagaattttggcttaacctgctagatttgggggtcagggttcagggcctggggaacagctctcagaacttacagagaggccttgactcacgtgtgtaaaagctgtttgcttgttgaacatccgtaaaagaggcctaagttaacacctgaaagaggtgaaaacatacgtcctcacaaaaatccgccgggcacagtgggctcacgcctgtaatcccagcactttgggaggcagaggtgggtggattacttaagcctaggagttcaagaccagcctggggaacatagtgagaccccaactctaaaacaaaagttaataacgtatgtataaacttacaccagatgtttatagcagcattatttacagtaaccaaaaggtgaaaacaactcaaatgtccatccattaaaaaccattgcacgaataaacaaactgtcataaatccaccaaatggagttttattcagtcgtaaaaaggaatgaagtagtcacacatgctacaacatcgataaaccttgaaaacgtttactaagtaaaatcagccaggtccaaaggactcagtattgtatgattccgtgaaatccacatgggaggttaggtaggtgacagctaaagggtgtggggtttctctgggggctaatatgaattttttttttttgccgagacagagtctcgctctgtcgcccaggctggagtgcagtggtgcgatatcgcctcactgcaacctccgcctcccgagttcaagcaattctgcctcagcctcctgagtagctggggttacaggcacccgccaccacactcccctaatttttgtatttttagtagagacagggtttcaccatgttggccaggctggtctcgaactcctgacctcgtgatccacctgcctcggccccccaaagtgctgggattacaggcgtgagccacagggcccagcctaattttgtattttttgtagagacggtgttttcccatgttgcccaggctgatctcaagctcttgagctcaaatgatcctgctgtctccgcctctcaaagtgctaggattacaggtgtgagccacctcgcccagcctgatttaactttttaatttttaaaaattatccttgaatacgctacagtgcccaactattcagtgttgaaatgaactggatttcttatttggctgtgattgtttccagtattttcagaaatatgtctccattcctatctaaactctaagttggttggtgtagggtgctgtcttattcatttatatttctccttcctctcttctcaaaggactttcgtgccctttacccctccttccagcagggaggtatgagccgtgcctctgggctccttcttcttcctcccgacagctccctttctgtggtgtgactgtcatcagagggagggaaattacagtgccttggcttcagagaactaagtttctggttctagccttatgagggctgaccacattgttttttttttttttctattggcttccagaaggattcctctttattctcctacagtgtctcctttgtggcttatcctactgcgagagcacttgtttaactgcgagcaaaagagatggctgctcctctaataccggtgggggcctcgactttcacatgaactccctcggaagggaagccatgtctgcagccagggtctcagcagatgtccacagcccccaaagctttgcctccagaggccaccacttcccaccatttctgtttctggtggggccccttcaattctaactatggcctccccaccacagaagagcagggtttactcacttgtcctcttccatgaagagcaaatgtattatctcacttggggtttcagttgcccttgtagttttatttatttttatttttcatttatttaattaaaaaaaaagtttgagacagggtctcgctctgtcacccaggctggagtgcagtggcaggatcttggctcacggcaaccttcacctcccgggctcaagcaatcctcccacctcagcctctggactacctgggatcacagacgcatacaaccatgcctggctgttgttttttattttatttttacagatactgggtcttgccatgttgtccaggttggactcaaattcctgggctcaagcagtgtgcccgccttgccctcccaaaatgctgggattacaggcatgagccaccacacccagaccttgaatacagtcacattctgaggtactaggggttagggtttcaacatacaaacttttgggggcctaattcagcccataatactatgcttgagaagagggctgcttcagaggcaggctgtttggaaactctggagaaaaacggggtgagaacattctgtttcttttttttttttttttttaagacagagtctcgctgtgtttcccaggctggagctggagtgcagtggcctgatcacagctcactgcagcctcaacctctcatgctcaaacaatcctcttgcctacgcctcccaattagctggggctacaggtgcatgccaccatgcccagctaatatttattttttgtagagatgggatcttgctgtattgcccaggctggtctcaaactcctaacctcaagcaattctcccgcctttggcctcccaaagtgcggggattacaggcatgagctaccacgcctgatcttgagaacattttttatgtcaacaaggtagtgagcacaaaacgaggaggggcaaggccagtcatccctccacaaatgctagctgagaacctggcctgtgacaggcactgcaaactggaagttaaagggaaactttgctataagccacctaggtttggtgccatatgtattagtaatcacaataaatttccttgaacgtaagtgcaatagcaagtgatccttcctatattcatttaaaaatctttgtgttggccaagcatggtggctcatgcctgtaatcccagcatttttaggaggccgaggcaggaggatcgctggagcccaggagttcgagaccagcctgggcaacatggtgaagcccgtctttacaaaaagcacaaaaattagctgggcatgatggtgcatgcctgtggtcccagctacttggtaggatcgcttgagcctgagagctggaggctgcagtgagccaagactgtgccactgcattccagcctgggcaacagagaccttgtctccaaaaaacaaaaagaaaactctgtgttgtttcctgatttataattagaggtagcattcattcattcttttatactgcagccaagaatcttcattggtttcacatataattctggtctggctgcctggctgatactaaatttctacctttacgctgttaagccatcctaaatggtagtacctctttgctgcctgtagctgtagtcagaagagggttcagtagtccctgttaagaaggactcttggggactggagatgtattcatcagggtaataatgcaagctgctataataaacaagcccacccaacaatggttaatttcttattcaggttgaagaccgtgagggttcgtaaggggggagatgctgcactctgaggttcctgagggactcgggctgctttgggatgcaccaccatctcctacacatggatgccagggtccctgctccaggggagggagagaatgggaaaaaccctcctgtcttgaaaactgtcccagcctgcgagcaggatatgtgctccattgatgacaactatttgaatgtcacagagttggggaatgtggttaagctgcattcccagggaaaaaaatacggtttggtgggctccagcttatctgagccacaggtgtatgatcctggtactaccacctccccgatggttccttgggggaagttccttaaactccctggggccttcctcatctgcagaagggttgtgacgatgggctggtgtcacaaggctgttgtgagatgagggagttagtacccctggtactcagtgagagcaagctcagttcaccttagctaccacccagccctgcaaaccacctgcgctcctacaactccttgcagtttacaatgcattctcatcttcataactgtttctacttttagcttctcagcaagctgtggggtaggcatttcacagatgagaaaaccgaagagaggctgggagatttgccaaggtcacatggcacttacacagctcagcctcctgactcagtccagcacttttcctgtctctttgcggagatcacagttaccaccttgagtgcagtgtggccccctgggcccaccccaaagctgctgggaagtttgcggagaaatctgagtcacagaaaaatgaggcatctacttcagatcctataccttggcgtttcacggaatattttggagtgttttatcctaggtagtaaatttgacttcgctgtctgtgaaaaatagatctgtgctgtcaacggtggacactgaatgtccacctggcaaacttatcagttcagtttctgtggacaagaagaggaaacaattggatttctcaatcatttttggtccagtccgtggtccaaatggaagagacagaccaggtgtggtggctaatgcctataatcgcagcactttgggaggccaaggtgggtggatcacctgaggtcaggagttcaagagcagtctggccaacatggcgaaaccctcgctctactaaaaatacaaaaaaattagccaggtgtggtgacaggtgcctgtaatcgcagctacttgagaagctgaggcaggagaattgcttgagcccgggggcggagatttcagtgagccgagattgcgctccagcctgggtgaaaaagcaaaactccgtctcagaaaaaaaacccaaacagaagagacatttcagtaccacaggccagcagaaaaagcttctgaatgagactccttttgtaggtggagtaaaggtggacagtaaaccactcccatttccatgcatcattgttactctgacttatttatttgtttgtttattttttgagatggagtctcgctctgtcacccaggctggagtgcagtggtgcgatctcagctaactgcaacctccaccacctggcttcaagcaattcttttgcctcagcctcccgagtagctgggactacaggtgcatgccaccacacctagctaatttttgtatttttagtagagatggggattcaccatgttgtccaggctggtctcgaactcctgactgcaagtgatctgccagcctcagcctcccaaagtgctgggattacaggtgtgagacaccacacccagcctatttatttaattaattttttttttttgagacaggatctcaccaggttacccaggctggagtgcagtggtgcaatcatggctcactgtagacccagcctcctgggctcaagcagtcctctcacctcagcctcccaagtagctaggactataattgtgtgccaccacacctagctaattttttttattttttttttgagatgaagtcttgctctgttgctcaggctgaagtgcagtggcgtgatctcagctcactgctgcctctgcttcccgggttcaaaggattatcctgcctcagcctcccgagtagctgggattacaggtgtgcacggccacacccggctaattttttgtatttttagtagagatgtggttttcccatgttgcccaggctggtctcgaactcctgacctcatgaggtccaccagcctcagcctctcaaagtgctgggattacaggtgtgagccaccatgcctggccacctggctaatttttgtatttttctgtagagatgggtttttgccatgttgtccaggctggtctcaatcttctgggctcgagcaatcctcctgcctcggactcccaaagtgctgggattacaggtgtgggccaccacacctgacctgctctgacttacttagataccagggagatcatccatggagaaggtctaagggctttatggatttcattatcattggcatgctcgctgtagatggccatgaaatcattttcaaaaatgtcctcatctttaaagaagtgtttttattatttgtgaattttgctttggttgagggtgtctttggagtttggaaatccatgttgaggcatgaaataatttgttttcccagatgtttacctgcctgagcatatgacccttgtttatttatttagggctctgtgtgggcaagaggacttaattggcagatgtgtctgtgactagacacagaagacatttttcttttgttagccatcttgtttgtgtgtatggggggaagtggtggattagtcacccgggaacatgtgggaagctggtgaaattttgcaacaatagctgggaagggcttgaacattccataggggcagggtacatcttcagtctcaggtcagctggcttaacgagagctcaagttgactgcctttccactggaagtgtccttcagaactggaaccgggccgggtgcggtggctcactcctgtaatcccatgggaggccaaggcaggcagatcacctgaggtcaggagttcgagaccagcctggccaacatggtgaaacgccgtctccaccaaaaatacaaaaatatcaggctgggcacggtggcaggtgcctggaatctcagctagtcagggaggctgaggcaggagaatcgcttgaacccgggaggcagaggttgcagtgatctgagattgcgccactgcactccagcctgagtgacagagtgagacaacgtctcaaaaaaaaaaaaaaaagaagaagaagaagaactggaactggaacaggagcttcctggaagattgactggggttaggggttgcaggcgagtaagcctgtcagagaatggagcctcctgccaacagagggggagctggcatacagaggccgggtgggagcgtggccgggcctgccatcagagtggctgtggtactactgggccagatgcaaatctggagccaagggtggagactgagctttgcccaagccttcatgatgaatcagcgcattagctcaagaccggggcaggaagtgaaccagggtctgtgtgtctcagacagtcctgagttaattcagacagaactattgtgctctgttcatttatcccttttattcttttttcttttcacggatgggctttagatttccatttgtggcctctcctccttttagatctaggtaaaatggacaaaaaccttccgttttcatggtttctgatggcttaaacctgtc

SEQ ID NO: 421 - DNA, 60414 bp, Homo sapiens
cagtgtcaactatcttcgtggcttgttgcaaaagtaaaagagatcattcatgtaaagcactaatcacggcacctgggacatagtgagtgcctgtgagcagcaacaagcctgatggctgtaacagcaacacgattgctgttgtgctgtgtcatccacccattgccacctggactgcagcattttgataatatttcatagattgccttactgttttactttcttgttagatgatccgttcgttccagaagcatataaacacctacctgactattctgagtcttagagaatccaacggtccagtagggaagacagagaggtaaatacataaatattaagttatgtgctgaatagcttgttgattgtatgaagtttgctaggcctgccctaacaccacttgcacacaaagtgggtggcttaaacacagatttattttctccctattctggaggccagaagtccaagatcaaggtgtctgcaagtttagtttattctgcacttggctagtttctccttgccttggagacagctttcttctcccacgtcttcacatggtctttcctctgtgtgggaaggttttgtcctaatctcttcttatgaggacaccagtcttattggattagggcccaccctactgacttcattttaacttaattacctctttaaagactacctcctattatagtcacattctgaggtactggagttaggacctcaacatatgatttttggggagacacagctcagcccctaacatagatcagtaagtgctgaatagttcccatttgcccaagcagttccacacccactctctgccgtccttcgccctgttctgtgcctcgggaggctggcttctgtggcctgcatccaccagctccttgccctctgcttctggctggattccagttggtactgccagcgggctccctcctggaacataaagttctagaacataaaatcacagctctctcaccaggttccagccaccgtccctctcctgctccttcaagcctagacgtagttggcaagctgtacccctctgttattagccacggggtctaggccatcccttgtggcttcccatcactctgcccacatctttgtgacaatgcccgtatttaaatagtgcgtggaggtcaggcgtgatggctcatgcctgtaatcccaacactttgggaggccaaggcgggtggaccacttgaggtcaggagttcgagaccagcctggccaacatggcgaaacctcgtctctactaaaaataaaataaaaaataaaaaataaaaaaaattaggcgggtgtcatggcacacacctgtaatcccagctacttgggaggctgaggcaggagaatcacttgaacccaggaagcggaggttgcagtgagctgagattgcaccactgcactccaccctgagtaacagagcaagactccgtctcaaaaataaataaataaatattgtgtgggaatttgtcagacaaaatgaggaagagcatcatccccagtagtggaacagctttggtaagtgaaactcccagcacactgatgaaatcatgaatgctgctactcacctatgacagctaaaatcagggagcaattagctttaaagggaggaaagcaatacagtatattcaatacacagtttaagaattatgtcaggccagctgtggaggatcatgtctgtaatcccagcactttgggaggccaaggcgggaggatgacttgaggccaggagtttgagactagcctggccaacatagcgagaccttgtctctacaaaaaaaaaaaaaaaaaaaaaaaaaaaaagaagaagaaaagaagagaaagaaaaaagttagccagtgcagtggcacaagctggtagtgctagctactcatgaggctgagacaagaagattgcttgcgcccaggagttcgcagctgcagtgaactatgatcgtgccactgcaccccaacctgtgtgacaaagtgagcccttttctctaaaaaaagagagagaggattatatcaggatccgttaaaaaaaaaagaattgtaggcttcctgagtctgaggaccaggaggatgaagggcagggagggctattaaaggaggaggcagccaggcacagctgctcacgcctgtaatcccagcactttggaaggccggggtgggtggatcacttgaggtcaggagttcgagaccagcctggccaacgtgatgaaaccccgtctctactacaaatttaaaaattagccaggcatggtggttggcacctacaatcctagctactcgctacttggaaggctgagccaagagaattgcttgaacccaggaggcggaggttgcagtgaactgagatcgtgccactgcattccagttggggcgacagagcaagactccatctcaaaaaaaaaaaaaaaggggggggggagtcagagtaccttctctttccttccggctgttgggcttgtgcccctctcctgagagctccccttcagacccccttcctaggcttcaaggaactgtcaagaatcagttcaggtggaaaagcttttcagcccccagcacacactcggtaagatcgggtgagtgcccagacctgctccctcccttcctatgcttatctctttcagggctatgtctgtgttgtaactctgtttacctgtctgagtctggctacaggggcctttttgagggcaggaactaggacttttagctctgcctccccacacccggcctggtgcttggcccacagctctcagagttttccagtgaacagcatggataaataaagccaagttaggacaaatgaggatgctgtcatctcagccttcccttcactgcctgtgcatacccagccctccctctctcccaggcccagctttcctttgaggccttccccagatacacagatagggagagagctgtgggtgaatggaaataatcccctacctcaccattcacttcacatcgtgagcatttccggtctggctgtcctctgtgcctcactgacagatagttctcttttacagtcctctgggcctcagcttcatttgtaaagtggggataatcatagcacctagcagagggtttgtagtgaggcaccagtgggttcatacctgctaagtgtttaaaacagtgcccggtatatggtaactactcaataaatagagtgatggtaatttcggactacgctttagagcaacagtgtccttcaattaaatctcacctgaggctggctgccatgactcatgcctgtaatccagcactttgggaggccgaggtggaaggatcgattgagcccaggagtttgagagcagcctgagcaatacagagagaccttgtctctattaaaaatcaaaaaattagccaggcgtggtagtatgtgcctgtagtcccaactactcgggaggctgaggtgggaggatcgcttgagccctggaagtcgaggctgcagtgggctatgattgtggcactgcactccagcctgggtgacagagctgagactctctataaaaaaaaaaaaaaaaaaaaaaaaaccttacctaacaacatacaagctactattttcctttcctcttgcctttcgtttttttttagatagaatcttgctgtgtcacccaagctggagtgcagcggttagatggaatctcgctctgtcacccaagatggagtgcagcggcgcaatctcggctcactgcaacctccacctcctgggttcaagtgattctcctgcctcagcctcttgagtagctgggattacaggcgctcgcccccatgcccagctaatttttgtatttttagtagagaccgggtttcaccatgttggtcaggctggtctcgaattcctgacctcaagtgatccacccacctcagcctcccaaagtgctaggatttacaggcgtaagccaccgtgcccagcctacaaactattttcatttagctacccactcttttcttcaccaaacctgggcttgcccccaggaagaatccagttcaggaagagaactaagtactttatgccctgggaggcctatgtcactgtgaccagggaaaaaagggccagctaggcctggagcaagaagctggccttttattgttggaattcaagaccagttgcaatcactctgtggggttttgcagcccaccaaaccccttgaaggcatacatttcagggccagtgtgggcccctctcttcctggggaagccacagcaactcgatctttaatatgcacatgaatttgctgcagatcttggaaaatgcagtgtgactcagtaggtctgggtctgcatttctagcaaccttccaggttgatgccagtgctgcgaatctgcagttgggataacgaacccacccgagtatgcccacgactttcctagttttggcactgaaagttctgcatccagggaaaccaggacagttggtcgatgtatccaaagaccacactttgaatggcaaggtcaaagcaaggaagcatgtgctgtttgtactgagtttcatagttcctcccactggagtccctggaataatcctcttgtcctgataaagaactgtgactctttacgctctagaaaggccacctgactccaagcctcagctcttcagggtagatgctggttttggggggcctgaagcttatctaatcttagtggctctcttaagaaaaaatttgaccaggcgcagtggctcacggcctgtaatcccagcaatttgggaggctgaggtgggtggatcacctgaggtcaggagttcgagaccagcctggccaacatggcgaaaccccgtctctactaaaaatacaaaaatttagctgggcgtggtggcgggtgcctgtaatcccagctactcaggacgctgaggcaggagaatcacttgaacccagaaggcgggggttgcagtgagctgagatcacactgttgcactccagcctgggcaacaagagtgaaactccatctcaaaaaaacaaaaagaaaagaaaaaatttaaaatatctttgttttgcaaattttagaaaacatataaccatgtgaacagagtaaatttccctctgtctctttggcctaaggccaaacaggtgctcgcatcttccttctgggaaaatggtgctgggtgtctcagtggccagtgactgccacttctgcaagatgaccaccaggtggcagtcgatttacacagcccccttcacatgcccaccctctcccgcctggccacctccagaaatttccaactcttcctccagctggtgcagcccattaatccaacaaattaatctatgctgtgataatgggcataaggagttcatgtgcttctctctcaatagcatatttgccatttaatggaaatgctgagagattgtttttaaaaccagataaagaatgctaatggaggcgttccaggcactctgttggatcacggatcactttggtgatgtttttgagcaagtgggcccttctgtgctccacagattgcatctgtgcaaaggtgctgcatcttaaccccatccccctgcatcccaacccgaccccaccatgcttagtgtttaggtatcatctcgggagctcagctgcctggattcatatgcaggtactaccacctcttactgagggtagatgttgagtaaggactttaacatctctgtgtgaaacgcacgtagtaatactgatttcatataattgttgtgaaggattcggtaaagtaccctaggagtgtgtggcacacaataaacactcgataaagagctaccatcttcataccacaccttgcctgcctccttcattcttcagagcaaattctcctgtttcccccccagaccctatctccaaccagttgcttcaagaaaacaaagggagaattgagaccccagcatggtaataaccaggcaattcttgtgggcacagcgttttccagacccatgatcgccttttaagttggggctgatccctgaggacatcaaagcatcatcaagatagggaaggggccctggctggaccagacttcagatagcccagctctgcatttttgcagaggataaatctgcaagtatcgccttgtggataccaggagttcagcacttgcagatgagcaagcaatgtgagggtaggtggctaaggcagtcatctggtccagcctgtccctgcccctggacccatagccatctttaaccaggcgtcagcggctccagcagaggcttcatctcctgcactccttgttagacctggtaagcattctccctctctttctctctctgattacaatcatctccagtgtcatctacactaacaggtaaaatggtgtaagggtctcaaacttgctgcatattagaagcacctgggattttacaatctgattctcaggctaaatcccaaaccaattaaatcagaatctctgggaatgagacccacacatcagaaatgattctaacgtacagcaagtttgagaaccagtgttctagagcagtgtttctctagctttaatgtgcatagaagtcacctgaagagcttgttaaaatgcgaattctgatccagtgaggctggggcagagcctgagattctttttctaacaagctcctaggtaataatgaatgttgctggtccatagaccaagctgtgagtggtcagattgtggaactgtggttctcaaatttgagcatgtatcagaatgatctgaaggtcttgttaaaatgcacgccagtttccgattcagatctggaatggggcctgataatacgcattcctaacaagttcccagggaatggcgatgctgctggtccacagggcacactttgggcagcaggggtgtagaggaggcaacacaagttttggagtcaggcagccctcagcctccttttctggcctcatgacactctagctctgtgatcttggataagttacttaacctctctgaactgtaattatactatctgtaaagtgatcgttattgggcaagatcaaatgagctaaaacacctaacacattgccaagtgggctggtcctcaagcttgacggcagatttaattaccttgggagctttttttaaaaaacaaacaaaaaacccatagttgatttaattggtctacggtactgaacatcaggacgttttttctttaatagagatgaggtcttgctctgtcacccaggctggagtgcggtggctcaattatagctcactgtaatgtcaaattcctgacctcaaacaatcctcccactttggcctcccaaagtgctgggattacaggcatgaaccacaagggcgggccaggatctatttttttaattgagacagggtcttgctctgtcacccaggctggagtgcagtggcatgatcacagctcactgcagcctcgacctcctgggctcaagcgatcctcccccctcaccctcccgtgtagctgggattacacatgtgtgccaccaacccagctattttttttttttttttttttttgtagagatgtggggggttgggggatgggtctcacttcgttgcccaggctggtcttgaactcctggcctcaagcgatcctgctgcctcgacctgtcaaagtgctgggattctaagtgtaagccactgagcctggtcttggccaggattttttttaaagctactcaagtaattctgtgcagccagtgctaggtactggcctggtaccatggttcccaaactgtggtgtgcatcagaatcacaggttgctgggctgcacccccagagtttctgactcagtaggtctcggatgggactgagaattggcatttggaacagcttcccaggcaatgaataccacgcagagaaccagggctggaggataatcctggtttgctcaggacagctcatgtggagcgtcaccctgtcccaggtgtgccactttacaagcccccctgggtctgactgggagtggggccagaccctgatgggtggggaggcccctgcaggagtgcaggaggcacagttgttgtcagggaagagagagggtgaggtcactgagctgaaacatggcatcaggggcaagagaggcagccttggcaacagtgacccagagcccaggagtaagatgtgtggttggaacccctaggaggccgttagctcaacacaaggaaaaacttcgaccttgagaactgccctgtctggaaacggcaccagcttcctcttctggcagcgagggccctgtccctgtggtggagggcggggtagtcctgctgagctggaggaggaggaggaaggagagatgtatcaactggggcgatctctgagttccctttgaagtctgaaattgcacttccctgcaacctccagtctgcctttaatccagaagctgtttatttagggaggtggccgtctggagctttctcaacagactggctttccccatggtgtttcccttgcctgatacagcaagcggtttacagtcctgggccaaacaggaaggcgacagcgctagacgcagccggcaggtccgcaaggttgaggtgcagcggtgccgcaggtgtcacctcgagagtgcagtcggagagcgccgcgggtgaatgggccaggcaaggcaggggtaccctagggatgcgacgcggggctcctggggacaaaccctgccccaggccgggagggaggagggagcaggagggtccagcccacgccgctggccacatcagagcaccaagagaacaccaactgtttattacaggaattcctatgaaacagctccaagaaaaaacccacacataggaggaaaaaaaataacaaagcaacactcaacagacatggggctggggcttcccccacagtgcgccgggtcctggcgcggggaaggctcagagacccgtcgagaactcgagctggggtaccgaggcactcctcggagacccccccccctccctccagggccccaggcctggcgcggggagcagcggagggggcgaccgctcctcggcagggccccccgagccagcgtcccggccccgcgcgcgtttccaaacttggtcacgctcggcggcggctgcgcgtcccggccctccccaagctcggcgttgcgagtccgggcagggtgggcgggacgaggtgcgatcgccggctcgccttcgctacgcccttgtgatcttggggccacggaggccaccagggcccggccaaggatcggatgccactcccaacctcccagagccgcgccgaagcctcgtgcctgcccaggcttcccggctctccggaaggtctgcgcgctcccatgtccagggcggggccacgggctgggcagcctccctccccgtggcagtggtcagtgccgtgtaagcgttcctagaatcagagttctcctcctcagatcacccgcccttctcaggggcacccagcaagcccttatgccctaggcgctcacccaggctggcggcctttccgccttgctctttagccctgcacctgctcaaaggggtcactccaggacccaccgctgcccaccctcggacagcagggcttccagtccagctggggagtcagagcccctgtgagcccctactgtggtgtgactccagaactggcttttgtctgctgccaaattaaagaccctgcctccccagagtcctccagctccagggtggccaccctccccatccctgctgggtgaccgggagctgctgggagtgagcccatccctaacagcagcagcctgatgaggccagacggggcagggcagtcggcagatgctttgcagtagcccatagctcctcagagttcctgggggactggccagggacctcccacccaggctgggtgcagggctcgtgtgctgggccagcagccccgggggaaggctgagatacaggaggacatggaagggaagggcacaagtgcccggagggagctgaggaagggggaccagaagggagctgaggaaagggggtcaggcagagtctgtgacaggagagatagagaacggacggaggcagagactccaccttcaggccaaagagcctctggtgggggtcatcttgcccttttccatattccaacttttatctgctttctggatttttttttttttaaagggaggttggttcctgcatttccactctttgaccataggaacgcctggctacaaaaggggctgtaattggctgctgcctataggggccccaggtccttcctccaattgcaaggcagcaactccgaagttctaagtcccatggaaagtggcagtggttgggctggactgtggctggaggatcaccgggcctcggttctcaagcaccatctgtctggctgcagctgggcccttcagctgggggccagtgttgctttccagctgcccccaccgggtcagatcatctctggcaaggaagagctgctggcatctggtaggggaaaaaagggatgggaggaatctttttcaaaggagcccaatggtctttcctggtcactggttcctggagagacagttttgggagaagttactaaagacgtaagccctctcctttttccagggactcgaggtcaaccgtagaactctgcctgggtcatccccccattcaaattcctagaaccattccagcttgcccagctgcagggactctggcagcaggagatggagtgaaggaatggaatcccggggtgaagcagctgtaggggagggcttcaacgtgggagggtacctggcccattctaatacgtcatagctcaggggagctaggccacaaagacctgtaggtggagaaaagtaaactgggggcagaacttggtaggactcagacaccaggctgaagagttcctaagactttactcagaagactcattcaggccaggcgcagtggctcacgcctgtaatctcagcactttgggaggctgaggcgggccgaggtcaggggtttaagaccagcctaaccagcatggtgaaaccccgtctctactaaaaatacaaaaattagccgggcggggtggcacgtgcctgtaatcccagctactcgggaggctgaggcaggagaatggcttgaacttgagaaggggaggttgcagtgagtggagattgcaccactgcactctagcctgggcaacagagcgagactccatctcaaaaaaaaaaaaaaaaagaaagaaaagaaaaagaaaaaaaaagattcattcaaagagcacaggaaaaatggaactaaagtggtgttttggtggtgggataatcagagtaggtaggggcagtgaagagaacagggctgtgacctaggtgatgagcatctatcagggtggtaatggaaggaatagaaaagagaatgaaagggggcagtcaggaggagagactgagttgctatccaaggctgaaaagaaaatcttgggtgcagctggggacacgaagcagctctggaagcctaactgcgatggagattcagatgtaggagccagatgcgcagaagtgttgctggtgctataaaagagggcggaggcactgccagagtgggcagtgagaagacttcgaagagggtcaagggcagagcaacaaggagagccagtatttagggagtgggcggagcaacaggagccaggagagaggaaggagaacctggcttcctggggtcacaggagccaagggagggcagcttcaggagagatcaggggagtgcgtgtggaagagcaccataagaatgcagaagatgctaaggccctgagctgctgggtgacctccgagtcaatccgagtgatgggaggggctgtcagcctgcagtggatgaaggaggatggcagggaagactcaaggacccttggtgtttaaggggaggaggaggaggatgtcaacttgcagaaggagctggaaggggacaagctggaagtcctaggacagaaataaatgatgaggtgcaggtacggtggctcacacctgtaatcctagcactttgggaggtccaggcgggcaggtcacctggggtcagatgttcgaaaccagcctggccacatggcaaaaatccatctctactaaaaatacaaaaacaaattagccaggcaagatagtgggtgcctataatcccagctactcgggaggctgaggcaggagaatcgcttgaacctgagaggtgaaggttgcaatgagccaagattgtgccactgcactccagcctgggcaacagagcgagactctgtctcaaaatgaatgaatgaatgaatgaatgaatgaatgatgagcaagtttctgatgtaggggtggtttggacaggacccgttctccctggggaccagtaggaaggagaagggcgtggagatagtagcagcgtggggtgacagtggaggcgattccccggcaggctctatctgggcattccaggacagtgggaagtgggccgcggctttgtgtttgaggaaagcctgaggggaatagaaggggctgcagtgcctggtgggagatgtggtagggagtcaggtggagtgggtgtgggggccagctgcccaggcagagaggagagggcacttgtatttacttgttcccggtttccctccattgtgactatcctgaggcaagtgagtatttctccatcgtctgacacagggccatacctgccacaccatcaactcaagaaagccttgtagatgctgcccactgggaccaaacaagtggctggggaaggccgggcagcttcccctctcccatggtaaacgggggctggaaaagggacagctgtcttggccaactcctggaggaggccttggtattttctttttctccccaagagggtgcacaggaagcgaggaggagaaatggcttggagccctggggcttcagccagaaaccgctgcctcaggagggtttcctcatcctggtgtggcagatcccagcccacccaacccaagcagggggctggagagagttgtgtgtgtgcacagccgggttgagaccacctcagtttttctttttcttttttttttttttttgagatgaagtttcactcttgtcgcccaggctggtgtgcaatggcgcgatctcagctcactgccacctccgcctcccagattcaagtgattctcctgcctcagcctcccaagtagctgggattacaggcgcttgccaccacgccaggctaatttttgtatttttagcagagacagggtttcaccatgttggccaggctggtctcgaactcctgacctcagctgatccacccaccttggcctcccaaagtgctgggattacaggcatgggacaccgtgcccagccagtttttcttaaatcatcctctcagtgtgctacgtgtgtcctggactgtcttctcaactggactgtaaactcttcaaggtcaaagctgattttgttttcctgttctcagcatctgtcataggcaggtgtgctcatcttttgtcaaatgaataaataaccaaaaaagacatgcaatgaactagttcccacgcccgtgtccctgccgcaactatgagggaagacacgtggggcctgtgctacccagttgcctgagcccagcgcctctggacacctgggaggacatgtggggtgcatagtgtggggggccctggccttgggcagtccctgggttgctatggctccaggccttacctcttactgtccttctcgcaggccttcctccaccttgggtgcctcctgacgcctgccccggaagtcttcatctgaaaaggagagggaagctgcctcatcctctaccctgcagggcctcgctcaggcacggcccctagactgggcaagagagctgacccgactctctctgcccccttcatttgggacccatgcagatccccccaggtagacgatgcatgggtccagggagagaggcagcaggacactcaggtgctggccagggtccaccactgagctctgagaccttggacaagttctcccctcgtctttgggcctcaaatttcctcatctataaaatgggatggaaaagctggactatctagatgacctctgaggcccttccagtccttgtttctggatgcctcctgaccctcgaatgtggcatgaggatcagggttcagctgcgggcccaggagggtctgaggcagagtcttctggcccacgtggcctttggaagggactgggtgaaagttgagaagcctctgggcccacagactgaagctgcccagtgcttggttctcaggccgagggtcccccatgggggcaggcctgtctgccacctcacacccaaaagaatattccccagaaacagtacctggcacttcatgctacaggtacacatctaggtggaagtagggctagggccccttttcaggggttgcagaaagggggaagcaatgtcgaccaagtcagggggatccatatctttgggtcacctgcccaccaaccctcagtgtgttcctccaggggacagggcgggtgctcccatgaaacacccaggaactccgctgggagatcaccgatcatagagaagttggagcttacgactcccctccagcctcaccacacgcgtggccctccacatcatccaggaggttggctgttgacgcggcagcccccagcctgccaggccattcaggaaaaccgtcccagggatgaggggacactgccctagtcctcccagtcccactgactctctgccccacccctcaaagctctggaggtacctgacacacccacctgaccccccacacccttagtactgtcccccaggctcattttcctgaggtcagtggtatggccaggccctgacactctcgcccagcttacatctctggggatggagaaacagcttcctccctgtttccctctggctgctgagcctctgctatcctaggccctgtttgagaagcatgaataggagttctgataaaaaggtggaaagccgtatttctactcgaggaagggagggccaacatgcttggagtgaggaggactcgtgcaccagttcaactagagaaatgaagggaaggtttgatattgatggaagaaccactttttctcccaagaagtacataacctcagaccaaaaaaaaagttaataggacaacttctgggcctacagaagggagacaggagctgctgccctgctccctaggcctggtccctggttggcaacgagagacgggcagtggactggtggccaagctcatggaggagaggggaggaggaagggaaggccacagagccgggttccactcccaggggagggcacagctgcagggagtccaacaggggtcttgctccatggcccttggcttccaccacccccaccagtgccaggctggaaaggatacgactgatgcttcaacaagtgtttcctctttgacttcctcattttggtcttctctgagaaggctcgggcaagttcaaacagtttcctccgggtggctgggggcagagagacctgtgagtcattctctcagcagccagcacaccagatggcctcctcccaggtgtgggaaaggccaggggaggaccaaggccccccggagagggagcagggggcaggcaagggtgggagctgaggagggagagatgacaggaatcgcagacccctgaggacgccaccccaggagcaagaggctacatcctgggtcagcctgcaggggcagcacaggacaccctgagccaggcccagggaccgcaggcggctcaagatccaagtattccctccccagctgcaacacactgcaacgcatcttggctcgctttcccgccgccaccgccttcccgcccctcccctagccacctccaaagttggttctgggatttccatgactaatccgagattttccttgaaatggagcctgaaaggatcgcagcctcattcacacatggctgtgggtctgtgtggcggggaggtgagggggagggaagggggcattcaaggctggtaggactttgtggaaagaggtcccccacccccacagaggcttagcaagggcctctctgtgcagtcagctccggccaagcctcctcgagccacagagaacgtgaacatgaggattgcggtgagggcatgtgtggcacgttatttttctgcagacatctggctcaagaggatttaaaacttaatttgtatctagactcagctgtagagggaagtgaggcaggaaggctgagggagccagcctgcgatgaaaatgtcactggttcaccaagagtcagctgcattacatgtgctgaggggctccctcactcctgggaggccacagggcctgtctcagaaaagctggggagggaagcggggcctgagtgggactcacactttcccatgtgtttcagcttgtccctgaataaggcatcttcagacacagcggggttggcgtcgccagttcctggaaggagacacctgctgaaggccggccaccgtggccagccatggccgctgtcccagccctacccacccatctgaggacaaatgcaaagaaagagcaggcttcttccctggccagaagggagtttaaagcaaggaggatgtggagttccaggagctcctctttccccttgtggactttgtttcctcctctgtaaaaatggggagggttcagcggtctactgtgtgtgcagacagccagctcgtgtgtgctcccaactgtccacgcctctgaccaactccatgtttcatgacatcaccttggtagcttgggagtatttccaccatggaggtcaccaagcactacatatcaggctcccgctgcacccagagttggctgtgaaacattcaccagcacaccaggggcctcctgcaccccgacattcatgtgacagtcaaatgaggtgctggctcagagccggcattcacctgtagcaagtcccttgtccttcctgccaggtaagcccatccattgctccctcccagccacagggtttctggctattagacaatgagtaggaatagaatgggactagtcctggagtcagaaccccaccggccacccagagtctcccgggctcgctcagcatccacttgggttttttgctggtttctgaagcccctgctctctgtcctgcaacttggttaatccccagtcaccttgcctgctaagtcccctttgagtcattctgatccatctcagcagccccggtatctctagttaattcaggatcaaggacaagaggctcctgcttaaaactcccagctgcacatctgctgagccctaagctcccagcctgctgcttatgagtcagttccacaggattttctcccttcaagctgggatcagctcagctccccatccctctgctcctccacccccaactccactgcatgatgcaaggtctattccaggcaagagcccttctccgaggtgggcagcttgtgtacatgtggggcagggggcactgactgatgaggggccactgttcgcacacaggcaccaggtcatcgttcccagctgtggctcaacccagtagtctgcgcatcccaggagcactgcagccccctcacccctatccaaccctctttcagccatcagagcttctgagcagaagggcctggccctctttacaggcaattcttacttcccaccaccttgtacacaaagctagaaattcctcttcctccaacacctagggcaaggcccaacagatggcagatattctccagctatgtcatgaatgaatgagtaaactccccagattaatcctgccctccttttttcccatgcatttgctaaaatcagtaagtcctcagctttgctagtttgttctacctgttttctgggcatttctccttacaagaccataagcttccccaggacacagaccaagacttatgagtctctgagccccaccacggggcattttggggtccttttcttcttttttttttttttggagacagggtctcactctgtcactcaagctggagtgcagtggcataatcacagctcactgcagcctcaacctcctgggctcaagtgatcctcccacctcagcctcctgagtagctgggactagaagcacaggccaatatgcccagctaatttttagtacttttttggtagagataggggggtctcattttgttgcccaggctggtcttgaactcttgggctgaagcaatccactctcctcggcctctcaaagtgttgggattataggcgtgagccaccgcacctggccatgtgtcattgactagcctacactcgaggcataggttgagagttcagccagcctatgttacttgaacacaactgtgggctctgaagcccagcagtggctggattggaaagaccccagagctgctaaatggactggatatggagatgggggcagaagcagccccgccagcctgctgaggaggcccaggccccctcccacaatctgttttttcaccctcctctcaaactccaaatatgcaaagcaaagttgggtgtgagctccccactatgcctctaggttttcttccccagaaggcaaagttacctgggacaggagaggaaaagccaaagtcgtttccgacagccacgctgctggatttagatttctgggattcgtatttcaatcgatctggaaaaggaccacattcacaggtcagggaggttagctcctgggctcccaggggcaggctgggctgggacacggtagtttgctagaggctaagtccccagaatcacacatgagcacacacgggcacccaaaatatgagtgcacacatctaccagctctcaaagaaccagcagtaaaagaaactaccgcctgacagccatctcaaatgtcagaattaaaaggactcagagagactgtagagtccaaaccccctcatttaaaaagaaaggcacggccagggatggtggctcatgcctgtaattccagcacactggaaggctaaggcaggcagatcacctgaggtcaggagttcgagaccagcctggccaacatggtgaaaccccgtctctactaaaaatacaaaaatcagccaggtgcggtggcgtgcgcctataatcccagctacttgaaaaactgaggcaggagaaacacttgaacctgggaggcggaggttgcagtgagccgagattgagccactgcacttcagcctgggtgacaagagcgagactatgtctcaaaaaataaaaaataaacggaaaagccttgaggcttctagcacctttgctgcagagctggggctaaccttgggcctcagcccagccttctccctccacaacttgctcctcccccaccaacacaccatcagttacacacacaagctctcacgctgtggccgtcacagggacagagctccacagccctctcgtctcctctaccccaaacgcactcccaccctgcaggggaaaggcagccaggctagggagcagggtctccaacccagagacaacccaaatacctgcaaagttccagagcccctgctctaaagtcttccactcaagagcctcccccgccctggccttcatgaacccagtcgttctgtttccggagctccagacacatcacgcctgccttggggctggggctctgtgaggaggggcagtgctcttctccctgctgccttgtgccaaggccagtgcctggcacagagcaggtgtgcaaagggaagaaggcctaagagtgcacatccttcttcctctgagtcccgagggagaaaggggtgggctagtgacccaggtccccataggcagaattctgaggctcccatgggataacttggtgggagtcatgcctcaataggacagaaagcacctggccccctcagcccccagctcagtgttttcctgagccccaaggctaaagccagcatcacctcccttcttcagccagggagaagtggctgcaggcgctgcccacctctctccagagcgaggaggaagtcgcggttccgttgcagctccttcatgaactcctcgttctgcaggaaaagcgcgatcctctcgtcctccaggtactgcttccagcggctctcctggtctccgggccctggcccagccatggcaggtggacatccctctccactcccaggcttggggcccccagcgttaccctgaggagggaagcgagcatgttgaatgtgtacacacaagggtacatgttgcacaaacgtccacatccctctggttgcacacatgccctgtccaacatcctccagccctcacctgaggctcacacctcctaatggaacctggttgcgagccaaaatccaacggacaggtcagagccattgctgcaggggacacagcagtagcctaaaaactatttttcccccacgccacagaccacctcataccttcatctacaacctgaacagtcctgaaaacaaatctgcagactgtggaacagcctatacgtcaattcccaaactcaaccctctccctgcaccagcagcctcagggtggacctgccccgctgtggggcaccttggggcatgccaacatctagcaagaagcagcctctggccctttcccaagggaggaaggggggtgctctggccctccaccattggccaccccatgcccgcctctctccagcctgaggtgactgctgcagcagacagcctccttaggctgtcaccttccctggatagaacaggaaacctccaggcccaggcaggaagtgaggctttcagttcagcattcctgccctacgaacccagggcaacagaaatagctcagcctgggtttaaacatcaggaagtaaaactggctggcacaaattgtgtgggcaaagagagatgctggacaagcaggtgggagtggaaggcgggggcggcccctgttacctgtatgctgtccagctgctggggcaggatgcggagaaagtcatccggaaggttgcccagcagtggtgggttccagttccgatagcgtctctggcttgtaggggctccagagcccagcgcgtcgatactaggggatggcaggtgacagggaagaggaagtcattaagcccaaccccaggtctcctggccccatcacaccaggtcctcaggcaggtcggatcctgctcagagattcccatggcctccactgcctccagaacaaaggcccgtcactctgtctcatcactggagatgtctccaccagcctcagcgaactccccagccattcatgctctccagtcactcagtgcccttccaggtctctggacctacagagctgtctgtccacggtgcacatgtggaactctgtggatttagccatagatgtttacaaatgtcccctaaagacagcagggatcgcatcctttcatgcttctatcctagcacctacacagtgccaggctcatggtgctgagtgacaggtatggtccaaaggaacagacacataagccaccaacagcacagcctgctgcatgctggtttgctgaggaaggggcatatggggacgccaggatccctacagagggtaaagcagatctgagctccagttctggctcaaccaccagccggcagggtagtcttaggtgggcccctgttccctctagggctcggtttccttatctagaaactgctgcctccctgcccaggtgctggggagcccctcaggaggccgtgtcctgagcaatgttctgaaaacgtgcgtggagatgtgagtgtggaagggatctcgctctcagggtgctctggggccgctctttccaggcccgttgtgtgtgtggcaggagctctgtgccatggcagagccaacagctgggcaaggcagtagaggaagagggggtggcacacaccctccctgacccccaggctcccgccctaccgccctgggcctgagggcagctcggagcccggccaggaggtccccacagctccatggcagcctgcagcgtggcaaccgcaggacacgtgttccgctgaatcaggaaaacggcacactgagaaggcagccgagggccgggcggtgggggctgctctagctctcgggcctggctttgatttggtcttcagctctaggaatcccgcccgccccctcactggaggggagcttttccgggctgccgctgactatggaaataacttcctttccttttctatttcgggcgggtggccggcggcgggggcgaggggaaggggcgggggcggcagcagaagggataaccagctgctaagtgcctggtgggagctcagctcttgcagactggagccaagggaaccccagcacgcctcgtccaccctctccctgcacagacacagggggagagggaatggtctggagagcagcttgcatcacaacccgggactcccattcctaggccaaatttttttctacatcactgccaccttctgtcactgttggaggcttcatttttctccaaaggccagagatggggagagaggaagcctcatctctaagggactcgcagaccaccccaggctacagcagggagggaccctcgccaggggtattaccagttcttgaggtctcagggtcttcatctgggacatgggtgcccacccccaatttaaccacacctcggagccacccaggaaagcagtggagggagaacctcagaggtgcacctggacccctctagccatgaagactccaagtggagaagggcacaaggtggaggaggcccctgttctcagctgagtttccttgctgctaggcctgtggtcctgaaggaaggccaggcccagccccctcccggccccttggctggcactggtagagatgaggtcagcccacagctgcgtgagccagggcacaggcagcccaggcaactccattgtggtcggaaaggaatgtcagaaatgagctgagacgcaaataaaaaaaaaaacttccaaggctgtaattttaacggaaaaacagcaggcggcctgtgtggaagggtccccggggtttcagagactgtctttcagacagatggagggaaggacagactgggggaggggaaggagggagaagctggggaggatttcccagcccagagcctctgcctctggaccccaaaactgcaacttcaagccccatcggacccccaggtttacccatggaacatcagacctgatggaaagggatttcagactcaggacttccaggtaaaatttttggtaagaactggacattgaggtccagagggggttcaagccatgtcccaggacacacacatcatccaggcaaaacctgggcccagggattgtgacatttgaagcatgctccccggggtggccctgcctctctgtgccctaggaggccaatacccacgctcccaaactctgccccatctgcaggttctcggcaccccagtgactggaggtagcagatgggggccaggccattcccccactcaaatctgatctccctcagcagccaaaggaagattcctaaaacacgaacctgatcgtgtcgctctccaggttaaggcccttgaatggctccccgctgtctgcaagagaagacggaagctccctggagggccacagggcctttgatctgcttgcctttccagcctcacccgccgttaggtacttccaggaggtctccagatgagccctctttcctgcctccaggcctctgcaagtgctccttcctttgcctgagcgcctccctgtcctctgcttctccacattactgccaatgtggccttcaggtcacagcctggacatcagtttctcctggcagccttccctgcccccgtgtcttcggcttccctagaccctgatctccttggcagtgtgtgggcaaacaggcagcaccgtattcacctccacatcacacacatggctcagcacgtggttcacacacatagttcaggagtgctgtactcaccacctcatcatacacatggctcagcacctgcgtatggcaggcaatcagtaaatgctggaaatgaatgtcctggatggagggactggacaaggcactggagatggcctagaggcccaggtctagcagagccatcctggggcaaagggatctgtgcctctactgaacactggcctctgggggaagcctcgcccctggtctcaatgttagagctaaacttagaagccagccagtgtagctgggggacaggaaggagcagtaaaccactgattataggtctggtctatacctgggtctgtgctaagtgctccacacacatctcattcaatcctcctaacagtgctaaggtggaaattactattcccatttcaggtgaggcaaacgaagctcagagaggttaagcaatgagccaaaggccacattgcaaaggtgcctgaagaattctaagctaggcagctgaagaaaggggtggggagaacagaccgcttctgtctgactccacaagtcaagttctcctcagggcatccactcccagcccagcaaagccttccatttcctgagttaggctccagaacctcaagcaagagcagtaacttatctaaagtccacagggtctcctaagccttggtctggtgctgaggttaccttgcccccaagtggggctcccatcaccaccctggcccccacccacagcaggctgaacacccagccagagtagggagggaggatgtggcatggatatccataccacatttatactgggattttcagccaagcgtgacggtatgccctgtagtcccagctatttgggaggctgaggcgggaggactgctagagcccaggagttcaaattcaccatgggcaacatagtgagaccctgtttctatttaaagaaaaaaaaatcctttctcttatggcctcagttttcccttctgaaaataggtggaaccactctgcctagcagaaactgaactttttgcaaaagtgtattggaatattaaaaaaaaaaaaaaaggtgggggtggggataggcccggtggcttatatctgcaatcccagcactttgagaggccgaggtgggcgaatcacctgagatcaggagtctgagaccagcctggcaacatggtgaaaccccgtctctactaaaatacaaaagttagccgggtgtggtggcacacatctgtaatcccagctactcgggaggctgaggcagaagaatcacttgaacctgggaggcggaggttgcagtgaacagagataatcccagtgcactccagcctggatgacagagtgagactccgactcaaaaaaaaaaaaaaaaaaagtcaaagaaaggaaaatcatttagcccagggctctgtgatctatcccaggctgcaagtcctgcctaggtctcacccagacccacccactcattccccacctcccactccagtacagcctgccagctcctggtaccactcgtgacaaagatcccagctctgttcctgtccctgactcaaaacacttccctccctcctcccctcagtaactttctaggactctatgagctccgtaagctgcaatcacagagacttttctcattcgggaggtgacaggacacagcagtgaagagtgattagctttaagtcagaatgacctggattcgaactccagctcttagtcttggggaagttatgaaatctctcaaggctcagtttcctcgtccataaataggggtgatgacaacagtgcccgcctctgcattaaatgtgatggtgtaggtaaagaacctgctccgtttctggcattggaagggtgcttagtcaatgctagctacacttgtatgataacagagttcaccactgctctggggctgttctggggagaagggaagatctaactgggacaggtgccctgtcccatcatctccccaccccctcaccactccaggcctgagccattctaagaaacagcagctctagggcaaagaggtcacaccccagctccagcagccccagcacaaatgtggagcccagaaaaacaagcaccccggagacccatgggatcttcctggcaactaccttgattatttatttatttatttatttatttatttatttatttactgagagtctcactctgtcacccaggctggagtgcagtggcaccatcttggctcactgcaacctccgcctccggggttcaagcggttctcctgcctcagcctcccaagtagatggaattacaggcatgcgccaccacccctggctaatctttgtatttttagtagagatggggtttcaccatgttggccagactggtcttgaactactgacctcaagtgatccacccaccttggcctcccaaagtgctgggattacagatgtgagccactgtgcccagcctagcttcattttaagcttccaaattacagagtctctaacctggaagaagtttccagggaccttgcagtctacctccctgcctccagttatcaaactaccttaatgaaagagacttgctctcattgcttaaaaatcctcacaatatccctagcccaaggatggcagctagccattccatcaattactgatgactggctgggaatgctgtgttctgtgttaaggaggatctgaggctctgtcttgactcagcaggaaagagcacagtgatgaatcagccatgtttgctgtgggcttgggaggggaagtgccaatacacattccctgtttgtcattcctactctggcatctcccttgactataagctcccagaaagcagaggctgagctttacttaactctgtgtcccatatggtaccagacataccgcctagcctagagtaggaatttaggaaatgtttgctcttgcaatccttacattttgcaagttctccttggtatctagctaaaatgtctcttgctgcagtagaagcctgttctttgaaatatactgagcagtccagccaagtttcgtgttgtttgtacacagccccagccactgatcctcttccctgccaccctgtgctctgagacatgacagattctcaccggggaggcggagtcgggggagccagagggtagggccggtcgaacacgtgcatgtggtaggctggcggggagtacacaggtgggggctcttcatccgagctatcaggttccaaagtcctttccaagatctaaatcagaggcaacagagaaagaaatattaatcatccctccttgaatttaaataccattcagacaaaatcaagtgtgggagggcaggtataataaaggaactctgtgtgttgctagtgggagtgtaaatcgatacaatcaccactttagaaaactgcctttttgaaaaagctaaacacatggctacctctgaccctccagttctggcaactccacagacatcaaagtgtatgtccccaaaagaatgttcacagcagcattctccctccatgtgcagttcaaatacaggcagaaacaaatacacagtggtaagggtcagggcggtgtgccctctgtggagcgggtaagggtgggaacagataccaggggcactccaggttctggggatgatggttattgagctggtgctgataatgtggaatattcgcactgtgaaactccaccgagctgcatgcgtgtgactcatgtgctcctgtacccatgctattctttgatgataacatctttcataccttctctcaaagtacctccacgtctctgatctcatcttaacctcgaacaacctggcgctgtaggatatggctcattaccccatttgacacagaaggaaactgaggccgaggctaagtgacatggcaaaagccacacgctttttagaactgagtcttcaacttggaccacaagggtccctccttcaggcacactggctgcacactcaggttggactctcagggcggagagtagcaaggggagtgcccgggatgcctgctctccttcccaagctcttgtctttatccaggagccaagaagagggccagggagaggccaaggactgggcaaagtctggggtcctgctccactgaccgacttagattcttccccagaagcccagagaggagtttggggcagctaaacacatggctacctctgaccctccagttctggcacactccgcagacatcaaagtatatgttctcctgcctcggcctcccaagtagatggaattacaggcgtgcgccaccacccctggctaatctttgtatttttagtagagatggggtttcaccatgttggccaggctggtcttgaactcctgatccaccataggggcggcccctgactgggagatccctcaccacacagcccaacctggcctacaccttcgcctcccgctcactccccacaactctgttcccatctcctccaagatcaaagaatatgggaggagctcagaggctgtgaatctcaggtgccccagagcccccagacctcaggtgagtttgcagaagtcaccataataatgctgcctgtataagcctgggctgggccaggcctcactggtacatctctgctcttgagaccagccatgcccagcacacacagcctcccaggggcacctggtgggtagggaagtgagcctgtgcatgtgagcacacatacacacacacgcgcacatgcacacacatgcacacgtgcactctgcagtgctctgcgcttacatagctagctaaacccaaggaggcctcccgccctggaatgcactaacgttctttcctttgaggccaaaagtatttaaacagatgcttttgcaggaaaggaagaatgtagtgcttggcaggccactgctctgcttaccctaaatttccacaagaaaggaaaaaagagagagaacactgtaagcgctgctcctgttccctggcgactctctggtgcctggcacaggacagtgacccagcaggtacctggtgcattctgagaacttgctgctgctgtcccccagcccaggcaccctgtttcccagacccctcttctctgagggatagggctttgggctgcagccttgaggccagcagtggtgggtctcagtggctggcctgggctattcccactgatatgggtcagagtgaggtgggtgagcaggggaggagagcgcagtagaaactgtcccctaaaggaagctgcttggggtttcccctgaccatggctagtggcagtcagccccccagactcagggcaatcagccctccccagccacaccaggaggccccctcctgctcctctgtgcagcctcccagggcagcaagaccagacagacgttcatcagagcctcctggagaggacttgggaaacacagagaagacaggcggccggccaggcaagctccagaatgcagggcccgagtcccaaggagagtaaccccagcagcactgctggcctccctggcctctccctcccactgccaccgccacaaagaggttgttcttctggctctaaaggtgctgaagtttttgggctctgcagcctcctggcttaactcattgtgggtgatggatgcctgccaggtgctccagggggcagggtctaggccatttatctgacaggagatacttctccatggcaaggatacccctcgggccagcccaccatccatcagcccccagaaagggtttttttttccagtcagcagttattgtcattccagctgtggctcataaattttccgaagcactttccgctggctcaggagctgcctgcctatgggcccaggcagagttccaaaggtggggggttggggagactgccaagggaggggaggggtaccgggagggggctcaatttggagagcaagattcttagaaaaacagaagtgcacacacagcaagggcctacctagggggtggtgaagccttgcagaggtctataggactgtgggggccatggacaaaggagaaaatactaccctacctgccagactgtcagggcaaatcagactgcagaaagggtcagagcttgcagagagctttccttccagttcacacttaaagcatatacagttgactctcaaataacaagagtttgaactgcgtgggtccacttataggtagattttcttccacctccaccacccctgagacagcaaaaccaacccctcctgtccctcctcctcagcctactcaatgtgagaagatgaggatgaagccctttacgatgatctacttccacttaatgagtagaaaatatattttgtcttgcttatgattttcttaacattttcttgtctctagcttactttattgtaggaatacagtatatgatacatacaacacacaaaatatatgttagtcgactgtttatgttaaggcttgagttaaggcttgaggtcaacgataggctattagcagtcaatttctgggaaaatcaaaagttatattaaaaagtggatttttgactgcaaggggaggattcactgcccctaacccctgcattgttcaatggtcaactgtatctgcagacacacacatacatacgcatactctcactctctctctctccttctttctacaaagaggatccatattttccaatattccttccaccacctactccaagcagatcaaaggagtggtctcccaaggagagagacaatagaaaactgtacaaagacagcagcaacacgtactcattcaacaaacactccctgagtgcttgctatgtgcgtggattgtcctgggtgctgcagatgacacagggatgagccagatgtcttggccaacagagcttttccacctctaggggaagtctcagcagcacccactaaggaggaaaagcaaggagactttgccctgcaggatggctgatgaacaagggtaataataatgccacagcacaaagtttgtgaggattagaagagatgacacatcgggccaggtgcagtggctcatgcctgtaatcccaatactttgggaggccgaggcgggcagatcacctgaggtcaggagttcgagaccagcctggccaacatggtgaaaccccatctctactaaaactacaaaattagccggtcatgatggcacatgcatgtagtcccagctactcgagaggctgaggcaggagaatcgcttgaacctgggaggtggaggttgcagtgaaccaagatcgcgccattgcactccagcctgggcgacagagcaagactctgtctcaaaaaaacaaaaaaacaaacaaaaaaagaagatatgatacatctaaagcacttaggatgatgcctggcacgggtcgggactcaataaagagtggagttaaatcctgctgggtcctggtcttgtccatggctgcatgtcccagatggccctgtggacaacacccctctgattaacaggctctgtgtgcctcatccttctgcaccaagcacctcaggctctgctgatactgggtggccagatgtccactgaactcgggtgggactggaaaggactcacaacctccagcaggtgggtactgatgcagtacgcaggtcccctctctccagccacttccctggagagactgcttggctatggctcactactgtttccatcaggccacagtcagagggatttaactggcaagtctgattcctcactccctttccgtggctatgctcccaggatacagccgcactctttttcttttctttttttttttttttttttttttgagacggagccttgttctgtcacccaggctggagtgcagtggcatgatctcggctcactgcaacctctgcctcccgggttcaggcgattctcctgcctcagcctcccgagtagctgggactacaggtgcgcaccaccacgcctggctaatttttgtatttttagtagagatggggtttcaccatattggccaggctggtctcgaactcctgaactcatgatccacctgcctcggcctcccaaagtgctgggattacaggcatgagccacctcgcccggccccagccgcactctttttctcagcgtcagggctttgtcaacctcattgatctcctctcactctaggaccctgacagatggtcctgctgccagttccctagccagtgaggcactatttcacctcccagactctgcacaagctgttccctttgcctgcacacccttcccccggcttcactcttcctttgggtctcagcttagggtttcggcttagccatcgcttcctctgggaagtcactcctttctgctgcttccacgtctccatcgagcacttaccactctggccgtcagtacccgactcgcgcttctagtccacactggactgtgagctccaggagggcagaaatttggtctgacttggccactagcggactctacgcctgatgtggagttcagtatgttggggtggggcccaggcacctgcatttttaacaagcaccttgattctgatgcctcctgactcagggtctagtgccacgtctcgcacaccactgagtgggcgctcagtgtttgttgaatgactgcatgatttctgcccataaaataaggtgactgacggatggtacttttccctaggggaagtaaggctgcttgctaattagaacccagatagcggagtaacccaggtcctcttagaggttccagtggtggttggaattacccgggccgtgcccctacctccggggggatgctgtcctccagtggtggttggaattacccgggctgcgcccctacctccggggggatgctgtcctccgagtcggagctgtcctcatagacgccgccgctgctgccaccgccctccaggttcatctgcagcagctggtcgatggtggcgtccacagcgccgctgttggcgcgcagcacgcattcgatgatgtcgtaatccatgttggggaacatggtcttgaagtcgtccatggcctggttgaactccaggcggcgcacctggcgggcaggccggctgttgttgagctcctggggggcggccgtgcctcccccgcccccgcgtgccccggcggtgccacccccgccgctgccgctgctgctccggcggaacaggctggtcattttgcggagccgcttggggaaaatgtttctagccggccgcaaagccccttccccagggtctttccgccgtcagccgcttacttgccctgcggtctcgggcagctcactcctgcgcctcctcctccccgggtagccaggcagcaatgggctgccaagagctccgggttaggagagtacgggcgcggggccccaggcagcccttggagagcggtcctcgcggggcggtggcatgcgggaccgggccgtgctggggctgggcggccggtcatccacacccccggtgcatcctggcaccggtttcacggatggtcccacctgaaaccgaaagagatggagtcagggccgaggctaacaaaacatgagctcagggtggcggccaagggctactaagaaatgagggcagggaaccgcgacccctaccacgggcaagggaggcttgcttcttcctcatgctttctccccggcttcagtaatgaaatccccacagttctttactagcacaggacagccaccagttagcaagggattcctccgacccaggtgccatcctaagtgctctatgtgggccaactcatgacaatactgtaaggtatgtgctagtatgcccatgttgcagatgggaaaagtgaggtatagacgctgagttagtggaggagccaggatttgaatctgggacatatggccctcaagtcactggtctctaccattacacatactgccaaagacccctgaagacctgagtgaggcaggaggggctctttaaagatgtcctgcctctctgatctctagtccctgttctcatcttcccacatcactgccccaacatcgtggtcccaccaccagggcaggaatcttgtgcagagctccatcgaaccccggggacagcagtgatgagaagcgggaccctccagtgtcaccgggagcttccagcctgagagaggaaacagggtttcatccttgcagagcctcgggctaataggggaggcccagttcccactcttggaaaactcatgtcaggccctaaaactcagtccattcccctgagaagcaccagcccaaaagagagatgcaaggccattgtcaacccctggagttcattttccttaccccaatgtcaggccgacatgttttatttatatcacagacacgtttgttcttatggaacactcagtgtccttacatatttttaaaaattctagaagttttttctcaaagttgtcttgagaaaccatatacatcataaattctggttgtttttttttttttttttttgagacggagtctcgctctgtcacccaggctggagtgcagcggcacgatctcggttcactgcaaactccgcttcccgggttcacaccattctcctgcctcagcctcccgagtagctgggactacaggcgcccgccaccacacccggctaatttttttttgtatttttagtagagacagggtttcaccatgttagccaggatggtctcgatctcctgacctcgtgatctgcccgcctcggcctcccaaagtgctgggattacaggcgtgagccaccgtgcccggccataaattctgttcttatccccaccaagcccagttctcctgccccagccaatgtgtgtccctcagcccccagggtcagcacagtgtcctgacaacatgtataggtggaactgaaaatcaagcacaatgagggaccttaatctgccacagaaaaccacccggcccactcaaacccaggcatgtaaatcactgccaaggttgcatttctgttagcacagaccactgggaatggaatgcgcctaaacaccaacttctgacagtggcagctttattttaagggacaattccatcaaataatatccttgagtttgatgaaacaggtgcaaacttgttttcacttttctaggacttggagtcacaatcttaacagctgatacagaaatttttttttttttttcggtctcactttgtcgcccaggctggagtacagtgctgtgatcttggttcactgcaacctctgcctcccaggttcaagcagttctcctgcctcagcctctcgagtagctgggactacaggtacacgccaccacgcctggctttttttttttttttttttttgtatttttaatacagatggggttttgccatgttggtcaggctgttctcaaactcctgacgtcaggtgatctgcccaccttggtctcccaaagtgctgggattacaggcatgagcttcaatgcttggccaagatgtttttgtgagtacatcaacccctgagaaaatctgttcacactttagtgtgtctacatctcgattttttcttttctttttctttttctcttttttttttttttttttttttgagacagagtctggctgtagcccaggccggagtgcagtggcgtgatcttggctcaccgcaacctccaccttccaggttcaagcaagtctcccatctcagcctcctgagtagctgggactacaggcacgtgccaccacgcttggtgctaatttttgtatttttaatggaaatggggttttaccatgttggccaggctggtctcaacctcctggcctcaagtgatccacctgcctcagcctcccaaagtgctgggattacaggcgtgagccactgcgcccggcattattttttctttgcatataccaccataaatgaatttattttactaaaatgtaatcaaaccataaatcctatgcaactagttttttccacataataagatattgtggccatcttcccatgtcagaatacgtagggctacgccatcatttttagtgcctgagtagcattctgttgactgagtgaagcatgatttataatccaactccctctaccccatctcttcccagatgagcaagtcagagcccagagacgcccaagccatttcacaagaagacacagaggggtgacttcaaatgatcagtccaagagttttgctgtgagaaggaacataggaaggtagccaagtatgacatggcttcccatagccggctttagacaccccaacacccctacacccacatctccacgaacccacacacatcagaagagtatgcagcttcgcctgggctccaccctgacagctgcctttgtcctgggctctggggacctgccctcaagcctctaacacagacctcagggccaggaggccccagaagctgatgccttgggctactgtctgctgtcctagtgtcatcacacacaggggtcagtgacttgtgttaaggccttctggagtaaagccatcatctctctgcccctccagtaatttactaacagagatggagggacccaggtctcactctgccaaaggcaatccctcggagaaagatgacctgggccacccccaggggaggaagaaagaagatggcaagaccgacattttccccattagcagccctctggacagctccctcgggttctgggcctctctgagtgttgagaagctccagaagccttgcactcttgccacttatagggaacacgcaccagttcagacaaggcctccgcactccccagctgtgggacctcagacaagtctcccatcctctccgtggccctaagccctcatctggatgtatcccttagggggtttcaatgggaatgaaataagataatcctcagcacactgcctagaacgtggctatgctgcatttgagttatcattgccccaggaggctggtaaagagccaggagcagtgggtaaattggccaagctgccctcacaggggggatggggtagggagattctaggggggtcttccccagcacctggatgtcaatccctggaattctttcagccctctgtaaggaaatattgatcctcatggccccaggggaggctgggctggcctgggcaactggagacacagcagctcaagcagccgcttccatttggcccaagtgcaaagctttgaaagcatccttgtggggaccacaaaatgtaaaggactgacaactccagcccagccccacaccctgcctcacattacaggtgaagagcctgagacccaagtctaggagggagttgcccaaggacacacagcgagtaaaggcaaagtctagacttttctatcaaagggtggttctgtggatgaggagagtggctcagaaacagtaatgggaaacacaaggaagcagtaatgggaagcattttgattaccagaagtaccatttccacaggactctataaggtctcagagactcccaggctgcctatagttagaaccaggtggactatagaggcccccaattctcagagcactgtccctctctccccctggctaagctcagggcagagtctgaggccatggctgtggtgtgcctgggagcagggtcagagccgtccatgccaggctgccttttgcaactagcactgctcaaatgaaaagcagtttaaaatacacgaaaggattaaagcaagtaggcgacaggtttacgagcctgtgccacatgctttcacatttaatctttattacaactccatgagacaggtgttgctgtctccatttcatagctgtgggaaccatttcagagaggttgggtaaattgcccaaagtcacacagccagtatgtggagaggccagaataggaacccacttcctaagaggcaaaaaatgccaagtaaggctcacagggctatgagccaaggagcataagaaattcagccatgtgtgccccaggctcaggagactgggcacagcccagaggacatttcagcacaggaaacatgacccagacagcatggtagcaaggtctcttggctctgctccagagctggctctgtgaccttggagaaaccataccacctctcagaaccccagctgctgagcactggcagggaaacagagggacataacccctgactggcttctgaaaaaggaagcaaacaacccactgggctcatcagacctctcggaggctgactcaaaggctcccctgaactcatggttgtggatgacctggagactgggaagcagaaaccccacacctgtcctcctccaggtcccaggaagccaggatcacagtggccctccacctcccctgtgaaggaatccaggcccggcaggggcggcaaacagccaacctcctctcctagcataagcacgcagccaaggcctgagtcactcccggcttggcccacggaggtgggcaagctgccccagtgcagttcatctggccttgcccaaggtcatcccagccagcctcctgcctggtacatcagggccagcgagggtctgcatgggggctatgagagctggggagccagagtcctgggtgcactttgtgaccttagtaaggctgtgtgacttggggaaattgtttcatttctttgcacctcagctccctcatttgtagacataggggaggagtattaatagaacgtacatgggtacctggcgtataataagcaccagtgacacaggctgctgtggcttggggcacaggcctgggaccttttcccgggctagactcactccctgagcaatctcatccagccccatggcttggaataccatctgcatactgaacactggctctcatgtgctccaacctctcatgggcactcccctcaactccacactcatacagccttcttgctgcctccacttggacatccaacagcagctccaacaacatggatccatccgacctgtgattccctccgaccccaacctgcttctcccctgccttctccatctttgttaatggcaactctccctggctccagccaaaacctttggagtcatcttggagtgctctcattctcttatactctatgtccaatctatggcgaagcctgtcttccccgtcttccaaatgatttctgaatctggccactccttaccacctccacagctaccataccctccctagctccctgcctcccacgtgttggcctagagacccctcatcacaggggtcatgcccttcctctgctccatgcctcccaatggctcccatgtccccagaatacccagagctttaccgtggccaacccacatggtcctgcccatgtcacctcgctgtcatatgtgcacgcacacatacagacagagcctaactctctgtggccacctggatccttgctagtccaccaacgagccaagcacactcccacccaggggcctctgaacttactttttccaccaactgctacgttctgctcccacatatctgcatggctcccttccttctggtccctactcaaccatcaccttgagggggaacagagtggcaagtccaccccccaacatcccagtgttcctaaccctttaggcttccctgtcttcttcatgaaacagaccaccttgaatattatacatttgtcactgatatcttctccactagaatgtaagctccatgaaggcaggggctttgctatactcactgtggtatccccagtgcccgaatcagtgcctggcatggtcaatagacatttattaggcgaatgagtaaagaagggaaggaaagatggaggagtgctgtaactgtggatttccctccctttccttcctcctccggctcacagcaatgatgggagggggccttttcagtttccaaagccctctctcccctacacactcatttactcctcacaacaaacctagaagatatataagggaatgcgttattatctcacttcacagacaaggggtctgaggccaaggcagcccagtgacgtggacacaaggctgatggcaggctgcccctttccaagccagtgccagcaccagggggcaggaggctaaccccctcctagatctgacttgaccttccattctgccccccaggaggaccagggcccaaccctgaaaggtgggagttagaacaggaagccacaggtcccaattgccagcaccttcctgtgtcccacccagaggccactcttctggaaggagggtaagactcctcagaccagctctgtctctgtgcaccccaggctccctcctctgaaaatcaccaaggagcagaccctacgtccatctgtgactgccgtgatgcctgcctgcagagggatttgcttcttgcctaagatctggcacagcccagtggcgctgccaagccaggccactaggtggtgtcccagagctcaggccctggcagctcccagggaaagggccagagtggcttttctctcagaacccaagaatgtgccccacccccacccttggcctgattaaaagggagaagaaccacccagttgcctcaggggtcttagcacccaagacccgcagagttgtcaaatcatttaatcctaggcaggaaatctttggcacatgtgccaccaccttctagccctcatccttggcagacatcactaatccacccaggtattactgtcctacagaacacacacaacctcagaaccctttgcaacaccgcctctgtgcaagccacgaccaagtgattagaactggcatgcaagacaagccacttgccagcgctctcatttcccgtatgaggacacgcaggccaggctcactctgtctcattgggaatccaggctgcaaaagccagtggggccagaatgaggtcatatgaccctgggaggcttgtgtaaccatggttgagtcctgcggaaacctcaagtgtgtaatggcagaggctgctgggctggggcagctgcattctcggccaattgtcacctcagagcgggtggggtgcagggaaatctgcctgagcttcttggcttcagagctgaagaggccccaaaagggggtgaaaggaagggaagaggagagcaagagacagaggctctcagggtatgtgtgtgtgtgtgtgtgtgtgtgtttcaggcagccctgacagagacgccttgtcctcctgcccctgcaaaggcttgttttcttcccaagctattaatgtcgctgcagcttcaaaagccgggtgacctttaaacgctgagcctcctgctcctgcccaaggctcggaaaaggcttaatggaaactcgacccaaatggccacagctgccggggctgcaacaaagccagcctcattcccgaggcccccagagctgctgggcagccacacctgtgcccacccccaggcagccaggaagggcaaagaggaccctcgggcacagccattggagaaaagaggccactggaccttaggggaggaggaggaggagcaggggagagacagacaatgctgtcatgcgctgctgtgtgaccttgggtacttctctggaccactcatctcttctacatctgtaaaacacgagaatttggcagggcacagtggctcacgcctgtaatcccagcactttgggaggccaaggcaggtggatcacgagatcaggagttcaagaccagcctggccaaaatggtgaaacaccgtctctactaaaaatacaaaaattagccaggcatggtggtgggtgcctgtaattccagctactcgggaggctgaggcagagaattgcttgaacctgggaggtggaggttgcagtgagccaagatcgtaccactgcactccagcctgggtgacagagcaagactccgtctcaaaaacaaaacaaaaccaaaccatgaggatttgataaaaggactcctaaacctctttgccaggaagaagccccactgccacccagagaagcaggacacctggtttccatgcccacacagcagagctgccggcaggggtgaggctgggggcagcccctgccttccaaaggctactccatgagctgtgcaggctgggcatggcatgatgccttggccacccccacccctatcacttagatctgtaagggtggggcattcctttaaaaattgtttttaatctttaaaaatcagaagaaaggccaggcttggtggctcatgcctgtaatcccagcactttgggaggccgaggcgggcagatcatctgaggtcaggagtttgagaccagcctggccaacatggtaaaaccctgtctctactgaaaatacaaaaattagcccagtgtggtggcgcatgcctgtaatcccagctacttgggaggctgaggcacttgaatcacttgaaccaggaggcagaggttgcagtgagccaagatcacaccactgtactccagcctgagcaagagtgagactctgtctcaaaaaaaaatcaaaagaaaaaatacgattcaaaaaagaccttttcttttctaatttttctctctcctgcctcaacacttgtggccaagtctgtagccaatgggagatgtggggcagggacgagggcaagaggtttcagagaaggtgaatgaggtcccttgtggacaaattggtcccagagcctcagtcctaaggacatcatcattcatctctgctcctgaggcccaaatatcaggtgtggctgccacaaaaggcaccatcaagaagccaattctgccttctagtgaaaaagatccaagatgaggcttctcagcagagaaacatgtcatttgtttggttcatcttagcaagataatggtcataatagtcataatgagaatagataacacttattgcctgcttccttatatgctagccactactcaaagtgccttattgcatgttaactctcttcatcctccctacagctctacaaggtgcatattactactgctatttccacttcatagtagaaaaatgaggcgtagaagggttgagtaacttgttcaaggtcacacagctaagtggccaagctgaaatttgaacccagaaggtccgattccagatttaacactctgtatccattgggcttgatcaccattccatattccctagagcctagcacagagctgggcacacagcaagaactcaataactgtgagttaaattgaatactaaaggacagggttgcccctggagaggctgggggtgcctgggtgccactggaggtataagggatggtgcttatgtccaggaagcaaaggagaagacaaaacagtggcagtttcctcacaaaacctttttcccatcctactgaagttgtcaagttgcctgagcaaccaactgttttccaccacaacctgggctggctggggactatttccacaacagtccctcactccataaacaaaagccaccagctcagccaagatattcgactcaggtgcctgggaggagatcaaacctcagcggattaagggggctactgtccccctgcccctcccctcccaggtgccacagctctaggggaccccactgggctggcaggaacacgcgcgttcatgctaccaagtcaaagggcccacgctggaggaagggggccactggtaactcaggtgcagggccaaggaagctgggttggctccaggcatgagctcatactggaccaggcccagcttcttgggaaaaggggtcagctgctcctccctgggcttctcctataggcagtcaggctgaaggcccccccagtaggctgagttctgaggtctggacagcagcaggagacacctctgggtccccggacaggcagcaatccatgccccacaatttagcatccgaacatgcccaggtaatccgggtcaaggaacccatgattagaaaggagtgctcaggatgggcagaggagggtcctgcaaacagaactcccaacccctgcccttgccctccacactaaggcacactttgcacctacctactgattcaggaattccacttctatgaaatttacctacagatgatatgtttgcaactgtgttgagtatgggcataaggatattccttgtaatagtctaacagcagaagactggaaacactctacaagtctacccgtagcaggctgatgaaaatatgatacattatcagcatcctcctctctctatataatgctattcaataacaaacaaaaatgagggatttcaatatgtctctttagcccaagacctaagggaacaatgcaaggtacaaaacaatgagtatagtcactctactatagtgcattatggggtgtgtgtgtgtgtgtgtgtgtgtgtgtgtgtgtgtgtgtatgaaatccgaaaggattcacaagaaactgataatatatgtttcccctggggagaactgggtcataagagatagatcaaggaaatttttccactacagattcttgtatacctctaaaattttgattgatactcatttattaatttaaaaataaaatatgcaaataatccattattattggattactaagaacattaaagtaatagcattgccagtgatttttatatctttttcttctttctttttttttttttttttttttgagatggagtctctctctgtcatccaggctggagtgcagtgatgtgatctcagcttatgcaacctctgcctcccgggttcaagtgattctcctgcctcagcctccagagtagctgagactacaggtgcgtgccaccatgccaaactaattttttgtatttttagtaaagatggggtttcaccatgttggccaggctggtctcgaactcctgacctctgataatctgcctgcctaggcctcccaaagtgctgggattacaggcatgagccaccgcgcctggccatgtcttttgcatattatatcatctacagcagacataagttactatttaataataattatagcaaacgtctatgagcacttggtaggtacatgcattttctatatacttggcatgcattatctcatcaaatccccacagtacagcaatgaatacatccatttcacagaaaagaaaactaaggctcagagagattaaataacttacacagggtcacatagtcagtggcagagcccgatttggaatccaaacagtctggccccggagtccatgatcttcttaacttccaacctatagtgtctctaattaaaagtttttctagccgggcgcagtggctcacgcctgtaatcccagcactttcggaggccgaggcaggtggatcacaaggtagggagattcagaccattctggctaacacggtgaaaccccgtctctactaaaaatacaaaaaattagccgggtgtggtggcaggcacctgtagtcccagctactcgtgaggctgaggcaggagaatggtgtgaacccaggaggcggagcttgcagtgagccaagaccgtgccactgcactccagcctggtctcaatgaaaaaaaaaaaaaaaaaaagtttttctagaatgtctttactctctaattaaaacaaaattttacaaaacctgaattatggccaggcgcggtagctcacgcctgtaatcccagcactttgggaggctgaggcgggtgaatcacgaggtcaggagtttgagaccagcctggccaacatggtgaaaccccgactctactaaaaatacaaaacttagctgggcgtggtggcaggtgcctgtaatctcagcgactcaggaggctggagcaggagaatcgcttgaaaccaggatgcagaggttgcaatgagccgagattgcaccactgcactccagcctgggcgacagtgcgagactaggtctaaaaaaataaaaactgaattgtggtagaaaaaatcttaagaaagcaaaccccagagcctccagggctttaaaaccttttcaatcctaagaatcccaacccaatccttcctgctctgatcatttaggcaggctttcttcagtcactgcaccccatggtgcaccctccaaccttggtcagggactcacctgcctcctgctggggatgcagggaaggaatgagggccgagtggacaaagtgctggctcatagcatagctgtttcagaggtagaaccacagtgtggagggcctgttggggcacaacagggctgggggtctggccaggaagctgccggtggaggggagaccacaagttgtttactggtgctatgtctggggtaggaagccatggagcgagtggtcaggagtggggctttagcctgagtggtcaggagttgggcagtcctctgcttacctcctgatcctgcagcttatggggcaagcaggattgctctgagcaatctgtaatatggggatacatataccttctcagatggcgctcctgcaggggattgactgtggtgggcatgcacagcaccccacaagggaagctgtcagtcagaggcagctgttagtaagactctatgagcacgggccattcacaccccaaggccacatagttccaaggggctgattctagagtctggcccaggcgtctggcctgggaatccagccctgaagggagtgaatgtggagcacaaaggcctccccactcagggacctccaggacctcaggctgagagggctcagggaccccaagggaggagcagggagctgggccagcagccctgtgcccattcctgcccataccctgccctccagctaagcttccaagggtaggagaagtgattggaataatgcagggtgcccactcctaaccaggggaaggaggtggcttgaaggggcctgtcccccaagggaggggctccatgggctctgggcagcaggagcacaggcagagtggccctctcagaaatgccttctctggcagctgaggaatgtaggcccaggacagaggaacagaggctgggagggaggggtggctggcccagggctgagcttcaaaagagcaggcagcagctgcggctgggaggccgcccgcctcaggcagccgggacaccatcagaaattccacccagagtgagaagggcccagcccagacagcagatgggataatttagagccactcactgctgggccagctgcacccccccaaccacagactgctccctccacccggcctcagcccctgctccgcctgtgtagcagcagcgatccccttgcacagtcaggggcgcccagagcccagctgcccaggtcccctctcctgcccatccacatacccacgtgcccacacgtatactctggagctgccacggttagggaggcaggagaaacctcatgttttcacttccacatggtgcatgttgccagaggtcagagagcccagtggctgcagcactgggattcgaacccagatcgtgagactcctggccagtgctctctccttgtatgggcacatacagcagcacatgccagcacacagctcacatgcctgcatgtgctaacaggctcccactcactgccacacacaccagctcactcaaccccattcacttgcacagtgccacatgctcctcccaggccctcgcagccataggacacagacaacactttaggattttttttgaaccgtcccacacagcccaggcactcaatgtactactcccctcttcgcccaactctgaagctatgtttttaaaattacagtcactcttctatacacactcgctagtgcgcactgacagcaccctcagccctcccacagcccaccctccaagccacccccttcattaggctgatagcagggccagatgaggccctgggatccctctcttcccccatctgcacccagaatgggttttacagcattggtaaggtcaggctgacctgacttgcagcaaaactggccagaaccaggaagtggcacaccctggccaagacaccagcttcctggttccctgcaggcccagctcctagaaggcagtgcagggaaggacctcaggccagctggggctggtagcctcagccccaaatctaacaatcaggggaagggggcaagagcttttaggggtcccataaccagcttcctttcgcctcccgagggcctcaatctctacttctagaaaatggagagaaacagtccctgtttggtctgatcattgaaatcttccagggatataggtgggggctgggggagccggtcaggaccagagaaaggcaccactgttctaggcacaaaccaggatgagccctctgcagaaacagcctgctgcatcctagtcccccagggatggaagggtctgtacactttctttagctacagaaccagaacccctttcttcaaatgaaaccctcagcagaagtccattatgtaaaggcattaaacagaaacctgccctcatccacccccagcaattatgcatcatcagagaagctgccatttaccaagtgctaggcaaagtacttctcgtgcatcacatcatttaatcctcgtgacaatgtagtagtgcaggttattaccttccaccatcatcatcaccattttatagatagatacactgagtcgtgtgtgacctagaggttgtccaggactgcgccacattgaaattgcatgtacatgtcaagtctcctgacataccacttacttgcaatgcattttaaagcctgggtttaatccctcatgctctcatctttaaagctgtttgcatctctgcctgttctgctcactgctactgatgaggcttcaggaaatgcaatgagcttttccatcagtctaagaagtcaaatgttctttgcactatagcaggtgtatctcagaggacggtggcgaccaccttcctcagactcccctgaggtgtttgctaagaacccatattctctaacccactattaaatcagaatctctgagaacatgctctggggatgtgctttctaacaagctccctgggtcattctgatacacagtaaattgtgaggaccactctcttgcaaggtgatgcagttcagagacctggatgctggttttggtcccatcactaactagccaagtgacctcggacacatcattttacctactgggcctccaggtttccatccggaaaatgggagggtaggactaaataatctccaagactcttttcacctccaacattctctgtgtccactctaggttcccagctggtccacaggtatacaaactgactttcacagactgcttggtccctgtagcagccagcgcacactgtagacactcatgacataaagttcctgtctagttgatttaaggaaacctgaaaaaataccttacctctggctctaggccctaaacagatggcttttggatcatccatgccacctacccctcccctgaatatttattttcttcattccagccccagccgtgagccaaccaggactctgtaaacactgagtctgcacacctgggcttagtcaacagtcatcaaacaaaggcactgccaaatcacctcacaagcccaaacttgcacctactctgtctgtcacagggaagcagccacctgggaggtgtgaatggtgtgctccccttctcccaacacagaatgggcatgagggattgggctgtatagaggatgtagccggaacggccccagcctacaaatgggttgcaagtttaattagacttaagggatatgagaaaacagcatgagaagcagccagcagttgcaagaatcttccagaagcagctagacatttctcagtcccttggcttcttcgataatcatcattaaaatatgatgcactggccgggcatggtggctcacacctgtaatcccagcactttgggaggccgaggcaggctaatcacctgaggtcaggagttcaagatcggcctggacaacatggtgaaaccccatctctactaaaaatacaaaaattagccaggcgtggtggcaggtgcctgtaatcccagctactcaggaggctgaggcaggagaattgcttgagcccaggaggcagaggttgcagggaggcagaggttgcagggagccaagatcacgccattgcactccagcctggaagacaagagcgagactccacctcagaaaaaaaaaaacaaaaaacaaaaaacaaaaaaaaccatgatgcattcagtgcttgaacctgggaggcggaggttgcagtgacctgagatcacaccactcactccagcctgggcaacagagcgagacctccatctcaaaaagagaaacgatgatacattcaggtagtgcttgaacactgcttgctggtggcaaacatatgactgactcgtcctgcaaggtctgtgtatccctaacagcagagttgtggggattagcagacccacagcccggacacgggttgaattgagattcatgctacctttgtgtatggtgaacctgtgtgcatgtgcaaaataactaaagaggaaggatgaacaggaaaggcaaggatgaaaacccagcttccacaggggaaacatctgtgaattgtagccaggatctgctgatactagtcatttgagaatcccaagatagattatcctctcactctgaccacactgactgtccacaatgattgtgctttacgtgtgcacagcactcaacagcttaagacgttgcgggaaagtccccgaacgctttgcattcagccaggctccaggttgggcacaaaccctatagcagagagctggcccaggtgccatgccatcctcacaacaatcctatgaagtagggactgttattttgcagaggaggggattgaagtacagaggagttaaataccttgccccaagtctcgcagccaggagtaaccaggtcaggattctaccccagagcccacactccaacccctcaccatgttgtcaccccacttacaataatgaatctctgcacctctgcatgggacaaagagggaaactgagtcttccaggagggctgggcacttgaggccatcctggcaatggtcccacctccagccatcctggaggaggagcgaagccactgcgttgagtgcgtgggtgcagtgggccagccagggaacagggaggtaaaaaaccaagggggcacctcagctctgagctgggcaggccaggccccacctcatgcttcctctgccacagcagtcccaggccaggagggcaccttgccaggctccactgccacccagaacatggcctccctgtcctggtctgggttctcctcgagttgtatttccatggcagccacaatgggcagcagccagggtgagtcaggccaggcaagaggaagtggccacacttgaaaattattaacatgcagggctgagcttgagtcctttgttcttgagcaaagactgtagcatttcactttcaggaaggagctaggagggtggggcaggctcagaattgcacaaccaaagcacaggctcaaacacacacaggtcccaggtggaagtcagcttagacaggccacctgcagaaaagtgcaggccaacccacagccccatacagcaggtccacagagaaaatacaggccaactcatctccactgttttttaaatcagaggctgggcacagtatatgaaaacctatataatcccagtgctttgggtggctgagatgagaggaccacttgaggccaggagcttgagaccagcttgagcaacatagagaccctttctctacacaaaaggaaaaattagctaggcatggtggtgcacacctgtagtcccggctattcaggagggtgagatgggaggattacttgagcccaagcgttcaaggctgcagtgagctatgatggctccactgcactccagcctgggtgacagagagagagaccgtgtttcaaaaaaaaaaaaaatcagagagggtttccaacagggataaaatcagggtttttgtggtcaaaagtgttccaagtcagggagaccaagcaaaggaggcacaaggccggccacagagggaaggatgggactctgggcagccagaccccagtgggagccctgcgtctgggagagatgaaagacaccccctcaccccagctggcagggggcagccccagctctaggaagactgccttcctgcacccccttgccaaaagatggcatctctcctccaaccatgcagctgtcctggcccccctaccccaccgcgtctcctaggtgagaaaaacacccataaccatcctcacgggcacccagcaaccctgaaacactgtgtctcgggcaacttttcgagctgcagctgttccctgaaaaagtcacacatcagccaccaggagtggtgggaaaggctgaattctggagaagagggatgaaggttggggaggtgggagggagggaagggaatatggtcaccagaggaaaaaagtcaatcaacgaggaaaaatctgtttctaaaaatgtaatgcaaacaacaaaaaaacaggctttgagcaagccttataagccctggggcccaggcctgtccttagttccccgggaatggcccctgctccccgtcccatttcacaggggtcatcaagaggctaagatttcactctgctcccctcctgcacttcaggagagcttaaccttgaggccttcaaggaaattgggagaaatgggacccctgtcctttggcaattacaaagtaaatggccctaggggctaggcgtggggggatcgccctaccgtaggggagtgggggggcctcattcccacccttcctcggctctgcaggggtggctgcagcagaggtggcttgttcagggaagctacctgctccatccgtgctgggaccacaggggcaggccacccaccgggtccaactcatccccctaccaaagcagctctttttgtaaagggctttcggggacaggaagcaataaacagagtcaagcggccaagatgcaggggctgattatacagtttacggattttccaggcctttttgtactctcccaccagctgcccggggctctgcagaaaaaggtgctggagaaagaccggctggtccctggctttacaggtggccttttgccaggcctaactgggccttcctgagcgaatgagggggctgcatgcctcgagggtcctgcaagtcaccatgaagaacactgccacccggtaccactagagaccagcaggctaatggctacagcttctctctctctctctgacacacacacacacacacacacacacacacacacacacacactccagcctgctgctcaactctccacccagctctaagtcactctggtattccagaggggaggggatgcctggctgcgcgctgcctgcgtgctgaggccaggtgggtggccctccttcacaaggaagctcacagctcagctcagtttagctgcactgggggtggcaagcaacttgggaaagactgaggctggcggggaagatggctctgggctggagggcctccccagtgcgtgctcagctcacattccccaaacaggctatgatctggtgaaacacaggcccacgcgtgcaaagccgtaaatgcagagctaaaatggggaaccacccacttgtctctcaataccccatatgcaacaaaaaacacagggcacatccacatgcagccaacaccttccagtgccaaatagaatcgcatgaaaaaaaccaagtggccaggccatgtgtacaccgtaccatttttgttcaaatgtctggatgtccatgtgtacacttgggtacacacaggaagacgtctgggtggatatgcaccaaatccaaggcagcagttacctaaaaggaagggttgtgtgggggcaactcctgctctttgcttcatgtacctctgcaacctttggtgttcttacaagaaatatgccttgtttctgcagtttaaaataagatattaaacaaaataaagttcattgttggtggcaatgtaaaatggtacagccactatgaaaaagatagtgaaacacagtgaaaaaccacagtttggtggttcctcaaagttaaacacagaattaccatatgctccagtgattccattcatgggtatataacccaacaaattggaaacaggactcaaataggtaattgtacatcagtgttcatagtggtgttattcacaatagtccacagctggaaacaatccaagtgtccatcaatagataaatggataaacaaaatgtactctacatatttagaacaatggaatattactcagccacaaaaaggaatgaaatgctgacacatgctacaatgtggatgaaccttgaaaacattatactaagtgacagaagccagacatagaagtacaaatattgtataattccacttatatgaggaacctagaacaggtaaactcatagagacagaaagtagaatagaggtttccaaggactcagggaagagggagaattggggacttattacttaatgggcatagagtttctgtttgggatgataaacaagttctggaaatggatagtggtgatggtggcacaataatgtggatctactaaatgccactgaattatacgcttaaaaatggttaaaatggtaagttttatatttagtatgttttacacaagaaagagagagacaaataaggcaccagattgtagaagacaccatgagtcaggccaggtgcggtggctcatgcctgtaatcccagaaccttgggaggccaaggcgggtggatcacctgagatagggagttccgagaccagcctggccaacatagtgaaacctcgtctctactaaaaatataaaaattagtcgggcgtgatggcgggcgcctgtaatcccagctactttgaggctgaggcaggagaatcgcttgaacccaggaggtggaggttgtgatgagccgagatcatgccattgcactccagcctgggcaacaagagtgaaactctgcctcacaaaaaaaaaaaaaaaaagaagacaccatgaatcaccatcaccaggcagaagggggcactactcgggctatttagagagagggcagccagcacacaggaaatcctggcctgcacagaggggctctgtccccatctgcatggagtgggctgggagacaatgacacccctgttgacgagggctgttcagatggcctgcagagtcacgcatgccacaaggctgggggagacagcactgcagggatactttgtggacatttgaaatccttgcgttatgatacgctaggaaacagtattttaaaaggctagtgtgctggaaaacgaagcatgcatcagggaaccttggacaggaggggactggggaagagagatactggaggaagtgggcaggagaggctgggagaagaggatcagcagtctgtcctagaggaccctcagtcaggctggatcattcactccacagacgggagcatgctcccaggttcagggtagtgggaaagtgggggtaagggataagaggaccctatttacatctagtaaatacctctgtacatcttcagtacccccacaaatcttgttcaaaagtacatactgggccaggcgcagtggctcatgcctgcaatcccagaactttgggaggccaaggcaggcggatcacttgaggtcaggagttcgataccagcttggccaacatggtgaaaccctgtctctactaaaaatacaaaaattagctgggtgtggagacaagcgcttgtaatcccagctattcaggaggctgaggcaggaaaattgcttgaacccgggaggtgaagcttgcagtgagccgagatcacgccactgcactccagcctgggcaaaagagtgagactcaaaaaaaaaaaaaaaaaatactgtacctatctaaaatgagaaagaaaaagctgccagtgcaccccaccccccaattcttgcagaaggcccaaattcctgtgacttgaggccaagccataagatccagaatagggaataagataaaaactgccagggtgagctgaacaccgttgtgactggacctcgttcacacacgcatgcccacgggccagccaccaggcatcaggttctttttgagacgaaatctcgctctgtttcccaggctggagtgcagtggcatgatctcggctcactgcaatctccacctcccaggttcaagtgattcttctgtctcagcctcctgagcagctgggactacaggtgctcgccaccacacctgacaaatttttgtatttttggtagagacgaggttttgtcatgttggccaggctggtctcaaactcctgacctcaggtaatctgcctgcctaggcctcccaaagtactgggattacaggtgtgagccaccgcgcctggtcatcaggttcttcttgaaggagagaagcacagaggagcttgggcacacccaagtagggccccacatgctgagaactgtgatgccaagacaggcttcccaggggcacggtttcctgaggtttagccacatatctccaatcatgcaagggctaagagaagccttgtgtggggcacatttgtggtcagcggcagctctgcctcacttgagataacgatatttaaagagtagattttttaataaaaggatgttgtatccaggggcttcctgaaacatgccaggtattatttgtggctgtgtgtgtgcatttgtgtgtgtgcacgcattagaaagaagacaggtagctttgaaagatcataatgtgaccaggtgcagtggcttacgcctgtaatcccaggactttgggagactgaggcaggtggatcacaaggtcaggagatcgagaccatcctggctaacacagtgaaaccccgtctctactaaaaatagaaaaaatcaactgggtgtggtggcatgcacctctattcccagctactcgagaggctgaggcaggagaatcgcttgaacccaggaggcagaggttgcagtgagccaagatcgcgctactgcactccagcctgggtgacagaacgagactgtctcaaaaaaaaaaggaagatcataatgtagccactatggctgtctcagagacctacttcttctagaacctactgtccaataaggtagccactggtcatgtatgacaataaaaattttaattttaattaaaattaaataaaatgtatttatttgttaattttttttgagacgaaatctcgttctgtcatggcgagacggggtttcaccacgttggccaggctggtctcgaactcctgacctcaatctgcccgcctcagcctcccaaagtgctgggattacaggcatgagccaccgcacctagcctaaaattaaataaaatttaaaatgcagttctttggtcataccatcacatttcaagtgttcatcagccattatggttaatggccatcatattgaacaggacgtattttagaacataagccctgattcactataactggaagagctttattatgactttctgagggagaccaaggactatggatggtcaatccccagcagaggagcccttccacatctcctgggcaaacagagctggggtgagctctgtgtcctctcatcactgagtcctcagcctcatccaagatcaaagcgttggctgtttcctgtgaaacttcacacccaggcagagagaagctggggtccagctgggagcctaaattctgatgtccacactggcagggcccaggcctcagaggaccaggctcagaaaggctttcccagtttgtctcaccaggaggaaggatgtcttaacatccccaggctcctcccctgttccctgtcctgagtgtgcaaatgcaaaactgcctccttgggcttctccagagcaatggggaggagtcagagaaaaagggcagctgaggcggggtatgcatgtgtgtgcgggtagacagcaggtaagtgcatatcaaagagaacccaacggtcaggctgaggaaataaccgaaagaggttctagcaacacaatgactgggtgtttggttctggttttgttttgttttgttttgttttagagatggggtctctctcttctgttgcccaggctggagtgcagttgcaggaccatagctcactgcagcctcaaactcctgggctcaagcaatcctcctgcctcagcctcttgagtagctgggatcacaggcacacgccaccatggctggctccctccatccctttcttttccttacaatttctgtgttgaagaacacaggccattcaatggcagccttctccacagactggagttcatggagtaagtttttttttcttgctaaacctcagtgacctcccctgctcagcccatggggcccctgtgacaataaaaagaaaaagtacacctgaaagcacatagggaaatgcttacgatagtttaagcaaagaatacaagatgcaaatgagcacagaatacaaattaacatatatatgttatgttttcaaccacagaaaaaaaaatgcatagaaaaaaggatcaaaaatatatatgcctagggcggggcacagtggttcacacctgtaatcccagcactttgggaggccggggcaggaggatcgcttgagcccaggtgtctgagaccaccctgggcaacatggtgagatcctgtctcttaaaaaaagaaaagaaaggaaagaaaaagaaaagggaaagggaaagaaaggaaaggaaaaaagagaagaaaagaaaaaagaaaagaaatatgccaaatatatcaataactgtcctggatggtacaactctgtgaacaccccctttttcttcctttcttatatttttccacaattagcatatcataatgtgatcatgaggtgacaagtcttctttaaaacatttcaaagaagagtgcccttaaagtctggcatgagacccagtgtgtcaccaggccttcacagtaccccctggctttgctctgttaccatggccaccaccaatccagctgagaccctcagcctcccaagcccgcttccctgatgccttcaagctcctcttgccgtctccctcccattttctccctatgccaccaacggaagagcaggccaggtcccctccgaactcctcagtctcttatgtaaagatcacatccctccctctgcatcagcggtcctcatgctcagcaagcatcactgtcacctggagggctggttaaacacacattgctggcctccacccccagagttcctgattccctgggtctggggtgaggtccaagaatctgctatctaacaagttgttaggcgatgctggcaccactggtccagggaccacacctgtctccctaactaagccctgtccatccttcaagacctcgctcaagttcccctgtcccatgaggcaatctctgagaacttcagccaatattgatctctctcttcccttccagagcacctgttcctcttaagggtggtttggtagatggggagatcacttagcggccataatcaggggcagtgtagcacttcatcacctgctgtcttgtgtggctggctctccttcatcctaccagctctcttttttcttttttcttttctttttttgagatggggtcttgctctgtcacccaggctggagtgcagtggtgcaatctcagctcactgcaatctccgcctcccaggttcaagcaattcttctgcctcaacctcccgagtagctgggattacaggcgtgcgccaccacacctggctaatttttgtattttcagtagagatgggatttcaccatgttggccaggcctgactcaagtgatctcctgatctcaagtgatccgccctcttctgcctcccaaactgctgggattacaggcatgagccaccgtgcccgtccctatcagctcttaagggcagactgggacagacatttcttaagtgattcctcattaaccaggaggcattcctcatgtcccaggtgaactgaatctgtttcattctcaggcaccccagtgacattcacaaacagacttctaattattcactcgctcattcactggcagtcaaaaaacacttactgagcacctactgtatgtcaggatgcgcaagataaaaacctcttttcttcacagaggccaagaattacaacagcatgaatggcagaagcctacagaaggtgctctgtgaggatccctcccaaccgcagcccaacgcccccacccctggccctggagaccgctacacacacacaaccttggccccagttgcaggtgctggtgcctgccaacaagcacacacagttgcagtcacaccctcgtgtaaccatggtgaggatttggctgccggtcataggctccattgttccccagctaagccaccctggactcggggacaggatttatgggcagacattgttaggagaacagatgttcgggcaggcaggcctgggacccgctggagggagtcaagaagacactacctcctaattaataggcggtaaatgtctgaggaacagactcctgtcccatttcttcaaacatctggggttccggacacttaggccctctgccaggtgagacatttggagcaggctgaagagatcatagattctggaaggtagatgttggtttctctgtgatcttggacaactttttacttgtttgtgcctcagtttcactatctactaatatttactacttaaaaaaaatagtaaagccaaaaaaaaagatgataaagacaccgtttggaagaataaagggagagtaaaaaacaaacaataataacgccactgtgtaaaaataaactgcaaaaagaccactcagggaagctccatcaatgccttggcaggaaaattctaaacgtatacaggcctacctggcacactgattctcaactagaggggtgcatcagaatctccggggagcctttttctttctttcttttttcagagacagggtctcactctgtcacctaggctgtatgtagtgcagtggtgcggtcatagctcatcgtagcctcaacctcctgggctcaaaagcgatcctcccacctcagcctccagagtagctaggcctacaggctcataccaggaccagctgcttacattaaaacaaatttttgtagaaactgggtgtctccgggcacagtggctcacacctgtaatcccagcactttgggaggccgaggcgggtggattacctgaggtcaggggttcaagaccagcctggccaacatggtaaaaccccgcctctactaaaaatacaaaaaaattagctgggcgtggtggcaggtgcctgtaatcccaactacttgggaggctgaggcaggagaatcgcttgaatcccagaggcggaggttgcagtgagccaagatcacgccattgcactccagcctgggcaacaagaacaagactccatctcaaaaaaaaaaaaaggaaaagaaactggtctcactatgttgcccagacttatctccatctcc

SEQ ID NO: 422 - DNA, 27003 bp, Homo sapiens
ctgcacctagcaaaatattttaatttaatttgtctttattgttttgttggttgacggtttccacaatgccagtcttgtgtgagcatcttagctacatttaaaaaaaaaaattagcctcaggccgggcacggtggctcacacctgtaatcctagcactttgggaggccgaggtgggcggatcacctgaggtcgggagttcgagaccagcctgaccaacacagagaaaccccgtctctactaaaaatacgaaattagccaggtgtggtggtgcatgcctgtagtcccagctactcaggaggctgaggcaggagaatcgcttgaacccggggggctcaggttgcagtgagccgagatcacgccattgtactccagcctgggtaacaagagcgaaactccatctcaaaaaaataaaaaaatgtagcctcaaaacaggtctctgaggtatataggctgcaattattcctgctttattaatgggattgtggcatccagaggacttaactaactttataagatcacatagctaataagtggcagagctaggatttgaagccaggtctaatggctccaaggccaatgtaataaccagaaggcaggacagtgaagagctgtaatgtaggtactcacaagccacctgaagaacttgtgacttcttcctctctctcttctcttctcttttggcccaggctggagtgcagtggcacaatctcagctcactgcagcctcaacttcccaggctcaagtgatcttcccacttcatcctccccaagcaggtgagactacaggcgcacaccgtcatgcccagctaatttctgtattttttgtagagacaggattttgccatgttgcctaggctgctcttgaactcctgggctcaagcgatccacctgccttggcctcccaaagtgctgggattacaggcatgagccttgtaatttcttttcaaaggtgagggagaactagagaacaatatattgagctaagagtaacatggtgaaagatgaaacagacaccatttcctcaggagctaccctatctcctcttgctccagggggcagacccccccacacccagccaggcttcacctccaagagcaattcagtgctaaaatggcgtcacccctgggacaggtgatgctgcttgccaccagtattcggaccaatgtcaacttccagggacggtgtaaccccttggaaacactgtaaaattctcaggagttacagtttggatcttctttgtctcttttccttgaaagagtgtttttgttcttcctccaaggtgatgaaagtacagctttctgtgtttgtgaggggagaagaggatttttgtttgacctgaaatttctcctcactctgttttgtttgtttttggcttttttttcttcctttgagatggagttttgctcttgtcgcccaggctggagtgcagtagcgcaatcttggctcactgcaatctccgcctcccgggttcaagtgattctcctgtctcagcctctcaagtagctgggattaacaagcacccaccaacacacctggctaattttttgtatttttagtagagacgaggtttcgccacgttgggcaggctggtcttgaactcctgacctcaggtgatccgcccgcctcggcctcccaaagtgctgagattacgggcatgagccaccacacctggcctctccttactctgttataagcctgttcctcaccatagcttcagattcccttcatttcatgttttttcaccaagaaggctcaagaaacccaatcccacagaaactgtgacggaacacctgtgctggagccgtgagtttgtctttgggttctccacccgctgcccggcagtccatcagccctggctctgcggggacggagtgggcaggtggcaggccaggggctgtagtgggccctgcagggatggaacggggagggtgggttccccagggttccatcctgcggagggactcatctgcacacacccgctccccctcctgaccaaactggtggcttttggggaggtttgtataaaaccctgagaaggactcatttcgtgggtttggatatagacaacgacgagaaacccaatatttatcaaggcactaaatgtatttcataggttcacatttcatcctcacagtaacgctatgacacaaacatcccagttccctaccacccgcccccgccatattacagatgggaaaaccaaggcttaaggccacctaaggtgtccatggccacgcagtctgtaaatgacaacactgggaggatttgtctctgcaacctgacttcgagtcatttgcattcccgtctgtgtgggactctcctgcccacacactcttttctgcctctcatcctcaccagagcctcggaagatgggcagcgcaggtgttaggttcccccacattatccatggggaaattgaggctcaggaagttagtgatgggcctaagatccagggtcaggaaacgggagctggggcagagcaccggggtggtctgggtccaatttatccgttgcgcttcccaccccactgcacggcctctgtgactggatccccaccctccagagaagggcgctaacatctacgagtgtgactgcagagagggctcctcatttgcctcaggttttgtggccaccagaggctgatagaacattcactcactctcaccctcccacaatagggaaggatttccctcctgtcaacaaggagactcaggggaactgcttttctttctcttttttcttttttttttttttgagacaagttcttgctatgtcacccaggctggagcgcagtggcgcactcactgccagccttgacctcctgggttcaatgtgatcctcccacttcagcctcccaagtaactgggaccagctgggaccacaggtatgtgccactacacctggctaattttttgtatttttttgtagtgatggggttttaccatgttgcccagctggtctggaactccagagctcaagagatccacccaccttgacttcccaaagtggtgggattacaaagtgctggtgtggtgagccactgtccccagcccaggaactccttttcgttttttgtttgtctgttttgagacggagtcttgttctgtctcacaggctggagtgcagtggcacaatctcggctcactgcaacctccacctagttctagtgattctcctgcctcagcctcccgagtagctgggactacaggtgcacgccaccacaccccgctaatttttgtatttttagtagagacggggtttcaccaagttggccaggctggtctcaaactcctgacctcaggtgatccacctgcctcggcctcccaaagtgctgagattacaggcatgagccacttcgcccagccaggaactgcttttctttaagacaagcgtggcccatttctcctgggagggttggctcttaatagctcactagaactgatttttaaattttcaggaattttatgagctgtttatatgaaacagccaatttaaaaaacttaaacctacaattgagttatattaaaaacaaaggtaatagatactcaaaactgatcatttcctagttattttactacatgttactgttatctgtgcccttgaggttatttacatttacctatcagtatggtggaaatactacataatggcatttactatgtaataataacaacggtaaagaacatataatgctactatgtgtctctttccaaccctgtttactggcatcacattggtagtttaaaattggtcacgttgggagtatctacaccacagtaatcagcaaacattacaaatcaaggctattccgcacacccccgcccctcccagacctggttgttaaacatttatttatcatcacatcactggttaaggacagtctgaggctcagacggttaactgtggggtcttggcaaagaccttccagttttgtcaaagatctgggcttccttctgcataaggagatagaatttatttactatcattgggccaattaaccaagtgatttagagcatttgattcagtcctcttgaggtaggaggcggggctcggacatggaaccaaattaaggactagctaaaacaggtaggggggcagaagcagctttccatgacatgcctgccagtgtgccatgtcagtttaccattgccatggcaaaacctaggagttaccatcccttttcgtggcaacgacctgatgacctggaagttactaccctcatcctggaaatctctgcataatccaccccttaatttgcatataattaaaagtagatgtccatatgagtgcagccctgcccctgcgttgctcttctgggcacactgcctctgggtagccctgctccacaaggagcagtacctctgctgctctgtgcactgcggcttgctggctaccaccactgctgcttgctggaattctttctgggtgaagccatgaaccctcctgggctaagccccaattttagggcttgcctgtcctgcatcactcttgtttgtctacccttctatttgtcaggtgctgatatgcaggataaagaacatgagaaggctcagtcttgaactccagaggtacaggaggtggacagtgtctgtggggggccccacccatttcaagtccaggcagatgctcagatgccaaggttcagtttaggttcagtaccaaggaacagaagctgagtgctgaagagggatggtcatggtggactcaggagtcataaaaaatgtgtctgagcctcaaggcaggtgggtttagatcagtggtgaaaaggccttccagacgggagagcacagtttgggcaggagtcaaagttcataaagtcattttctaaaaggtcactccgcttgcctgaaaggtactctcccggccaaatatcccaagagcccttctgcatgaccacaggggacaggtgggaaagcatggctggctccccaccatgcaccattgaaatcttgagttctggtcccagccctgctgctacgtagctgtgtgatctggggcaagtcataccctatacccagcccacacaatggccctcagtttccttcaaaatgaaggtttagacaggacacagtggctcacatctgtaatcctagaattttgggaggccaaggcagaaggatcactaggggccatgagtttgagaccagcctgggcaacataataagatccccatctcttcaaaaaacttaaaaattagccagagtggtggcacacacctgtagtcccagctacccaggaagctgaggcaggaagctctcttgagcccaggtgttccagactgcggtgagccatgattgcaccactgcactccagcctgggtgacagagtgagaccctgtctcaaaaaaaaaatgaagtccgtaggagagcttgtgggcagctgaccccagcccccatcacaagcagcctgggagagatgctgacaccacagtgagcccaagggaaaggctatactggagtttgtcccttccctctcccggttcctctgcccccatcagctgggtgctggatcgagtcaagctatcctcagctcaaagcagaggggaataagattggctggaggaaagttaagtatttcagatttgctcagaatttgaaaggctttttttttttttttttttttttttttttgagacggcgtctctctcactcactctgtcacccagttggagtgcagtggcacaatcttggctcactgcaacttccacctcctgggttcaagcgattctcccacctcagcctcctgagtagctggaactagaggtgtgcgccaacatgcccagctagagacgaggtttcaccatgttggccaggctggtctcagattcctgagctcaagcgttgtgcccaccttggcctcccatagtgttgggattacaggtgtgagccactgtgcttggcctgaaaggcattttgtagactagtgatgaagagataagcaattagcagaagatctgtgtcctctgtggaagtggtgggtgggtttaactgggatggaaaacatcgcaagtttgcaagaatctcacacaatgtcacttgaggactcggggggggtgcgcagcagtgtgtacaagattcacctggatagcctgtaaaatgcagatttccaggccctgctcccagagtgtactcaatgcatgaaagatagggaccagagtctgtgttcttaagtaagtttctcagatgagtctggctcaaggggtctgtgagccacactttgacagatactgacctggtgcatattacatctatctatatctgtttgtctgtctataggttcccatatatcttcatctctttctctctctcactctgccccccaacacacatatgcactctttcattctccaactattgaaccagaacattgaatggcaggaaagtgaaatactaatccttcttcttctttctttctttttctttagagattgggtcttgctctaggatgcagtgcagtggcacgatctcagatcactgcagcctcggcctcctggggtccagcaatcctcccacctcagcctcctgagtagctgagactacaggtatgccaccatgcctgggtaatttttttttttttttttgagacagagtcttgctctgtcgcccacgctggagtacagtggcgcgatctctgctcactgcaagctccgcctcccaggttcacgccattctcctgcctcagcctcccgattagctgggactacaggcgcctgccagcacgcccggctaattttttgtatcattagtagagacagggtttcatcgtgttagccaggatggtctcgatctcctgatcttgtgatctgcctgcctcggcctcccaaagtgctgagattacaggcatgagccaccgcgcccggccaatttttttttaagtgttgtagaaacagggcctcactctgttgcccaggctgctctcgaactcctgggctcaagggatcctcctgcctaggccccccaaagtgctggaattccaggcataagccaccacacttggcctcctgcaggctctttagcaaagtcccagggtaaatggcagatgaaggccaagaccgagttagggaatagtagggaacggtccactgccacctgattaacaaagctctttataaggaagaaggtagtgtcgtaactgaaaaccttgtcttgctccctatagggacgtcttctctctaagacttagctaggcagggtatcagccatgctctgctgacgtccttctgtctagtcagaggggaaggactgggttgttgatgacctgaccctggtctggctggcaccagggagctggggatggggcctctctctaggctaaaagggtcagtttcttccgggatgtctcaggacattcatttgcagactggccaatgaccaaggtttaaatataccagtttccagatataaaggagtcagggcttcattttctagtgaggaagctttgtttttttttttttttttttgagacggagtctcgcactgttgcccaggctggagtgcagtggcgcgatctcagctcactgcaagctccccctcccgggttcatgccattctcctgcctcagcctcccgagtagctaggactataggtgcccgccaccatgcccggctaattttttgtatttttagtagagacggggtttcatcgtgttagccaggacagtctcgatctcctgacctcgtgatctgcccgcctcggcctcccaaagtgctgggattacaggcgtgagccactgcacccagccctagtgaggaagcttttacagacttcctggggtttttgagtggggagaaggaggtggaacccaggcactgctgcagaagacagctgtagaagcccttacctggcagtgtttaccccagggaagggtgaggaaagggggacacaccagtcttggtctttgcagaccaagacagagggatggcaacggcaggtccagtctgtgggtcacatacactcccccaaggtcgaacctgtgaggtaacatgcagtgaagcctatttggatcaaaacaaacaacacttttgccctactttctttttcttttccttttttcttttttttgagacagagtcttgaactgttgcccaggctggagtgcagtggcgcgatctccgctcactgcaagctccgcctccggggttcacgccattctcctgtctcagcctcccgagtagctgggactacaggtgcctgccaccacgcccgggtaattttttgtatttttagtagagacggggttttgccatgttgggcaggctagtctagaactccacacctcaggcgatccacccatctcggactcccaaagtgctggaattacaggcacgagccaccacgcccggcctgccctactttcaaaatataaactcaggccaggctcggtggctcacacctgtagtcctggcactttgggaggctgaggtgggatcacttgaggtcaggagttcgagaccagcctggccaacatggcgaaaccccatctctggtaaaaataaaaaaattatccaggcgcctgtaattccagctacttgggagactgaggcagcagaatcgctcaagggaggtggaggttgtagtgagctgagattgtgccattgcagtccagcctgtgtgaaagagcaagagtctgtctcaaaacacacacacacacacacacacacacacacacacacacacacacaaacaaacagaaaacaaaagataaactcaatcctaccacttctcactgtttccactgctgtggccgtggtttaactcatcaacatctggctttcctggaccagcacaacagcctccttcctaactgttctcctgctcccactcccatcccttagcagaacattctccacacagcaactacggcgatctttcagaaatacaaaccagctgggcacagcggctcatgcctataatccaaacactttgggaggctgaggtgggagaagcgcttgagcttaggagtttgagaccagcctagaaaacacagcaaaaccccatctctacaaaaagtaaaacattagtcaggcctggtgatgtgtgcctgtagtcctagttacttgggatgctgaggtgggaggatcacttgagcctgggaggttgaggctgcagtgagccatgattgtgccactgcaatcagcctggcaacagagtgagaccatgtcactcaaaaaacagaacaaaaaacaacaacaaaaaaacccaaacaaaacaaaacaaaaaacaggctaggcgctgtggctcatgtctataatcccagcactttgggaggccgagatgggtggatcacctgaggtcaggagttcgagaccagcctgaccaacatggcaaaacctcatctctactaaaaatacaaaattagctgggcatggtggcacacgcctgcaatcccagctattttggaggctgaggcaggagaatcacttgaactcaggaggcaggggttgcagtgagccaagatcatgccattgcactccagccagggcaacaagagcgaaactccttctcaaacaaaaacaaaaacaaaaaaacagattgttccacttacatacttaaaatcctccagtgacttcctgtcataattagaataaaacccaacctccctcctggcctcctgtaatcccagctacagtgggaacggaccactatgtccactctgacctcatcagggcccactctccccttcactggccatgctgacctctcccacctggaggcctttttacctgcttctcagcatgcaacacttttcctgaccccttgttcaaagcagccacccactgcctctgccattttctcatcacatcacacaaattgtgattgacttcaaagcacttacgagtctctgaacttattcacttgttagccctcactagaatgtaagcttcagagaccacggagctcgagtgtcctgagaaagtgaatggcacatagtaggtgctcaataaaatcggtgttgaaagaatgagtgagcaaatgaatacataaatgaactactcagggaccttatggaaaaaaaaaaactgtttatgcacatcactggcattgccacaagctgaaaaagaaggcagagtgggttgggagtagggaagaatggcggagaagggtggggggttgtatctctaaatctgtgttgtggggccacatagggtggacaggggctgtgagttacagcctttaggtgctaccctcagcctgggcttccctccaggcctggcgcaccttgatcttcactttgaaagagtcgatcagaaagaccaccttggggatgccttccagggagggcagctgcccatcatctggcacctccaggtcgaacctctgcagcagccaggccatgatgaggaagagctcctggcgggccaggatctcacctatacaggagcgaggtcctgctccgaagggcaaatagcttactgacggtgagatgagctgggtccccgctggattcaagaaacgctctgcaggcaaggagtggcatcagccaggggttagggcaggagggaggagaggcatggttctgccctggttgagggggagacatggccctgcccagggaaccctgatctgaggatgtagccttattatgggggaacccccgcctggggagagatacagccctgctttcaggtagcccttaacgacacagaggaaatgaaatattcaggaaggatggaaaagagatggaattaacctatgaaaatagcaccatccgaggggagaagggacagacttaatggcagacagaggcgtagagggcttcttggagggtgaatttgcagttggttggaagaagagcgtgggaaacccagctgtgaagagtttgggtaagtctatggcaggatgagggtgtcaacaggtccgtatagttggagccaagagttttctagcagcaagcttggcagaggtgaaggggtactggggtggtggagcagagtccaggctcgctgtgtggcccagggcgcaggacaggacagactcaccaggcatgaactgatccggctggtgccactccttctcattgtgatgcagcgcccacagattgatgataacttctgtgcccttgtccacagcaaactcaccgatgctgctccagagtggaagaggaaaagtgggtctgggacttcgtactcccttccttgctcagcctcatgccccctcattcttccgccgtgaggaaaatgccctttactccctcattcccactcactcatgttttcctcagcttctgccagatcaaacctaaatccagcccttctccatcccttccctcctaacaggcgcttctgtctgaacacctgtgtctgtggactttggtgtctggcagtgtatgtgggtgtgcgtttggagctgcagcgcatgttatgtgcgtgctgcagctggttggaacatggagctcccagcctttcatcccagaccacatgtctctgagggcagcaggaagctcctctgggaagtcaggcagatctgtggatgagtcaatgcgtgtctgtaggtggtagagacatggagccacggggctgggggcaggatgatttttatatttaattaattaattatttattttgagacagagtcccgctctgtcacccaggctggagtgcagtggtgcaatcttggctcactgcaacctccgccgccttggttcaagtgattctcctgcctcagcctcctgagtagctgggactacaggcacgcgccacgatgcatggctaatttttgtatttttagtagagacggggtttcaccatattggtcaggctggtcttgaacccctgacctcatgatccacccgcctcgacctcccaaagtgttgggatgacaggtgtgagccaccgtgcccggccggcaggatgatttttagtagttgatggttgactgactttaggttggccagcaggggccgggggtagggggagccaggtgggctggcaagcagtgttgaatgcatcatggggctagatgtcactgggagggcaggcacacctggagtcaacgttggccttgtgggggatgagcataggggccacgggcctgaggcgaagcacctctcggatggtggcctccagcaggaggagacggttacggtcactgatagttggtgtgcggctgaaacccacattctggtcaatctcctcgtagagcttcttcttcacctgaagaccagagtaggttggaggtgactagtgtgtgtaagcccaggagaagcaagggcttagagaagaatccaactgtgacatcgagaagagcctgtccagtcccttcccagtagtggctctggggcccaggcccggcttccagaagatggggcagctctactctggggtcaaagccaactactgcttgggtaaggagcagggcaggcctagtcttcctgcacagaaagcctgagagaattggctctccctttctctggagcccagagattgggctggctggggtctaggatcaatgagggggaagcacacctgaggattgtgcagcaggaaggccagggtccatttaaccacagaggtggtggtctccacgccagccccaaagatgtcccctatggtggtgagaatgtggttatctgaaagcagctctgagtcttgatctgggccagcattgccattatctgagttcatcttggcttgcatcagtgtgtccagcatgttggtgatagagtcactccggaatttctcctgggttgggtgaggttgggagacattaataaggaaggagccccatctgtgacactcctgccatacttctgtccctgactagagataacaaggctccttccacttggaagtagagcaagtctgggcaggacctacgaacttgtggaggtaggaggcagccccgggccctctttaaatttggtggagaggttaggtctcttctaggatcctcttcagttcctcacttttcgatcccaactccttgagtcagttttttttttttttttgagacagaatcttggtgcaatgcccaggctggagtgcaatggcatgatctcagctcactgcaacctctgcttctcgggttcaagtgagtctcctgcctcagcctcccaaatagctgggattataggcatgcgccaccgtgcccggctaattttgtatttttagtagagacagagtttctccatgttggtcaggctggtctcgaactcccaacctcaggtgatctgcccaccttggcctcccaaaatgttgggattacaggtgtgagccatcttgcctggcctagtttttgtatttttagtacagacggggtttcaccatattggccaggctcatctcgaactcctgacctcaattgatctgcccacctcggcctcccaaagtgttgggattacaggcgtgagccaccgcgcccagcccttaagtcagtttttattgtacacctactatgtgccaggttctctgcttggttttgaagcttctacagtgtgtagaatggactccaccctgctcttgtgattacttttagcctaactcatattctcttctgctctatcacctaccttgtaattttcaagtattttattcagcagatcatttcgtattttaacatggctctttaatttttccagggttttgttggggaaaatctgggaaataaaaagaaatgttaaatccacccttcttccattttgcttctccagctgccagagtctctcctggaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaattcagcgatgaatgcgtatagaatgcttagtactggcacatggtaattggaaaagaaatgaaggtcattatctggagtactaaggtgcataattaaaaggctaaatctatctctgcagagaaatggcaaaggttttaagtggcagaggaggtagaggtggcggaggtaatcaggaaaaagatgggtcattgcggctggagcagggaagtaaaaaggaaggaagattggggacaatgtcagggtctactagaacctgaaggcagggctggcagcatctcaccttcaaccaggggactaggtccaccaggctgtctttgctcaggttgtctatgatgccttcattgtaattctgtatgacattcaactcagggtccccattcttgtaggaggtattgaagcagatcaaggagatgacattggttaccgccacgaagacaggaaaggagatgtctatggactgtccgttgtgggtggccagcatatcacacaatgtactgatttcctgacaaactgaagggagagggggcatgagggtgggaaatgaatcagcacccttaccccctctctgtaccagttgcctcttaacaggagcgggggacagatagcagatggccactagatggcagcagtagccaagaaaaggctgcattgcgctctagtcctaacccttacccctgcccaaccctcctctccctccagcagctcctgtgggatccagccccagccccaggggccagcctggcactcactgatcttctccagcttctgatcgccatccttgaacagggcaaaggtggccatcgccagccttcgatgcagctgccagtgtgcgccagagtcagcgaaggcgatacccttacggttgttggacgcgatgtctagagttgcctttagagagcaggcaaggctgtaggaatctcacaccatccaccccactcttgcccttacacctctggtccctgctttccttcctggaggagaaggcaggtacctggcatgctgactcccatgtgggcacagccccactgcactccaccatgactgcaaggacttggtaggacagaccctaaggcctcctactcccaattccttcagaaatacagtagatcaaggagaaagaaagaacccttaattagaatgcagcagcattggggttcttttcgctgacagggtgccctctgggcttctttttgctcatcagtttctgaccacaggaaggcaactctggatgggataaactctctaaactatgcctgtccagagggtagggagcaggtgagcttgtagaggctgaggactgcacagatctctgcttttccctgagcccttagctgagctaaaggcacagctcacctcactcaggtttacccttccattgcaagcctgcatacccagccacaagcccacatttggagagtgcagatgttttgtctacccagtctggacttgggccgagccgcctcctcctagaggtgccccccaaagcaaaagggtccaaagcctcccttttccatttcctgaccctgaagatccacatgactagccttctccatcttctctgcccccgggaggaagccagcagaggtgggagctaggtagttggtcagcagacctggctgattggtccaagaaaaaataaaccaacccttggcttgatcaaagctgagaggctggcagggcacagtggcttacgcctataatcctagcactttgggaggctaaggtgggaggatcacgaggtcaggagatcgagaccatcctggctaacatggtgaaacaccatctctactaaaaatacaaaaaattagcgggcatggtggcatgctcctgtagtcccaggtactcaggaggctgaggcaggagaatcacttgaacccgggaggcagaggttgcagtgagctgagattggccactgcactccaggctgggcgacagagagagactctgtctcaaaaaaaaaaaaaaaaaaaaaaaatgctgagaggctgggggccctgctgagtgggaggctcatcagcaaccctgaaatgtcattgtagaaaactgcccctgtgagcctgagtagctggaaatagcaccaggaaagcagcaatcccagcctgcaatagctaggctaattctccccagcagctttcatggaggacagtagtcactgcccccattttccatgaaaagtaacatgaatcctggctgtataaggggcacttactgtgctgggtgctaggctaagtgctgtacatgcaccttctcagtccattagagaagtctaggctcagagagaggagtggagtgaggattccttgacccctcagaccactgtggtcctcccatcccacctcctgggcagcctggtagaggagacattcctttaattcttcctgcctaatttagaggctgggtgggggtctgaaggttcactcccttcacatcatcccactagtctactttgggaagaattacaggttgttggagctggaagccccattctaggcatggtctgaagacctgaacaatcccagggggtggtgaagggggcagggaggagatgggcaccacttaccatttgaggccgcccagagaagtccttgcccttcttaataagcacctccttggccagctggtggtggccgacaatcactgtagtcttggtgcccatacgaaccgaatagatggggccatattttttctgcagcttgaagaagttgttatgcatatggccgtgtctggggaggaatggcaggctgcccaccaggggcagggacaggaggctcttggggtacttggcaccagggcaccttctcttgggccaaaacaaataagctagggtaagcagcaagagagccacgagctcccacatggtggctgggtgccggcaggcaagatagacagcagtggagtagaagagctgtggcaactctagggcacaaggaggccttttaaagggctaccctgatcttcaccttgactttgtgttatctcttgccttgtggaaagattctcctggagcccagccaggcctgagctcatatccagaagggagagaggcggtgggagtgaaggcctcctcaagggctggctcaactccagggcaaacctccggaggaggagctaggtaagggaggtcagttgatcaccctctgaggagctccccatgcttgaatgactccagagtgcgaatggtatctgggctcaggagtcaaggcttggaactttccatgttgcaaaatcaaaatcactggacagatgacagattcaggagggtcacaagtagcagggactgttaaaggtcttttatgcttctttttttttttttcagagtcttgctccatcaccaggctggtgtgcagtggtgtgactgtccatgcagccctggccctccagcccatgtggttttggcagcgataagggctgtgggttaatggtccccaaaataaaaatgtacatgtgtatgggaacgaaaggggtgctaagctgtggggagcggtggaagggaagggagagataggtcagtactaggaatgccagaggtgggaggccgtttcataacatttcttgttgatcaaaatgccatcaacaccttctttgctcatcagcaggactagcgtactgggggaacccacccccaatatttcaacgtaggttctttctataagtgtcagccggctgagaaataaagagagacagtataaagagaggaattttacagctgggccgccgggggtggcatcacatatcggtaggactgtgatacccacctgagcctcaaaccagcaagtttttattaagggtttcaaaaaggggagggggtgtaagaacagggagtaggtacaaagatcacatgcttcaaagggcgaaaagcagaactactaataagtgtctaacaaagatcacatgcttctgagggaaaggacaaagggcaaaagcagaactaccgataagggtccaacaaagatcacaaggcaaagggcaaaagcagaaccactgataagggtccaacaaagatcacaaggcaaagggcaaaagcagaactacagatgagggtctatgttcagcggtgcacatactgtcttgataaacaccttaaacaacagcaaacagggttcgacagcagagaaccggtctgaccacaaatttaccagggcggagtttttccccaccctagtaagcctgagggtactgcaggagaccagggcgtatctcagtccttatctcaactgcacaagatagacattcccagagcggctgtttatagacctccccccaggaatgcattcctttcccagggtattaataataatactccttgctaggaaaagaatttagtgatatcttccctacttgcatgtccatttatagcctctctcaagaaggaaaatatggctctttctgcccgaccctgcaggcagtcagaccttatggttgttttcccttgttccctaaaaattgctcttattctgttctttttcaaggtgcactaatttcatattgttcaaacacatgtcttacaatcaatttgtacagttaacacaattatcacagtggtcctgaagtgacaaacatcctcagcttacaaagataacaggattaagagattaaagtaaagacaggcataagaaattataaaagtattatttgggaactgataaatgtccatattaaaatgaaatcttcacaatttatgttcctctgccatggctccagccagtccctccattcagggtccctgacttcccgcaacatctctccctttctttttatataaatgtgccgtggcgatgaaggcttgctcgttctctcggttttgatgcaggattctttgactggtctggcacactaaaaacaagccgattaaacagagaaacatgattccaaaatttcctacagtggagcccccagtagacttaatccaagttgtggagtttagtccagaaagactttctgccacctgatctaacgcctcagctccaggcacaatggataaatgagcttgagaggcttcaaaaatttgtttctttaatttagttatgtccaaggataaattatcttccctacccagaaggtgtcctttgaccatttcccatgatcagtctcgttgtaggaatatggtgtgctatagaaatcagaagtgttgcaatcgaactgcatttgcatgtgatgttcgagactcattagctggtccccaagccaaataacagactgtcttaaatcattagctaatttttgatcaatgccttgttgaggattccacatttgggtggaattgccttaccaatcattaacaaaattagccatttgaatagattggtgtaatgccactccggcagtggtggccagtgcagtgactgtaattaggcccatgatcacagtgattaaagtgaaaacaaatctcttgatcttttgagaattcgttgtaacacttcattaattaaatgtactgagggggaagattcccaagttctgggtaaagttactggtatccagattccttctcaagctcgaaccaacattacacttttcctgagtcaaaacgggagttaacacaagtggataaatgacaattaatgcattggacggtttgattgttcatccaaattttgatatttcccactaacagcatgtaaggaggcttaacacaactctgtataatagtcaggctggaggtaaacaaagcagaatgtttgaatctacgttgataccgagggggaggagtggcggtggcaacgcccaatgtttgatgccgtaaagaagcaatccgaggtgcccggggattctgaagaggtagggggacatacctgggtccagaagaattatcataatgccaatcagagtcccataaaggaggactggcatcaaaaagaggaaaatggtccaaaggggatttatcatgggtttcagaatcacggatgtgaggggtggtagtggggacaacagaaagaaaagtttccccttcccatactcgcagtctggacatggcaatagccaatttccaaagttctgggtgttctgggctcagaatgggggatatcataagaggcctcgggtggcagggggtaatgctcttatcttcccattttaagggacagaatgagctgaacctcctatgcaaagtaggatgatgatcctcgtcctcccaataagaaataaaacaagtagcctccaggcattcccttccagcagaagagcaactgcttttcaaatagccctttggtgcccagtctcttactaaaccatatgagtcattttttaatagtactgcatgtgaattaacacaatcttcccaaattaaagatttagatgggccctcaaaaattttaggacatggttttcctacaggtttatattgaaagtagggggtatctcctattactccccctttcatttgtcttaaaggagaaagggagaggctggagaccaaatgtccccgttcccctgtggctgatctctccagaaggtacgcagcccagacttgagtttctagatggatacaacaaggtgcatgtccgaggcacagaggagggtatttataaccgtaggaacattaaatgcagtgccttcttttcctggttgagtggggcaacggtcatctgtagctccaggcatccacacactatcattagtatagatttccgcaggagcatccatccaggtgagaggttgaataagtggaggaaaaggcacataagcccagcaagaataattttgtgtagcaggtaaatcaatgtgaggggaaactggtgagacagaaagtataaggaagagaattattaaataaaacctattgtaagcaagatccagtgctgaaggaggaatagaagaataaggggatgttattttcaggctaatagaaatggtgagatttttaggttcgtaaggagaaaaagaaagggaattaggagaagtgggattagttagaggggtttctgttgccattagggaggattgaaccagacccattttgatttggcgtgccagtttctgaggagttggcacagatctcaccaggtatgagggtggtctctgacgtggacgtctcttccctgtggtttttattgtcagtattcacatgaagtttaagtcttctagtgggcacccagacaggggattgatgatctcctggtgaaacacaagcataccctcttccccatgttataatcgttccaggtttccaggtattggtctgggaattaaaggcaaagaattaggtagtaaatttagaggaatggtactacagagattgaccgcccctccccttactctggagcatagataagcgttgtactgagacagaagaagaggctgggacacatctgggttggctgtaggtaaatttgtttgtgctgggggctgcgttgggaccgattgaagcagaaaggcaacattcgtctgagtctgaggtgtcccatttgaaattggggcctaggactggccccatttcccatttccctggttctgtggcaagggatttccatctatatcagacttagagtggcaagtacttgcccaatgtttacctttacaacaacaagggcaaacagtagcaggagcatttggctgtgttttttgagccggcttggctgcctttaagtttttaactgtgcaattttttcgagtatgaccaagttgaccacaattatagcaggctccaagaaaagaatcagtcgagccagtttgattgccgtccttcatggcccgtgcccacagaatagctttgtgggcacagaatagctttgtgtctgatccaatgccttcatatttaatatactcaggcaacacctcacgatcaggtaaattttgttgttggacggaatgcatggccattttacactcatggttcgcattctcaaaagctaacattcgaagaagaataccttgagcgtgctcatcagagacagatttttcaacagcatcttgtaatttagctaaaaaatcaggatataattcattgtgaccctgtttaacagtagtaaaagaaacaggagcttggcctggggcgcgtaatttatcccaagctctcatacacacctttgttacttgttccacggtgagagcatcaaagcctaattgggcagtagtgtcagagtaattattggagcctgtgagctgagcctgagtaattagaatgccatcagcccgatttagctgagcctgcagatgggcctcccgtgaccaccaggtacagaattgtaaatgttgagatggagttagaacagcttttgccaaaagtcccagtctaaaggaagcaaaatgacctcagtacaaagagtctgtaataccattttaacatatggagaagtaggaccatactgagtacaagcatccttgaattcttttaaaaaggtaagattgagcagcgcctatcgatgcacttgtaccccttgagcattgcaaggttccagcatgaacggataagcccacgcctctaatccacttgtttgttttggcgtaataagcattgcatggaaatttcaacaacaggcacatgagacagagttggcacagaagtgacaggaaaattatgtgtagataagggaaactgaggctgaggaggttggaccagtatgagagcgtgagaaaggggcaccagaggagcagaagaggcagaagcatactggtgattattgcccaatcctgtgcaaccagagtggcaggggtgtccacatgtgaagaagggtacagagaagcaggttgagtggatggcaaagtgaccagttgaggaaccgaaatgacaggagggtgaggggctgtggtggatgggggagggcctgcagaattacaggtaaattgtagtttagttccggagccattagatggctccggaggcaaaggctgcaaaggtttgaagagggaagagttagcatagatacagtcctgggctgtccaagtcggggccgtgggagctacaagtactggctgttcgtgaaaagaaataagatcatcagggggtgacgttaagccaaagtcactggagttagatattgaatcttcaatatcctcaggtggggaaggagtaggcgaagggagaggctgatcaggtaacgaaggccgtgcgggagaggaaggttgaggaagaggtggagggtttccagattcagaaaactgtggtaactgcagggggtgatgggattggtatgtcattaggacggcacataccaaggcccagtcaccccaaacagtgacgggaacataatttcctgttgggaccagttcccggaattttgcaccaacacgatcccatagttccacgtctaatgttcccttttcaggaaacaaaggacaatgttcttccactgccctgaatagggtgaccatattttccatgggtacccaaactcccccctgttttaacaggagtttaatatggcagagataagcataatgtttagactctgagtgacccaaagttagcctggacaatacacagacaacttaccaatcatcagagagctgaacaagcatttctgtggaccagaccaatgaacgtttctccgcacctaccaaagggaatcaggttcccacatgcaattaggagaaagaaaaccacattggtgtgccagatattgggggaaccagcccccaatatttcaacataggttctttctattttccataagtgtcggctggctgagaaataaagagagacagtataaagagaggaattttacagctaggccaccgggggtggcatcacatatcagtaggactgtgatgcccgcctgagcctcaaaccagcaagtttttattaagggtttcaaaaaggggagggggtgtaagaacagggagtaggtacaaagatcacatgcttcaaagggcaaaaagcagaactactaatatgggtctaacaaagatcacatgcttctcagggaacaggacaaagggcaaaagcagaaccactgataagggtccaacaaagatcacaaggcaaagggcaaaagcagaactacagatgagggtctatgttcagcggtgcacatattgtcttgagaaacatcttaaacaacagaaaacagggttcgagagcagagaaccagtctgaccacaaatttaccagggcagagtttttccccaccctagtaagcctgagggtactgcaggagaccagggcatatctcagtccttatctcaactgtacaagacagacattcccagagtggccgtttatagacctccccggaggaatgcattcctttcacagggtattaatattaatattccttgctaggaaaagaatttagcaatatctttcctacttgcacgtccatttatatcctctctgcaagaaagaaaatatggctctttttgcccgaccccacaggcagtcagaccttatggttgtcttcccttgttccctaaaaatcgctattattctgttctttttcaaggtgcactgatttcatattgttcaaacacacatgttttacaatcaatttgtacagttaacacaattatcacagtggtcctgaggtgacatacaccctcagcttatgaagataacaggattaagagattaaagacaggcataagaaattataaaagtattatttgggaactgataaatgtccatattaaaatgaaatcttcacaatttctgttcctctgccatgcctccagcccatccctccatttgggtccctgacttcctacaacactagcatcctagcagtcatggtgacagtgacattgaaggtgggggctccatcggtgctcttggtataaagataggtcagttccccatcctgcagcagtaggtcccagatcacagaacatttctggcccccaagtgtcacctcattcacaaaaaaacttgaccagtctttgccaaccaggacatcaacctcagctggcttgacgttgatgaaggttttcccagggatggtggcctggatggaaggcaagtccttgtagcccacgatggctgcatcctacaggtcccttccaccacgaggttgtcgatgtgggtgttccaccctgccgtgggctgcttgtggcactgctgccacctcgcagacaggcaggggaggcggagagctcagggcatgcactgtggtcgggaccactgctctgctatccgtgcagaagcccttgtactgccacttcctggaagtgatcattttaagcatttatatggcatcaatctttttcactgtattgatccaaatgatttcaagcataagagaatggacagatcggttttgtttgtttacaaaaaggaaaatggggccagtcatggccaaggttaacaaaacaaagggcaaagcttaactggcttagtgtggactccaatcattggaaagactgggaagatggttcagatgaagccatgtctgattttgattatttctctgagatgatgaaccacatgggtggtgaagaggatgtagatttagcagatggagcagatgatcattcacaagacagtgatgatgaaaaaatgccagatctggagtaaggaatattgtcatcatctggattttgagaaagaaaaataacttctctgcaagatttcataattgagagaattcctggccgggcatggtggctcacgcctgtaatcccagcactttgggaggctgacgccagcagatcacaaggtcaggagatcgagaccatcctggctaacacggtgaaactccgtctctactaaaagtacaaaaaattagccgggcgtggtggcgggcacctgtagtcccagctactccggagactgaggcaggagaatggtgtgaacctgggaggcagagcttgtagtgagccgagattgcaccactgcactccagcctgggtgacagagcaagactccatctcaaaaaaaaaaaaaaaaaaaaaaaaattgagagaattcctgagttgatagctctaaagacagatgctgtatttgcctactttaatctatttttcaacctgtttgttttttaaaaggcctcactaagggttgatatgtaccactgtatggggcaattttcagtcagctaaggcaataaccttatgcctgaacatttcccagacttccatgaagctgttgaagtcctaggcaattgatgcagcagttgtgataaatacaaacatctcacctaagtctccttttcttcataacatacatactgacatgatagaaagctctcagcttagggaaagagaactaaattttagattataggacatggattcaaaagtgactggaacaaattggctgacaccttactggtaacctgttattcctcttgtgttattcttcaggattgttccactaaagcttatttcaaaaaatttacctctcgggctgggcgcagtggcccacgcctataatcccagcactttgggaggccaatgcaggtggatcacatgaggccaggagttcaagaccagcctgactgacacgccaaaaccccatctctactaaaaatacacaaattagctggtcatggtggcgtgcatctgcaatcccagctacttgggaggctgaggcaggagaatcgcttgaacccgggaggtacaggttgcagtgagctgagatcatgccactgcactccagcctggatgacagagtgagactctcaaaaaaaaaattttttttatattaccagatgaaatcacagccccaaggtagcagacattcttggtgtcaatcattatagaagagatgggccaaacaggagttgttagttgaggctcacagaggtgggagatggcatctgatggcatctgtcccactctctgggagtggtctgtctgcaagtttagtaaggatggagtgaaggctgctggaattaggcaggaaggcagcaggtagggggcctcatgatgaagaagagctggccaggcctcataagccagactgcctggttgcccattactcagaattttcaaatgttgttcagatttttaaggccatttgcagccagaggtatgggctgggatgaaacctatgagaaaccttcatgcaagaaaggggatttgaggtaggccttgaaggagagctaggactgatgcaggacagacagacaggcaaacctctaaactggggcttagccc

SEQ ID NO: 423 - DNA, 30216 bp, Homo sapiens
gaatttaacatatttgtcaaataataggctgaccagccatggagagaagctcctattatagtcacaacctattcaaaaatattaatgtgggtggggtgcagtgtctcatgcctgtaatcctagcactttgggaggcagaggtgggtggatcacttgaggccaggagttcaagaccagcctggccaacatggcgaaaccccatctctactaaaaatacaaaaattagccgagtgtggtggcacatgcctgtaatcccagctacttgggaggctgaggcaggagaatcacttgaaccagggaggcagaggttgcagtgagccaagatcacgctactgcactccagcctggacgtagagtgagattccgtctcaaaaaaaagaaaaaaattatagtgcatttgaagtgcattcaaaaactatgagaacacgattttagctgtgagcttgtaaaaacaaaaacaaacaaaacttatgagaacacttgtacctccctagcctgaggggcatgatgtatagcctctttcaggactgttggtacatgtccctttgaatattcactgtggagaatcttttttagcaagcgtagctaaattgtatctgctcctctaaacatttgccagaagaagaaatagtttattttcaggttcaggctctacacattctctttcttttcttttcttttttttttttgacagagtctcactccttcacccaggctggagtacagtagcgtgatctcggctcaccgcaacctctgtctcctgggtccaagcaatcctccggcctcagcctcccaagtagctgggattacaggagcctgccaccatgaccaactaatttttgtattttttagtagagacgaagtttcaccatgttggccaggctggtcttgaacacctgacctcaggtgatccacctgtctccgcctcccaaagtgctgggattacaggtgtgagccaccgcaccgggccctcttctcccaccctttccctttctttctttctttttttttttttttttttctttgacagagtctcactctgtcgcccaggctggagtgcagaggcatgagcttggctcactgcaacctccacatcctgggttcaagagattcttgtgcctcagcctcccaagtagctgggattacagatgcgtgccaccacacccgactaattttttgtatttttagtagagatggggtttagccatgttggccaggctggttttgaacccctgccctcaagtgatcagctcacgttggcctcccaaagtgtcaggattacaggcatgagccaccacacctggcttctacacattttatgagcaataaataatgttgataatctctcagttttcttctttcttcctgtctctccctccccagtggtcctgcagcagttctaatcccattcccatcaccagttgatcagagacctagtatttttaggaaagtagcagcctttatttattttttatatttatatttatatttttacttatttatttatttatttttgagacagagtttcactcttgttgcccaggctacagtgcaatggcacaatcttggctcactgcaacctccgcctcctgcgttcaagtgattctcccgcctcagcctccagagcagctgggattacaggcatgtgctaccatgcccggctaattttgtatttttagtagatctggggtttctccatgttggtcatttttagtaaatctggggtttctccatgttggtcagtttccatgtggagagagaattttgccatgttgcccaggctgggcttgaactcctgggctcaagtgatctgtctgcctcagccttccaaagtgctgggactacaggtgggagccaccatgtccagcctgcatactttttatgttatcagaaatgctatctttctctttggttacatttctttttttttttttttcgtaaatcaaagtactattttattaaatgagttattttacacaatatgaacatcaatataattacaattgtaaaaaatttttttataacaaggatggactgattttcatatttccaaatcagagtcaactgtacatttacacagaattgtctttgcatgaagcccaaaagggaacagcataaaaaatgagtgtttctgtagcccctttatttttgctgatcaacagtttgttagaaaagcagctgcaggtatgttacctaaggtctgagacagtagaagagtcaaaggtgtcgtgaattcacctgtaaacaaccttatgcctgaacatcagctaattctggaggaagtgaagtcttaggatgcttgctctcaaagtgctgcttgaaggtcttagggtctggcattcgtgtcctacagacagtgcaggtatatattaaggcagctttggcagcagccttttggtcatgtccttgtttcttcttttgtccagcttgctttttggcattattctgctgagactgaattttctgctgtccacgagccatatccgggccaggagaatcttgcgtcggagagacagtgcagcgcgagagggccgggagaggacgccggagggaaaggaagggggagcgcgcccagcatcgcttgggcctcctccacccgctcaggaggggaaacaggagagccgggagcacaacagcctcgcgcgcccgccgccgcctcagccttaggggaggccactacgcctctggttacatttcttgatcatggtatctccccagctaggtaagtatctctttgattacatttcttttttttctttttttgagatggagtctcactcttgctgctcaggctgcagtgcaatggcgctttctcagcgcactgcaacctttgcctcccgagttcaagcgattctcctgcctcagcctcccaagtagctgggattacaggcacccgacactacacccagctaattttttgtaaagccaccatgccccccgattacatttctttctcttttgagacggagtcttgctctgtcgcccgggctggagtgcagtggtgtgatctgggctcactgcaagttccgcttcccgggttcacgccattctcctgcctcagcctccggagtagctgggactacaggcgcccgccaccacgcccagctaattttttgtatttttagtagagacggggtttcaccgtgttagccaggatggtctcaatgtcctgacctcgtgatccacccgcctcagccccccaaagtgctgggattacaggcgtgaaccaccatgcctggcctattacatttcttaactggctgttgctggtgtataaaaatacaaaacattggctgggcacggtggctcatgtctgtattcctagcactttgggaggccaagacaggcagatcacttcaggtcaggagtttaagaccagcctggccaacaggacaaaaccctgtctctactaaaaataccaaaattaggccggttgtggtggctcacacctgtaatcccagcactttgggaggccgaggcaggaggatcacctgaggtcaggagttcgagaccagcccggtcaacatggtgaaaccctgtctctacaacaaacacaaaaattagctgggtgtggtgttaggcgcctgtaatcccagctactcgggaggctgaggcaggagaatcgcttgaacctgggaggcagaagttgcagtgagccaagaatgcaccactgtactccagcctgggcaacaagagtgaaactctgtctcaaaaaaaaaaaaaaaaaaaaaaaagcccaataattagctgggtgtggtggcacatacctgtaggcccagctactcgggaggctgaggtgggagaatcccttgaacctgagagacagaggttgcagtgagctgagattgtgccacagcaccccagcctgggtgatagagtgagactccgtctcaataataaaaataaaaataggggggaggggggagggatagcattaggagatatacctaatgttaaatgacgagttaatgggtgcaggacaccaacatggcacatgtatacatatgtaactaacctgcacgttgtgcacatgtaccctaaaacttaaagtataatttaaaaaaattaaataaaaatatatatacattaaaataaaaaatatttttgtacattaaggttttttgtttatttgtttttaagatggagtctcactctgttgcccaggctggcgtgcattggcataatctttgctcattgcaacctcaacctctcgtgttcaggagattctctgcctcagcctcctgagtagctgggactataggtgctcgccaccatgcctggctaatttttgtatttttagtagggacagggtttcaccatgttggccaagctggtctcgaactcctagcctcaagtgatccgcctgcctcagcctcccaaagtgctgggattataggcatgagccaccgcacccagcccctgctttcaacatgatgtgtatgcaatagattagcactctttaagggaagtgtctaacctgatgggcctgaggacaaacacacagaatcctgtacatcccttcatggacgaggcaatcagctgagagagatcatccctccacaggagtgagacccagaagcccagagaaggctatggactgggagaaacctgcagggtccgagggaagacaggtctggtgtatagatcccgagactggaggtcactgtggtactaaagataacaggagtaaatggcagcacatcatgcccccaaactggccaggactagctacactgagtgaggccagcatggcagaagacaaaacaggcaagggattatttcccctgccacactaagtcagctttagttatgaacaaattcgcgaatttttttttttttttagacggagttttgctcttgttgcccaggctggagtgcaatggtgcaatctcagctcactgcaacctctgcctcccagcttcaagcgattctcctgcctcagcctcccaagtagctgggattacaggcatgtgccaccaagcccagctaattttgtagttttagtagagacggggtttcaccatgttggccaggctggtctcaaactcttgacctcaggtgatccacctgcctcagcctcccaaagtgctgggattacaggcatcagccaccgcatccagccttatgtcatctatttcttgacaccaataacagacaactactctagtcagtaattagttgtcaatatatatttttcttacttaaaatgtattatttaaatataaaattagcacatgtaaatttatagttaaaacattcatgaatttgggccaggcgctgtagctcatgcctgtaatcccagcactttgggaggctgaggcaggtggatcacctgaggtcaggagtttcgagaccagcctgaccaatatggtgaaactaaagtacaaaaattagccaggcgtggtgacatgaatctgtaatcccagctactcgggaggctgaggcaggagaatcaccagaactcaggaggcggagattgcagtgagccaagattgggccattgtactccagcctgggcgacagagcgaaactccatctcaaaaataaaataaaaagaaaagaaaagaaatagataacataaaattcttacgattatttgcttgaagtgaataaagaatgttttctgtattactcttctatgaattacagtagtcaataccattcaatctcaactgttatcactattgaaatggcctcaaaaataaactgccctttcaaaaatcaagcagatggaaaaggaaaaatccatattgatttcaaaagtacagctgccctcatctgaaaactacttcatcttaaatttcctaatatgatcatggctggctgcgattcaccacagcttccaacagccgactggagagcgtttttccagaataactagtatgtttgcttcaagacaaattatttgacaaggttaaggaaaagatgtgaaagctagataatccattaagaatctttttttaaaacttcaaggcattttatttatacttcttttttttttttttgagacagtctcgctctgtcgcccaggctagtgtgcagtggtgcaatctcagctcactgcaacctccgcctcccgggttcaagctgttttctgcctcagcttcccaagtagctgggattacaagcacccaccgccatgcccagctaatttttgtatttttagtagagacggggtttcaccatcttggccaggctggtcgtgaactcctgaccttgtgatccacccacctcggcctcccaaagtgctggaattacaggcgtgagccaccatgcctggctatacttcttagcttacttttttattacgcgtatatattaagaacttttaaaagtccaaattaaagaagcatgcctagacatcattaaaatagctatcaatgcccatgacaatcctgtagctcaaatagtttactttagaatgtcaaaattgattttgtaatagtcaggacaggataaacagtcgctatattaagaccatgtacgtgtccctagacctagttctttccctacgtctgtttttataaatgctggtgataaaccaggtctgattaatatataatcattttgtgtgattatgtaacggctataattctaggttatctttggtcaaccttaagaaaaatggcagtatatgtaatgacttttgcaaatgatcagtgctaatttgcagacttttgtttaaagagggtttaaacaaaataagaaaatttcatgattaccagttgctattaaatgaattgtaactttttttaaaaaaaaagaatgtccaagccaggtgtggtgctcatgcctgtaatcccagcactttgggaagccaagaagggcagatcacttaaggtcaggagttcaagaccagcctggccaacatggtgaaaccccgtctctagtaaaaatacaaaaagttgctggacgtggtggcacacacctgtaatcccagctactcgggagggtgaggcaggagaatcgcttgaacccaggaggcagaggttgcagtgagccaagatcttgacactgcactccagcctgggcaacagagcgcaactccatctcagaaaaaaaaaatggtatatccagattcacattttttttcaaactctgcatttttctttctttcttttattttttaatgtttttgagacaaagcctcactctgtcacacaggctagagtgcagtgccacaatctcagctcatttctcagctcattgaagcctcgacctcctgggctcaagcaatcttcccacctcagcctcagcaataggtgggaccacaaacatgggccaccacgcccagttaaattttttttttttttttttgagacggagtcttgctctgtcgcccagtctggagtgcagtggtgcgatctcggctcactgcaagctccgcctcccggtttcatgccattctccttcctcagccccccaagtagctggggctacaggcgccccccccaccatgcctggctaattttttttgtatttttagtagagatggggtttcaccgtgttagccaggatggtctggatctcctgaccttggagaccgccttggcctcccaaagtgctgggattacaggcatgagccaccatacccggcataatttttgtattttttatagaggtgggtttttgccatgttgcccaggcttgtcccgaacccctgccctcaagcgatccccctacctcggcctcccaaagtgctcagactacagacgtaagcctccgcacaccttttggactggtgtgccagttcacacatgcctgtgatagcaactgcgttctgaactgcagggatacatttacttgtcagcacctgaaaacttcctcctgagttgagtccaattatcagcttcatgtgccatctgccaatccagatgaaacttggcaaatacaaagctgtccttttccaggtgacactccccaccttctttttcctccaccatttcattaacaactaaaaagctcctgcatgatcagacctgtgtatctatccatcatcaaatcccactcctttttcgagactgggaccctctggaggctgacccagccacgcatttgctagcatgccctgcagacatgaccctcgctgggctctgatcagccttcaggcctccactccaggtgtcactgttctgtctcccctctgctctcacagccttctctgctagatgtctcagccgtgctggccctctctatttcagaagtgaatgtactgagagggtcttagggacttattaataatgctcctggggtcggatgtagtagctcatgcctgtgatcccaatactttgagatcacttgagcccaagcgtttgagaccagcctgggcaacaaggtgaggccccatctctatcaaaaattcaaaaaagtagccaagcatggtggtgcacgcctgtgatcccagctcctcgggagactggggtgggaggatggcttaagctcaggtcaagactgaagtgagacatgaggccaccactgcactccagcctgggcaacagagcaggactctgtctcaaaaaaaacaaaacccactataaccataatactattatcacacttaagaaattcataattccttaatatcatcacatatccaattgatatctgagttcaattatttcatgtcaatgtttttaaactatttcaatcagaatctaaatgaggtcaacacgttgcaattggttggtatgtcttttaaactccttttaatctacaggtttctctttttttgccttgagtttcatttattagagaacccagacattgtcccatatagtctcccagagttggatcttgctagtttcatccccacggcctagtttaacacattcctctgtcctttctattttcttttttttttcttgagagggagtctccgtctgtcccccaggctggagtgcagtggctccgtctcagctcactgcaacctctgcctcccagttcgagcgattcccctgcctcagcctcctgagtagctgggattacaggcgcctgccactacgcccagctaatttttttatatttttagtagagacgggggtttcaccatcctgatcaggctggtctcgaactcccgacctcaggtgatggacccgcctctgcctcacagagtgcaaggattacagacgtgagccaccgcacccggccaaatgtcctttctattttctataaattaacagtcagatctaggggctcgatcagatttgtgtgtgtgtgtgtgccgtgtgcgcgtgcacagcatgttctttgactaggaggcacacctgctttggttatcttctttttgtaatctttaagttgctctttgatgtagacgtggtaactaatgttgaaacaaaattagtttcgtttcaaaacctttctttcaggaagaggttgtggttgattacttctgcgacaggtagatgcaaggttgagcaatcatctcttaacagaagtggtcacactagaataattcaagcacaacaacaaatcccacatcatcaccccctcttaataatggtgttttctttttacttgattagcttttaattgtcacgcactctgcattttttccctgaggtattatttccagaaggcagcgaaatatgactcaatggctaatttgctttttaaaaattaaacaaaacttaggccagctgccatttaagaagggctccggggcctccagactcggtgtgaccgtagccgtgcccggtgctcccctcgcggaggcgttagggcggcaggtttatctcacttgagaccattccttcctttttcatcttctccgggctccggcgcagcaggccgcaggggcgggcactcgcaagaacgcggcatcctggatggtggccgagtcaccgaagctcagaaccccgcgtcccagaatcgctgagagccggccccgcacgggggcctgggagcgccacgcgccctccacccagagaggcaggcgggcgggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctgggtgagggccagcgggcgccccgttatgtgcgtgcgtggcctcccggcgccggggcgcgctctcccctcgcgggccctgcgcggtcgtgggcgccggaggcccgttagcagcctgctccccgtcgcgtcccgtcgccgctcgggccgccagcccgcgggtcagcgcgggagaggctgggcgaggagcggggggagggacgggtcctcggagccgcgcagctccgacccttccgcgaagaggcgcaggcgcgtccccgagcgcgggagtccccgccaggcccacgccggccggttggggcgaagggtgtccccggctgtgccagccttgagtagatcttttcgctagaagattcctgtgccctcaggtgggcgccctttcctctcaccactccctctcctccggagcgggccgaggtgagcgggtgccggccttggggctgcctgagtgctaggcagggtgtggtcctgggcatccttgggcctaccagcgagccctgctcagggtgtcgggcgccggcgggcagtactggcgggggcggccgcagtcccggccttgggcccgttaagggggccggcgtccctccatatgccccccggggcttctcggacttgatgggccctggtcggttcacgccgcttgtcccattgatcctcacgacaagcctgggacgtaagaacggcggattcgtaggcatttttcatccatctcggttttgtggatgaaaagactgaaaatggaagacttgccaaataaggaaaatatgtggcgtggcctgctggtcccctgacagctaattgagaggccttaactctccagaggattcgggccttctgtgttacatagagaatgctcatctctcccaggctactcctaatatgctagggattgtgtggaatgctttacaaacattacccaatttcatcctcttggtaattctacttggttggtattatcgctgttttaaaaaatgaaataagaacgcgtgactaaatgctagggggattctaatgcgcattcggttgcctcttccagagcacgtgtttgttttttgtttgtttgttttttgagactgcacgtgtttgttttttgtttgtttgtttgtttgttttttgagactgagtctcactctgttgctcatgctggagtgcagtggcgcgatctccactcgctgcaacctctgcctcctgggttcaagcgattcttctgtctcagcctcccgagtagctgggattacaggttcccaccactacgcctggctaatgtttgtatcttttttagttagagacggggtttcaccatgttggccaggcttatctcgaactcctgacctcaggtgatccgcccgccttggcctcccgaagttttgggattacaggcgtgaaccaccgtgcccggccagagcacgagctttttaacctctgttgaggaaacggggaccggtcacggtagctcaggcctgtaatcctagcacttcgggaggctgaggcgggaggatcgcttcagcccagaagtttgagaccatcctgagtaacatagtgagagccccccgtttacacacacacacacacacacacacacacacacacactttttttaaattgaggaaacggtgagttgaacatgagcaattattccttatatatagtatttccttagtttttcttctcaacattcatttgcccagtgaaaagaaaaagcaagtagctgggaccacaagcgcacaccaccatgcctggttgatttttctattttttgtagagatgggtttctccgtgttgcccaggctggtcttgaactcctgggctcaagcaatctgtccgctttggcctcccaaagtgctgggattttaaaggcgtaagccactgcacccggtaactttgggttcttgaattcccttcctcctcttcttcctcctcccctacactccattagagaaagggtcttgctttgttgcccaagctggagtgcggtggttgttcacaggcatgatgatcactgcagcctgggctccagtggtccgcatacctcagcctgccagtagcaatttgtttggcacatcacttacacatacttgatatgagatagcatgatacttttttgagacggagccgcactctgtcacccaggctggagtgcagtggcccagtctcggctcactgcaacctctccctcctgggttcaagcagttctgcctgccccagtctcccgagtacctgggattacagacgcccgccaccatacctggctaagtttttctatttttatttttagtagagacagggttttgccacattggccaggctggtctcagatgatgcgcctgccatggcctcccaaagtcctgggattacaggcgtgagccaccctgccaggccacatatgatatattttatcaatgccttatctacatgttacataggaataatctagcgtcctacctgtgtaaaaaccaactctggaatactgaaactgagctacttaatattctgaaaatcaggacgggtgtggtggcttttttttgcctgtaatccgagcactttgagaagctgaggcaagaagatcgcttgaggccagttcagaacagccccatctgcacgagaaattaaaaaattagctaggcgtgcatgcctgtcccgctactcagaaggctgaggcgagaggaacacttgaactcaggagttcgaggccaacctgggcaacatggcaaaaccccatctctaccaaaaaaaaaaaaatttaattagcgggacatggtggcatgtgcctgtggtcccagctacacagaaggctgaggtgggaggattgcttgagctggggaggtagaggctgcagtgagccgtgattgccccaccgcgttccagcctgggcaacagagtgagactgtctcaagaaaaagagatgaaggaagtgagaaggtgctgattgatacttacctcacactgagccttttttccccccacagacttatcactgaaccatttcactgggaaagtaaaaggaccacatatttcttggccgggcatggtggctcacgcctgtaatcccagcactttaggaggctaaggtgggcggatcatgaggtcaggagatcgagaccatcctggctaacacggtgaaaccccatctctactaaaaatacaaaaaattagccgggcgtggcggcagccacctgtagtcccaactactcaggaggccgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtttcagggtgggagatggaataacctgtagaaagaatctttagatttgtttaaattatacacaaatgataagagatctttctgaaagtattgactttttggcgggggagggaaggggcctgatagaacaaccaacaattgtacactttaagtttacatttagagttcacattaaaagttcatttacaaggcatctgtttgaaattcgtgaggatgagctgggctgggtggctcatggctgtaatcccagcccttgggtggctgaggtggacaggtcacctgaggtcaggagttcaagaccagtctggccaacatggtgaaaccccgtctctactaaaaatacaaaaattagctgggtgtggtggtgggcgcctgtaatcccagctactgggaaggctgaggcaggagaattgcttgaacccaggaggcagagggtgcagtgagctgagatctcaccattgcactccagcctgggcaacagagcgagactccgtctcaaaaaaaaaaaagaataaatcacaagaaatggttccttcactgttatactttaacatgatacagctttttaatgttttattttttgagagagagtctcactgtgttgcccaggctggagtgcagtggtgtgatcataaattcttgggctcaagtgatgctcccgcttcagcatcctaagtagctgggactacaggcttgtgccacctcacctggctaattttttttatttttggtagaaatagaatctgtttgcccaggctggtcttgaacactgggcctcaggcagtctttgtgcctcagcctcccaaagtgctggattaatggtgtgagccacagcacctggccaatagctttattgagattataattcaactatcatgatttattcatttaaagtgtacagttcagtattttttagtatattcacagagttgtgcagctgtcaccaccatataaccttagaacatttcatcatcaccaaaagaaaccctatactcattagcagtccctcatatcccctgcttctacctaggtaaccactaatctactttgtggcctatagatttgcttattctggacatttcatatacatgaaatcataaaatacctgatcttttatgattggcttttacttagcataatataaatttttttttttttttaatttgtagagacagggtcctgttatgttgcccaggctgatcttgaattcctgggctcaagtgatcctcctgccttggcctctcagagtgctggcattataggtgtgagccactgcacccagccattagcataatattttagctgggcacagtggcatgctcctgtagtcccagctactagggtgactgaggcaggaggatcacttgagtccaggagtttgaggctgtagtgagctatgatggcatcactgtacttcagcctgagtgacagaggtagaccctgtctctaaatattttaaggttcattaaaataatatattttcaataaaataatatttcaataaaataatattttaaggttcattcatgttatagcatatgtcagtgtatgattcctttttctggctgaataatattcctttgtatggatataccaggtgtttaacattttgaggaactgctgtacagttttccaaagcagctgcaccattttatattcccactagcaaagtatgagggttctaatttctccacatccttgtttttacctacctttttttattatagtcatcctagtgagtgtgaggtggtatctatggtttcagtttgcactttcctaatgactaacggtgttgagcctctttcatgtgtttcttgactgtttccgtatcttttggagaaaagtgggttcagatcctttgcccattttttaattggattattagttgtaagagttcttcatatattctggatataggtcccttatgagatacatgatttgcaaacataaccccgcttctgtggattgtctttttactttcttgacagtatcatgtgcaacagaaagtttttgatgctgtccgatttctctgttttcttttgtcacttgtacttgttatagtatctaagaaaccacaaaggccatgaagatttatttctatgttttcttatcagagttttataattttcttataaatttgggtctgtgatctgttttgagttcatttttgtgtatggtgtaaggtaggggtctgaatccattcttttgcctgttgataacaagtcggtctagcaccatttgttgaaaggactgttctttccctgattatattggtagcctgtagtattggtttttatatactattacaattttgggaaaattcagtacagaattacttggagcatgttgatttgtctgagaaaactgtgaataccagtttcatgattttagggtaactacaaaatgtatattatattctatcctttgtcagatgtgttaatttaatcgttttatataaggtaagaatgctgtacctctgtctaaacacagaaataacatgtattttaatataaagaatgtggaacttctaaactttgaggctaatttttcctgcataaattctcaaattattgtgacatgatatttcataactttactagtagaatccttccctgtgttattaaatatccactaaagtctctagtaaagggaatatgatttacagaacaaatttaatgtgttagtttaattggtgttaatttaattataattggtgaactattacatacttttcttagttcctgtttttttgttttttctttacagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttgtatttttagtagagatggggttttgccatgttggccaggctagtattttgtcagtccaagcagttcattaaaaaaaaaaaaaacaaaaagagcaagaatataaatactgcatcttccagcctacttttacaaagggttcactcttgggtccttaagcttagtggttacacttaggatttatttttaattttattttttaactttatgtttttttagagacagggtcttgccctgtcacctagtctagagtgcagtggtacgatagctcactgcagcctcaactcctgggtcaagcgatcctcccacctcagcctcctgagtaggcaggattataggcacgtgccaccatgcctggctaattttttattttttgtagaggcagggtcttgctgtgttgctcaggctggtctcaaactcctggattcaagtgatcctcctgcctcagcctcccaagtagctaggactacagccacatgctatgacaggctgattttttaaataatttcttttaatcctccaaatggtttgttaaaatttttaacatttttaacatttttatagagctggagtttcctggatgggtgcagtggctcacacctgtaatcccagcactttgggaggcctaggtgagtggatcatctgaggtcaggagttcgagaccagcctggccaacatagtgaaagcctgtctctactaaaaatacaaaaaacttagctgggcatggtggcgggtacctatagtcccagctactcgggaggctgaggcgggagaatcgtttgaactcgggcagtggaggttgcagtgagccgagattgtgccactgcactccagcctgggtgacagagcgaaactccgtctcaaaaaaaaaaaaagagagagatgggtttccctgtgttgcccaggctggtctcaaattcctgggctcaagtgattctcttgccttccagaatgatgctgggattatacatacgaaccactgtgcccatccagatagttttttaacttgagatgaaaagacatttttaacttgagatggcagaattgcacatttgataagtgcttttttttttttttttttttttttgagatggagtctctctctcacccaggctggagtgcagtggcacaatctcggctcactgcaacctccgcctcccgagttcaagcaattctcctatctcagcctcctgagttgctgggactacaggcgcacgccaccatgtctggctaatttttttgtatttttagtagagatggggtttcaccatattggttaggctggtctcgaactcctgacctcaggtgatccacccgcctcggcttcccaaagtcctgggattacaggtatgagccaccgcacccagccaagtgcttaatttctatctaattagcatgccacaatttattagtatttgtaagttcctggatggcagggatcagatgttgcctttatattctatggcgtcatccatgcagtacattctttaataatatcaagttaatctaattgtatgtatttgttgttaattttacaaataagccagatatttagtcccttggaatgtgatgggagagagacctagagggtcgagtgtattcaactgctgctgaaatgtagactgctttttgtttagaattcccacagctgctgctgctgctgcttttttttttttttaagagagaggagggaggcaggtctcatggtttcccttctcagtgtttgtgtcaaccattcatcagtcatctttgaaagaacctagtaacactcatttttcatcttgctgtattttttcccttctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattcaaattcatttttcaggtgtgttgactctcacattagaaactgctcaactgataaagactttcatgttatttcactgcagtgggaactggctgtggtctgatggtagatcgttggtctcaagtagctggtagcatgggctgttgttatgtcagcagtcttgcttacctcaaatatgtcacttggatacgtttagtgtaatatggtgaattattttaaaaatacatcagcagctgggtgtggtggttcacacctgtaattccatgcttcggaaagctgaggcaggaggatcgcttgagaccaggagtttgagaccagcctgggcaacatagtgagaccccatctttttttattttttattttttgaaatggagtcttgctctgttgtccaggctggagtgcagtggcgcaatcttgcctcaccacaacctctgcctcctgggttcaagcgactttcctgcctcagcttcctgagtaactgggatcacaggcgtgcacagccatgcccagctaatttttttttttttttttttttttttgtatttttagtagagacaggttttcactatgttggccaggctggtctcaaactcctgatctcaggtgatctgcctgccttggcctcccaaagttctgggattacaggcatgagccgctgtgtctggcccccatcttttcaaaaaataagagtggtgtggtggtgtgcacctgtagtcccagctacttgggaggctgagattgagactacaatgagccatgatcgcactactacgctccagcttgggtgacaaacaccctctaaaaaaaaaaaaaagttggctacattgcagtttcgtaaagaataaaacaacacccagaatgctgagggcggggtgaggagtagaatcctctgtgggactgccaggcctgtctcacagacctcatttcatccccaaaatactttgctttcccttcctgacccccttgcctaggaaaattcctagtatcttctaatctgttactcaaagaacaatcaaagagtgacaatagaaccaagtttacaattcagattttactcagtcactaaagtatctgcaaaacatacccctggatttgatgctagatcatagagatcatgtactcccatcaagtctatagaactctggccaatggcaccgggcgtggtggctgtaataccagtactttgggaggctgaggcaggtggatcacgaggttaggagttcaagactagcctgaccaatatggtgaaaccctgtctctactaaaaaaaatacaaaattatctgggcatggtggcatgtgcctgtagtcctggctactcgggaagctgaggcaggagaatcgcttgaacccaggaggcaaaggttgcgtgagccgagatcacgccctgcactccagtctgggcgacagagcaagacaacgtctccaaaaaaaaaaaaaaggccaggcgcggtgcctcacgcctgtaatcccagcactttgggaggccgaggtgggcggatcacgaggtcaggagatcaagaccatcctggccaatacggtgaaaccccatctctagtaaaaaatacaaaaaattagccaggcgtagtggccggcgcctgtagtcccagctacttgggaggctgaggcaggagaatggcgggaacccaggaggcggagcttgcagtcagccgagatcgagccactgcactccagccggggcgacaaagtgagactacgtctcaaaaaaaaaaaacaacaaccaaaagaactttagccaatggctgcagctgccatgtaaatgctgaaaacctccaaatctatcacttcagacctctcactacctgctggatgcacagagtgggttgtcatccctctccaaaactccagtctccacttacataaccacttctttcctgaatggaagtttcagtcttcgtagcaggcatcccgattattctggctcccatctgccaactcgatccattctttaagagagctaccaatctgggcagtaagaaggctgggccccataacctctaaagaataactccaaacaaaattatccgggcctggtgttgtgtgcatctgtggtcctaagctactcaggaggctgaggtaggagtttcgcttctttttttcttttttttttgagatggagtcctgctctgtcgcccaggctggagtgcagtggctcgatctggctcactgcaagctccgcctcccgcgttcacgccattctcctgcctcagcctcccgagtagctgggactacaggcgaccaccaccacgcccggctaatttgtatttttagtagagacggggtttcaccgtgttagccaggatggtctcaatctcctgacctcgtgatccgcccgccttggcctcccaaagtgctgggattacaggcctgagccaccgcccacggctggagtttcgcttcttgaacccaggaggcggaggttgcagtgaactgaaattgcacgccattacactccagcctcggtgacagagcgagatcccgtctcagacagtcctaagaaatcactcagtagctttgcatgagttctcccttctgttgtaaactcctttctccgtttctcttctggttcaaagtttcacaccttcaaggctcacagcagccttctgttacccacccccagtccccagcaggtcaggtgtcaatttttttgactttgagaaccaatgattatctcttcatggccctaatcataccattgtgtaaataggcactgtttctccataagttgtaactccttaagagcaggacacatcttttatttctgtttcccaaacctagcagggtgtttgacttaaagtaagtgcttgataaatggagagagaccagcagggagagtccttgaacttgagaagctttttctaaaacaaaaacacagccaaagacagggcacttgtataatctttaggtaaaagtattttatgctacaaataatggacattcaatgagaatccttacttttcactgagtcctgtaccaagtgttttacatgaactattgtacttttttgttgttgttcctttttttttttttttttttttgagacagagtcttgctctgtggcccaggctggagtgcagtgttgcaatctcagctcactgcaacctccgcctcccagggtcaagcaatcctcccacatcagcctcccaagaagctgggactgactacaggtgtacaccaccacacctagctaatttttgtattttttgtagagatggggtttcgctatgttgcccaggctggtctcaaactcctgagctcaagtgatccaaccacctcggcctcccaaagtgctgggattacaggtatgaaccacaatttattgtatttaagtctcaacatttatatgctataagcagtactattaatatcttcattttgtagatgacagaaaaggcttagagagattaagtaactggccgaaggtcacacttagtaaactgcagaaactgaacctgaaatgcagactctgtggactccagacccaaaagccttaaccatattccatttggcttacattatgagcctcgtcctgaaacagtaatgagaatgaaaaacacatgttcctattactacatacatactctactgcctcattaaccatttcctgtatgccagcattttggctaggtctctgtttttttccaactcttgaatctaaaattcaaatatgaaacattaatgtttaaatccatgcaaaaaatgcatttatgtattcatttattcattctacagatgcttttggcaggcttgcactaggcagtgaggatacaaagacaaaatgttgccccaaattaaggagctaatgctctagtgctgggaggtacatgttaagaaagaaaggacttaaaacaggagaattaggatgtggctgggactgagtagagggcacacattgctatcgctgatcagggtgagtgctctgccaggctgtacgtgcaaatattgtgctaatccacggcagcctgggaaggtaggtattgtctcccacacttttcacaggaagaaacagggttaggcaagtaactagcctgaggtcacacaacatgggccagggcctgaagctatgtgtgttaaagccaatgctttatgctattcctcttggaagctctttggacaagttcatgtatttcttgttaggaaaatcttctagaagccttagccatttggaaggaagcaagaacagtttgatgacctagggctaggaaggctctgaaaaactgtgcccttgaaatccaagaacattattattattattattattattttgaaacagggtctggctctgtcacccaggctgaagtgcagtggtgggatcatgtctcactgcagccttaaccacctaggttcaagcaatcctcccatttcagcctcgagtagctgggaccgcaggcgtgcaccaccatgcctggctttttttttttttttgagatggagtctgcttctatcacctacgctggagtgcagtggtgtgatctcagctcactgcaacctccacctcccgggttcaagcgattctcctgcctcagccttcccagtagctgggattacagacacctgccactatgcccggctaattttttttttaaatatttttagtagaggtagggtttcaccatgttggtcaggctggtctcgaactcctgaccttatgatccgcctgcctcagcctcccaaagtgctgggattacagatgtgagccactgcacccggcccctatttttattttgtatagggacagagtctcactgtgttccccaggctggtcctaaactccagtggtcctcctgtctcggcctcccaaagtgttgggatcacaggcgttagccactgcctccagccccaggagcatcactaataaatccctaagacctgctcagtacattgacttctgagacagagggccagcatggccgaggcgcctggcagaggaggctctgagagcagaggggagacagagcagtgacacctggagtggaggcctgaaggctgatcagagcccagcgagggtcatgcctgcagggcgtgctagcaaacgcagggctgggacagcctcaggagggtcccagtgttgaaaaaggagtaggatttgatgatggatagatacacaggtctgatcatgcaggagcttttcagttaatgaaacggtggaggaaaaataaggtggggagcgtcacctggaaatgaacagctttgtatttgccaagtttcatctggattggcagatggcacatgaagctgataattggactcaactcaggaggaaggtttcaggtgctgacaagtaaatgcatccctgcagttcagaatgcagttgctatcacaggcatgtatgaactggtacaccagtccaaaagcaggccaggtgtggaggctcatgtctgtagtctcagctattcaggaaactgaggtaggaggattgcttgagcccagaggttcgggacaagcctgggcaaacggcaaaaacccacctctataaaaaatacaaaggccaggcatggtggcccacactttgggaggccaaggcgggcggatcatgaggtcaggaaatggagaccatcctggctaacacggcgaaaccccgtctctactaaaaatacaaaatattagctgggcgtggtggtgggcacctgtagtcccagctactcgggaggctgacgcaggagaatggtgtgaacccaggaggcggagcttgcagtgagccgagatcgcgccactgcactccagcctgggtgacagagcgagactctgtttcaaaaaaaaaaaaaaaaatacaaaaatacaaaaattggccaggcatggtggcttaagcctgtaatctcagaactttgggaggctgaggcgggtggatcacctgaggtcaggagttcgagaccagcctagccgacatggcgaaaccccgtctctactcagaatacaaaaatcaggtaggtgtgatggcaggcacctgtaatcccagctacttgggaggctgaggcaggagaatcacttgaacctgggagttggaggttgcagtgagcaaaggttgtgccactgcaccctagcctgggcaacaagagcgaaactccttctcaaaaaaaaaaaaaattagccaggtgtggtggcatgcacctgtgattccagctacttgggaggctgaggtgggaggatcctttgagcccaagagatagaggctgcagtgagccgagatcatgccactgccctccagcctgggtgatagagcaagaccctgtctcaaaaacaaaaaaaaaagcaagggtgaggacagtgtcctggggagttctctgtaaccctggctgcatgagagtgtttgaacagacagcaccgtctgggaagaaaggtggaacccaaagaaacataagtcacttttttatggagtcaagagtggatctcccggttactaggtacacttccctgtattagtaatccctgagaaagaaatacaatagatgctttgtggaaaaggcctggaggaattgagctgccctcaatgttgtgttctaaatccttgcaggtcagcaatttgctaacccaaggagggcctgtataatctccctcccctattagtgtattaccaagggctgctctcacagtcttcacagaggggccagtaacacccagaatagcccttcatttctctacttggtggtttaagccttacattcccctcccattaggtagctgagatgtatatatatattttggcacaaggggttgtcccattcccttcttactttgaactgtagtctcccctccttagccaccataaacacaggttaagaaatctgcttttcggccgggcgtggtggctcatgcctgtaatcccagcactttgggaggccgagacgggcggatcactaggtcaggagatcgagaccatcctggataacacagtgaaaccccgtctctactaaaaatacaaaaaaattagccgggcgtagtggcgggcgcctgtagtcccagctactcgggaggctgaggcagaagaatggcgtgaacccgggaggcagagcttgcagtaagccgagatgatgccactgcactccagcctgggcgacagagcgagactccgtctcaaaaaaaaaaaaaaaaaaaaaaaagaaatctgcttttctcctctatgctggctgttaaataggctagagagtgtagaaagtgggttcttttaaggccgggggtggtggctcatgcctataatcccagcactttgggaggccgaggcaggtggatcacttgagcccaagagtttgagaccagcctggtcaacacggtgaaaccctgtctctactaaaaatacaaaaattagccaggtgtgatggcaggcacctgtaatcccagctacttgggaggccgaggcaggagaatcacttgaacctgggaggcagaggtcgcagtgagccaagatcgcaccatcgcactacagcctgggtgacaagagcaaaaattctgtctcacaaaaaaaaaaaaaaaaaaaaaaagttttttttttgtttttctttttttgagacagggtcttggtggcgcatacctgtcttggtggcacgcacctgtcatcccagctactcaggaggcctgaagtgcaagaatcgcttgaacccgggaggcagaggttgcagtgagcagagactgcgccacaactacattccagcctgggagacagagtgagactccatccccccaccgccccccaaaaaaaggatcagagacaagtgtaagcaaatattaggaaaatgacactccctattttaatcaaaatatgatctccttgtaacatacacaatgtaaagtagataatcttatccttattttagggaggaggaaactgagaatcaaggatgttaggtaacttgcatcaagttggccagcttgatctctgagtagtggcagaaccagaacccgatttgaaccagcctcactctaagccccagcccttgccacaccaccaccacccatcaattacatatccacaaagaacctccgtctggtcacgtatgaaatgagggattgctgccgtccagttgggaatcctggagtctgaatgccccaccacagacggcagtgatcagaaagatattcttctctggggagggctgggccccatccactccccagtcaactccccacattccagggagatgcagtgagctcttctctgcagccagctcaggctcatgactgcactgccagggaagagagtaacattgctccagacccatttgtacctgactgctctaaaggttaccttggatctgggaaagtttgctgagtaaattaataacataagcaaggacgtaagaagaactttaacctacctcacagaattctatactaagaggccaaactgtttttgagaaccaaaggacaatgcatacaacgagtctggttattcctagagaatcctaactgggagctgacaatattgatggggctcctgccaagtgccggggcctgtgctcatctctttatggactgtttcatccttacattggtattatcctcattttgcagccaagaaaataaactaataggaaggaataagtaacttgtctaaagtcatgcagccaaaattctaacccaatgtctacaaagtccatgacattgcatttttctttttctttttttaattaaaaagagaccaggccgggcgtggtggctcatgcctgtaatcccaggactttgggaggccaaggtgagttgatcacttgaggccaggagttcaagaccagcctggccaacacagtgaaaccccatctctagtaaaaatacaaaaaattaactgggtatgatagcgtgcacctgtaatcccagctacttgggaggctgaggcaggataattgcttgaacctggtaggaggaggttgcagggagccgagattgcgcccctgcactccagcctgggtgacacagggagactgtgtctcaaaaaaaaaaaaaaaaaaaaagagactgggtccgggctcactatgttgcccagactgctcgtgaactctttgttgttgttgttgttgagacagagtttcctttagctcttgttgcccaggctgaagtgcaatggcacgatctcggctcactgcaacctctgcctcccaggttcaagcaattctcctccctcagcctcccgagtagctgggattacaggcacccgccaccacacctggctggctaatttttgtatttttagtagagacaggtttcaccatgtcgaccaggctggtctcgaactcctgacctcaagtgatctacctgcctcggcctcccaaagtgctgggattacaggtgtgagccactgagcctggctaagagaaaggccttgaactcttaaattcctggcctcaagcaatcctcccatctcagcctcccaagtgctgggattacaggagtgagccactacacctggccaatatttgtgtttttttttttttttttgagatggagtctcactcaatagcccaggctggagtacagtggcgcgatctctgctcattgcagcctccatctcccgggttcaagcgattctcccaccttagcctcccgagtagctgggactacaggtgcatgccaccacgcctgtctagtttttgtatttttagtagagatggggtttcatgacgttggcctcgaactcctgatctcaggtgatctgcccacctcaacctcccaaagtgctgggattacaggcgtgaaccactatgcccggcccaaagtttgtatttcttaaaaaggattttacaatgataattttcctcaaattcagagcccgctttctacttagtataactgatggggttttctaatgataatatgaaccgtcccactcccaggaacacaggcagcaggccaagcagtggctctcagtgagggtgagtgtgtgggttgggggaggggcagcccatgaacaccccaagctacttccacactccaatggtcaggagaatgcagaattgaaagcaggaacaggagtctgtggcctggagctcacatttaaccaa

SEQ ID NO: 424 - DNA, 39197 bp, Homo sapiens
aatcaaatagctgccaggtttgagtcagtcttattttggtggtctactataaacaaaaacgtagactggataaactatatatattacaatcaacaaggatttgttaattataccagagataccatttggggatagccgagcaatttggtcccaccagccaaatggcctgggaaaacaggatagctcttgacatgacattagcagaaaacggcagagtttgtgtaatcatcagagcccaatgttgtactttgatcccaaataacacagctcccgatggaaccactaccaaggctctacaaggcctcaccaccctagcaaatgagctggctgaaaattctggaatagatgaccccttcacaggtttaaccaaaagatggtttggtaaatggaaaggacttatggcctctatcctcacttcccttgccattgttacaagtgcactcatccttgtaggctgttgcatcacaccttgtgtttgtgggttagttcaaagactcatagaaatggcttgcactaaaaccttctctgtctctccccctccatattcagaccaacttttactcctagacaatcaagaagagcaacaaagccaaatcttactaaaataatttgaagaggaagaattataacaacaaaaagggggaaattgtcagaataaaagaaaggttcctcttcaaagatccaactttcttgtcataggctgtaaaccgccttgctccaaaccttaacctgtaacctttaccctctgccttatttgagaaagattcaagcgcatagccaattggagtcagcctagactgtgcggtccaaccccagccaatgggggaaagacaaagaagcaggaactgcgttagggttagaaacctgttctcctttgttaggtgtgcttttgcgactgctataggcgcgggcagcacccttctgcagaagtaaactttgccttgctgagaaacttttcttctgagtgctcctcttcctctgcggcactcagaaataagagaacttatttctaacaggaggaagaagacatgataattttgcacacgcaggttctgagttttggctggtgcgctgagtgcttaccataccgcaaatactgtgtgatctgggctgaagaacagaaaacccaactaacagtgacttaggcaaaaagaaattttattctttcacagaagtctgaggcaggcaggtccagagttcatgcaggagctcaataacatcagagattgggctctttttgttcttcttagcatatcgatgttttacgtgatgctgggcacctcggggacctaagatggctgttgtagctccatgcatcatgattaaaccagagacaggaagtgtacgatggaagaggccagaggtgatggcctcctcctctccttttgtcttattcctggagtgactccctcctcttatcagcagggatacaagcagtgcctggcagccttccctctctcctgtatgagccaaaagcaagactcatggcacccctccctgcaggaaaggggtggaatggagcccctggcaaagggggctggacttgcagtgacagtgctgctctgaacaggactaggcttctgttggagaggtggtcagcggctgctaggcaggtcacaagctgcctcacccatggctctccagctctgcacctaccctctccttctaataaatctgtttcaataaccaccacgaggtttaaagaggagcagtaacttgcccacggttgcgccaggcacccctagaagagcaagaattccttacaaagttattaaaacaggcaaatcccatataggtgacatttctatccaacaatgctgacatctcttttagttttgagccttagtaatccaattttctgcctcaggaagaggcagcagcttctgggaaaaatctgctcctgctaaggtggctcattcattgttttacctgaatagagtggtggatggtgaaggttcaaattctcactttccatattaaattttataacataaaaaataattaaatggggtgcgcgcggtggctcacgcctataatcccagcacctgggaggctgaggagggcagatcacgaggtcaggagatcgagaccatcttggctaacacggtgaaactgcgcctctataaaaatacaaaaaattagctgggcatggtggcgggcgcctgtagtcccagctactcaggaggctgaagcaggaaaatggcatgaacccaggaggtggagcttgcagtgagccgagatcgcgccactgcactccagcctgggtgacaagagtgactcggtctcaaaaaaaaaaaaaaaaattaaatgagccaaccaggacaatgtttaaaagccagagccaaaaaggctccaaaataaaacaaacttgtctgctcaattaattatttgaagagaacctacagtaatacagactggagatgggaaagcacgagggatgtatgagtcgaggaaccggcaaaggggtgtgggggtgtgtgtgtgtgtgtgtgtgcacacacatgcacccagctagggtagaaaataagtacttttgcttctatgggaagtgactttccagttcacttgtgtatcaaatgaacatgatgaaatcaagttgtactagccaatgtttgggagggttctgtattaaagggataaagaaaaacattagaaagagaagttacaaaaatcactgtggggaaaatgaacaccaatgacttggctgctctgaggcttgcagggagtagacagttaggcatcccaggtcatcagagaaccagtggggtcttttcctcaggggccgggttttctacacgcaagtcaaacctcttctcctctgggacacatgtttccaaaggactccagaaacacagcacagctggattcaggtactgtgtcaagatgtgccttcttcttcatctttgacagcaattaatgtactaaatgtcttgatagagaaggtcatatttgggaatattcttgggatcaataggactttggacaataagcttccccctcattgctcctcgatagattacttcaatcaaatctatgaagtcttgtttggttttgaagcttcccacaaacttagtgtgatctggagatctagacagcatagaagagaaacaactgctctaagaactttgagtaatcacttgttgaagactttcaggataaacaaaatgaaaaacagctttgttattttcttcttgtcaatgagacttcagaaataaagcccaacattaatttttcaatcatttttttccatttagtaaatgactcaacccagtgctgtgggccactagcatgaaagctctgtcatgtgcaaagctttagcttcaaaagctattgtaatcacaaaatctatttttatcacttctcaaatcatcaagcagatttcaccaagtgttggagtgcacattgtttcttcgtttgctgttgttgcttttgcctgggcattgtgcaaagcccattcaatattcatggccttttgagtggtaggtattaaaaaattgattttttagaaaagtatctcaaacaccaggtatgttactgtaaaaattttaaagaaataaataaaatcacggatgaggccagaggtcacttttcagtgtctatccttccaatcttgtgtgtgtgtgtgtgtgtgtgtgtgtgtgtgtgtgtgtgtgtatgtgcagatacaaacttcttttttcccaacattgggaattatgtcatacaaattattcagtaatatgcttttttctagctgacatatatttctttcatttgttaaatgtgcatctgcaacatcatattaaagtcctggaagtgtaattactgggttaaaaagtttaaaaactttaaactatttgatacataatgttgaactggcccccataaaaggttgtaccaaattaatacttacatcaaatgtgttccagtagaataaacagctttaaaatacttttgtgttttttttttgttgttgttgttgttgttttgcgatggagccttgctctgtcaccagactggagtgtagtggtgcgttctctgctcactgcaacctccacctcctgggctcaagcgaatctcctgcctcagcctcctgagtagttgggattacaggcacccaccatcatgcctggctaatcttttttttgagacggcagctctgttgcccaggatggagtgcagtggcgcgctctcggctcactgcaagctccgcctcctgggttcatgccatttttctgcctcagcctccagagtagccgggactacatgcgcccgccaccacgcccagctaattttttgtatttttagtagagacagggtttcactgtgttagccaggatggtctcgatctgctgacctcataatctgcctgcctcggcttcccaaagtgctgggattacacgcgtgagccactgcgcctggccatgcctggctaatttttgtatttttagtagagatggggtttcactatgttggccatgctggttttgaactcctgacctcaaatgatccgcctgccttggcctcccaaagtgctgggattacaggcgtgagccactatgcccagcctaaaacactttaaaacagataatatttcacatactttcaaataaagacaaaaagggtacacagatctagataagtggacacatcaaccacagtaagaaatgatcagaatcatggatgcacccaatcatcaatattaagtattgagatggtaattggatggagtggaaggcactaaagaggacatcatgttacttattcttgacaggctttgttgaagaatgatttaaaattcaatggcgaaaagcaggaaactttgcaagagagaagcacatcttagtttgctagaaggaatgtttctttcataaatgccacttaccagtccaaaagcttaagaaaaactacatgttttgtttcaaatgaaattcctgggaaaattttaagagttctttatttagctaatatggctattttatattttatagacttatggatggtagtgctttgccacctgtactatttcttcatacttaagtcggaaattaaaatttgacaaaccatgtgtatgcactattaaaaaaataaataaaatttgacaatcataccagaagcactctcattttgtagcaaggttttgcataaaaaattagagagtgcgtcaattggggaaacagtactgatataagactcacagagccaacatcacatggaaataggcaagctactgaaaatgcttaccaaggaaacttacaaggttgcaattaacttcagatcaactgcacttacccataatccactttcatatgctgcccattgaagaaaaagacagtagatggaatataactgatgtcaaaatactgtgtataaactgcagtttggtccacatctaccaggtatatagcagccattttacttaagtcagaagaggtcttagaaagctgcaaatgacgagagagacaaaggttacaatatgagaggcagcttaatgtttcttctgtgaaacttgttactacaacagagtgttttgtttgaaaaaactcctgggccaacaatgcagcccatgtggctcccacattagacaaagcataaccccatcctccagagtctcattcactgcaacggggttaggagggaatcttggggaaaactgtatgaggttaggaagggaccttggggaaaactgtgtgaggttagaaggggaccttggggaaaactgtgtgagtttaggagggtgacagcatgggagtattcctgtctattcattgtggagagagacctaacccagaactaagacctctacccgccatttctactgctgccatcccgtgttaagagctgagcatacaaatccttggggaaaactgtgtgaatctatttcttcctttaatttctttctttgaatgcttttataaaagtagcccatgctcatttaaaacaacacaacttagaaatatgttatgtggatactgaaattccctaacgtctccttcctcccaatcctcccagaaatgaaaaccacgataattagtagcagacacttatataacattactatgtggtaactgtcctaagtgcttaacatttgttaactcatttaatccttacatcattcttataaggtatatgctatcagagtccccattttatagatagggaaactgaggcacaggaaggtaaagtaatttgccccaggtcacacagctcctgagcagtagggctggggtttgaactttggcagtgtggcttcagtgtctacatcactgacctctgtggtatttcctcctgcttatgactgagggtagaatcctctggtccttttttccccaagctaacacatcacaccctcattgtaaccacggaaatgaggatttgtacgctcagctcttacacgggatggtagcagtagaaatggcggtaagaggtcttagttctgggttaggtctctctctgcatcaggcacatactggaggcagcacactagaaaagattatttgcagctacagaaaactgagttcaaatctcaactctgcaatatagtggatctgcacctgtgggaaattacttgacctctctggttttttttttcctactgggaaatggggctactattatcccactattgcgagcactgaaaagatagtgttcacagatgcttgttaatagttttctgctcttccatcaccttgttggtgaaacagcattgacagcttctagtgggtaaggacatccaagacagattcagcacacacagatttgggggcttggttcagggcaggcacacaatcagctcttagtgaactaacaaatgaacagctatatacccaaccctgactactccctctcatgtactactcagatgctgaagtgagaatatacagattattaataaaaaccaattattttagacattcacttacaatatcatctagctgcagacagacaggatcttcatctctcccaaacctgagaaccaacaccttctcagcagtactttttatcgcctggtctacttcctttttgctagtcagcttgggcagtaggaagctcatcttgaaataacccaaatgtgaatcctcactgtcactcctgaaataaaggtgcaatgtttaaagacagtttagattaagtgcgtgagccctcattaaaaaaaattaattcacagagtagctaatgtattcacatggtatgaaagaaacatcatagaaaggtaacactgtggagtttccctctctttgtccctgctccttggaaccagttttcattgttccctcccccgggccagataactgctttcattagtttctcatgtatctttcagagttttgttatgcattcaccaaaaaatacaaatatgcgttccgatattttttttctctctctccccacccccaaaagatagcctattgtatcagtgttccagcaggaaagcgatgacactctcaactttggtaatttgaaggcagtttaattaaggcaggtgtagaaaaacaatacggtaaagtgtactactttggggctagtaacagcgggatgctgtacccatccctaggccatgggaggaagaagccacggtaggaagcagttataagaattgtgtggcagaaagaggtgagtggagaggacagtgtataggagggcagcctgctgttaggtgttgcagccactctcctccctccctctgacctttgctcatgcaaccaccggctgactccaactggaaccagagggcaggggcctgttgaggcaggcaaacctccctgtcccagagcagtctagaggaggatgaagaatggctgtggagggaccaatggcagatgttcagcacacacactttatctactcttcagcacttttcattatttcaaacctaacctatgaagattgccccatatctctatatagagaacatccatattctctgtcatggcagcatattatttcttgcatgtgttacactttttaaacagtcctttattgtatactttatattattacaagtcctggcttaaagattcttcgtgtgcaccttactaggtgcacctcattacacggcaaacagatcaattaagagtgtgtgtgaaaactacaataccataaacaaataataaaatactgaggtacaagggacctaatacaaccccgtcattttacaaactagcttgcttacagttgcactttctactacaatgacaaggactagaatacaggccaccaaatttctagtccaggggtccttctactacaataatctattttcatgattggtagaaatttcatttttgagaaactctttgacaaagaagcttagttttgtggtcatctataagagactccattgagatggtcggtattttgaattcagttccaaatatgaaaagggaggatttcttttcctattttttttgtcacaagtcacattttaagatacgaattaggccaggctcacccctgtaatcccagcactttgggaggccaaggagggtggatcacctatggccaggaattcgagaccagcctggccaacatggtgaaaccccgtctctactaaaaatacaaaaaattagccgggcgtggtggcagatgccacctgtaatccaagctactcaggaggctgaggcaggagaattgcttgaaccctggaggcggaggttgcagtgagctaggatcgctccactgcactccagcctgggcaaggcaacaagagcgaagctccgtctccaaaaaaaaaaaaaggaattatttaactaaaattcacataggaaataagattgttccagctataggtcatactttaaacagggacattgatggcccaaagggacgtcatcagatgtgagcagcagaacaaattaccaatgaaagggaaggtcaaagagaagacggatctgtcccactagaattcaaacaaacagcagttcctccgtgttactgatcgaaaggagaaagtaaggggagaacaaagttgttagtggtgaggctaggggtgcaactggacaaacgttggaagcaggagaggaaaactgagaccacatctaagaaaatgtccatagtaaatgatacccacagagaattcccaaaagaagacgtacaaatggacagtaaataaactaaaaagttaagctttaccagtaagcaaagaaaagcaaattaaaacatatgtttacaaagtcactgaattggcaaaaattaaacaagatagtggtaggggcaggcacagggagttcctgctggaatgcagacacaaaacctttctggaaagaaaactgacatactctttgaccaataactccactgctttcctctctccctctctttttctgaggcggggtttcgctatgttgcccaggctggtctcaactccccaggctcaagcaatcctcccgcctcagcctcccgagtagctggaacctcaggcgcgcgccacaactgcagaaacaccaaaaaaagaaaaaaagcttgaactcacttttgtacagaatcttactacaatgtattccagaaaaacaactggaaatcagtggtcatctctgcgtgtgaacgcatgggtgatttttatttacagccgggcgcgcatctccattttccaaaatatccgatatacatatttaaagtcacctgtgttgcgctgctcctggcccacaagcgctaagggaccccagcacttaccttactcgtccacgccgcctcactccctttcactttgtggctgtcagcaaccacttctcggaagagcccgggcgcggacagctcctttcatcagccccaagccggacaggaccctaagaccaagtcacccaggggctgttgcctagcaaccctcgtggccccgctagcgggaaggaaaccgaacagaaaacgcacaagcgcagaaaagaaactcctggccgtcggtcggcccccgctcaacagcccaataaacggaagagcttctagtcaccgcccaccttgctcggctctgaccggaagctaggcgtcacctccgcccgtattaaagatggtcgacctttttcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgaggtgagagtcccttcttccttcctggcctgcccttctgtaatcatggcggctctaggcggcggatattggtcccctgctcaggtccgggccccagtttggggagttcctctgtcgtccctgtcacccaccttgccttactcacctcagggatgctgcatccgtcctggccgccttggccttcctccttgctctggtcaaatcctgctgcctggagcggcctcgctgagatccagggatgctgcctggagtggccttggtccctctcccaggcctccgctttaacccaccccagactgtcaccgagcccgagtaggactccttgtgtcttcctctgctctctcacagtgtcatttataccaggcaatctggtgggcgatctcttctactagaatgtcagctccaggtgggcggggatttttgtcttgttctctgttgctatcgccgagaacagcaattggctcagggacaccctcagtgaataattgttgaatgaatgaatccaggttctttcttccctggctttctcgtacgccttgtagtttctttgccattaatccttctcaagaatcttgctctttagctccttatttgttcgtctcagcagctaatgaagttctctctggctgtctccttgtcctgtgttgctggaatcttcccttgctgtctccagaaatgtttgggttcctgtcctcctttaataagtttaaattaattcattttttaatttatcaaacgcttattttgctagacattgagctacagcagtcaacaacacatccagtgttctctcaactgcgtagaatggcagtccagggtacctttcctagtttagacaactattgagtagagcctgtatatctttaccttcttgtgtggatttcctcacatgcgcacagatgtcaccaatatgcagctttctttttttctgttctgcctgatggcattttcaaaatgtaactcttgtttctgcattaatattatgtgtccagtctgtttggcaatactctgtagagctgtgcatttaattagagtttggtaaacaattctggattctggtggcatctcctttgctttgctaacttgttggaatgagaggaattatccaagcatccagaactgatatatgttgatgagtggcagatgtgtagtgagaggtaaagaggagcttgttccaacttgagtgccagaagtcttgtagccacttaaatacttctcagtaacaccttttcctaacctggtgtttctcataaatatttttggtgaacatggattgttattaaactgattttggctgctgtgagtaaattgttttctgtaaaacgcagctaggccaagaaaagccactaaagtatggagaacatggacggtagccttctgccccatctctgtgctgctgtacctgttgtttaaagagaggaagaggtagaactcatgtaaaaaaatgggtgagggaccaacagtatataggaggatagcaaataatacaatgtagcagttacatttatgttaactgttatggttacataaagagctactctttatggtttcacatacactttttgtttgattctcacaatagcttcatggattagataaggtaaaaattttttccatttaatagatatgaaattatggctaaacaaagattaagttatttgcttaccatcatacaggtagaaagtgtcaagagcctggtttctaattgaggtttctgattcaaatttagtggtgttttccctacatccctgttacagctgctgacatcaggctctagaaagtgtcccttagtgagactttttattgcctcttggatctttgtgggggctggggaggaatgtatggggtgtgtgtgtgtgtgtgtgtgtgtgtgtatctattttggtgtttattgggggttggaataggagaatctttggagataggcagtgacttgatggaaaggtcttggagagagggagcaaaagtagtcctggtcttaaggggagatggggaaggttaatcacctacatataaccataactgcatttattgtgggatatagtagagctgagccttctctagtaccaaatggtttgccttccttccagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacaggtaaaggccttagtatgggttagcccagagggaagcgaacggaggctggaaaataacagctcatgtttatctctcagttttcctgttggagatttagagctttatgattttattatgattctgtaatactgaaggtaggtaggaatttgtggggaaaaacaaaggtgaataaagacgagatggtagaggttagaaatgccttgggttgttgccatatgtgagcctgcgtcccagggagagaaagtggaaaaggacagatcacttgtttggacagccaaaggttttagggcagagtttttctcctatggaggggcctttaccagttgctctccctgtttcagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagaggtaaactgtccagcacagttcctattgtccattagcattcgaataaatgtgtcagcctttttcttgttgcaggagtttttgcaacacccatttgttagggagtcctatttgcatgatgtccgcctgagtggttttgaccctgctgggattgggaatactagtttaagaaaagagctgttgcctgtaacatagctgctctccttgagtgtgtggtcttcgttttattatgaaaattgatgataaaggagataatgggtaaatatgtataagagaccagcatttctaatagtattggtgatagagaaaggacagtgctatggaacaaagctagacaaaaaaatccaatgctgtccttgctcagtattaagttttatagctgatagaattgtaactattaaaaaaaatgattcactgtaaactcgcactagtattttttgaattcttgctggaaaataactgttactgtgggtttgaaattttctaggcagtaactatttttcccccttgggagaatggggataggtgagtttcaggagtccacggatcacattcgagcagtgcaggttgcacctgtgagtgagtgggcagcctgtcctttctctagggtgaagatgtgtataccttaggatgggatgcatgtttttaagcttcgtgtgactcttcatagatgagcgggatagaagtaggcacagcagcagatcagagcgagatggagggtcagagcgtagcagcagaagaaatgaacccgagagcccacgacatcgacctaaaggtagactcactgttttggtggcttgtgaggattcaagtgtataaaaggcagagtgagtgactctcgtcttcagtgagattgctgaggcattgagtcagaattcccgattctaccatgaacatcttgggatagttggttctgagtcaggtgggcacagctctgcacttggggtggatatggttcctgtaaggtgagaggctggtttgctgaatggccagttttccaaatggtaggaaagaatagggagctggaggtagaagaagtgtttattaaaaagaactacttatatccaagaagggtgtgtttgtagagataaagtaaatatcccttaaaatgttgtcataaacacagaatgcaaactggaccattggctaggtgcagtggctcatacctgtaatcccagtactttgggaggctgaggcaggcagattacttgaggtcaggagttcgagaccagcctggccaacatggtgaaaccccatccctactaaaaatacaaaaattagcctggggtggtggtgggtacctataatcccagctattcggtaggctgaggcaggagaatcacttgtacccgggaggcagaggttgcagtgagccaagatcacaccactgtactccagcctgggcgacagagcaagactttgtctcaaaaaaagaaaaaaaggaaaaatacatcctggaccattaaaaattgagatatctttaaaaactgtcaaaaccgatcttaaccgttatagatacatgcaaggtttagaaatagtaaaaggagtaaatttggggaattgacttttggcaactggttctagaccatgtcatggttaagtgagatgtttcctgtggatgtgtcttttgtggcccagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtgatgttctgggcagagcagcccagtttcgctgggtgggcggtaaggagcctcggcagggagagcagatggtggccaggaggacgtggcttagctcagtgacagttttgtgatgctggtgctgctgttcccaggtctgtgaggggcaagtactcggatgacacgcctctgccaactccctcctacaaatataacgagtgggccgatgacagaagacacttggggtccaccccgcgtctgtccaggggccgaggtgaggcctgtggggcagcaggcagaagagcaggcttgcttgccctagcgaggatgagcaggggctgcccttctggagctgcatggccctgcagatctgtctggggccgctggggacaggccagggcatggactgacctgcttcctgtgctcctccaggaagacgtgaggagggcgaagaaggaatttcatttgacacggaggaggagcggcagcagtgggaagatgaccagagggtaaagttttatacctctgaggggctgatcggggctggtggccgtctgtagatgggtgaccctctagcaggactgggctttgatgagggtacacctgagccctgttcagacccaatgccctggagtctctttgcagaggcatagacggcacggtgaaccctgtcactcactgcagtaggctgacctaactgttctgttatgtgttggtgccaccatgtggtaaatctaagaagtgctatcgtgatgggctgccctccagtcctgtgtagttgcccactgtggttctcctccagatggcatgtgtctgcagggaggcctctcctgcacccctcacaagggtagctccactgcagtagtgacttcctaccaagcgtcccttcttctgttggccatgtctcgtgcataaacttgatctgtccctcactcccttgctttgcctcctgccctgcagcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggtgaggctgcctgcagaagttggagcagattcagagctggaggtagagcacgtggggaagcagcaggttatccccaagtgagggcagcacagcttgtcccctgattgccgagaagcccagatcctctggaggtggaagaggagtgggtgatgagccttttagtagcttaaggaaagccccggctcgtacttctctcttttgcagtacttccttgaggggaagtactgttgatgggaacaggtgcattgggacctgcctctgtggtctgtgttctttgtgtctctgatgtgggctagggacacttaccatttgtgtgtccctctagaggttctgatttagatgaaaggtgctgctgcttggaacaaactcctgcaggtgatttgggatcagcacctcttctgtctttggagctgtgggtagaggcctgtgacatctttgcagctaccagtggccttctgtcaggacttgatgtgtggacttacctcataacctttcaggacgacctttggggtggcaatttgagtgtggctcccattgtgtcctcacaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcaggtgaggctcctctgtggccagggacaagacagctcagagagacctgatgtgggccaggtgcagtggctcatgcctgtcatcccggcactttgggaggctgaggagggtggatcattggataccaggagttcaaggcctgcctgggcaatatagtgaaaccctgtctcaaaagtacaaaaattagccgggtgtggtggcaggcacctgtagtttcagctactcgggaggctgaggcaggagagttgcttgaacctgggaggcagaacctgcagtgagcagagatcacaccactgcactccagtctgggcgacagagcaagactctgtctcacacacaaaaaaggcctgatgtggagacagaaagaagagaagggagaaaatagccctgtaccatgagagggtagcagtccctttcacaagtagggatcttatgaacatggccttcttgctgattttaacgggcatcgctctttctccccactgctgcagccggagccggtgattccagtgaaggatgctacttctgacctggccatcattgctcggaaaggcagccagacagtgcggaagcacagggagcagaaggagcgcaagaaggttggtttcttggtttcgtggctgggaagtttatgtgtatttttttcttttttcttctcttcataagtcttactaggcccacagatagaagttaggagtcccctctatcaagtccttaggcccgacagctgcggggcctggtgttgggagagctggaggcttgaggattggaatgtggctcggtgccaccagcactctgggggagtttaccacctgcggggtgaagtctgctctcccgtgggattgattttccattgctcgcagtcatgtggcaggatggagcagactgacctttttccttttcaggctcagcacaaacactgggaactggcggggaccaaactgggagatataatgggcgtcaagaaggaggaagagccagataaagctgtgacggaggatgggaaggtggactacaggtgggcagcctcagccagcagcacatcagccttgctccaaagatgggggcccatgtgggcagttgcggcagaacccatcgactttgtggctcctgagtgggagactcttaggatacctctctgcatcttccattctctctggtcccttcctcctggtctcttcactgtcctccacttttcctatatgtgattcctcctccctcacactgcttcctctggtgctggtgttgtgagaggaaggaggcccagggaggttaagtaacttgtctgaggtcacccagcttgtcagtgagggagttaggatcagacccaggccgtctcacatcagagccactctgctgaagtacctcccaggtgttcagcatgggcagctgggttttagtcccttagatttgagttcactataagaactatttttaaaagaggttccaaaatagaaagggttatcttattggccagtgacttctctgctcatagaggcatctaagcagatgctgagttgggattcctgcattgggcaggtggctggacttatctgtcccttaagatcctcatccttcgaatgcccttatgttctactgaacggtcatctgagttaataattctctccactcctgtgtgaaatgtccatacgagaagttggtactattgatcagcccttattcttctctagttaacttaattcctcaggtattagttattgggtgaccaggagggactgggtgaaattagaaataggaagctcagcagagcatggggcggcacatcagacaggaagtctctggggagggggttggggaggggtgtgtggactgtgtggagcactgaactggtgtctttttgccaggcagccttgagaaagtgacagtgctctgcatctcgggtgtgtacatgtgtcagacattgagagctttcagtagaggttgcaggttactgtttagtggggctgttttcacagttctttgaaaacaaaaccgtacagactatgctttcctgctgtcctgccaagaggagggaggaagtttgacccatgtcccgtgctctgcacccttacctcctcacaaggcctgtgtggctattttagccctttagacgttgtgctgaaattgcccgagggtattttctacaagttagtgacctggggattgatttccactcctcttctgctcactctgttttggttagagggtttgctaatatggtgatctgtaaatcctccgatccatgttcagctagctctgttggaccctgtggtgtcgagtgtgttgtggatgatggattctcaagtagcagtttcagtcctgaggtcgatgagaaccatctcagattccctggctgctttggtgtctcagactcttgccgaagtcctcattcctgagcgtaggaaggagggcagcaacccaatcaggaaggacagcatggggcaccatgcagggtgtttaggctgctgtgtgttcctaggacagagcagaagtttgcagatcacatgaagagaaagagcgaagccagcagtgaatttgcaaagaagaagtccatcctggagcagaggcagtacctgcccatctttgcagtgcagcaggagctgctcactattatcaggtaacttcacccggggcccaggaatctagtgtcaagtcaggggtgcccttggtctcccatgtttacccaggagctctttttcttttgtgcattgcacccagtggagaagggaaatacttttttcctctgacctcatgcctggggtacactgcacaaagtaacgggatggcaccattttgttttagctcacctgtttaaacctcaccgtattccagatgtttcaggtgttatctcagtaagaggctgttgtcccagtgaaattctcccttctaaaccggcatgctccctggatagctagtcatggggataggaggtagcggagtcttcttggaggctgggtgttggccttccacttcggctgataagccctttgcctgcttgtccttgtagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgagtgggcgtgggggctgagccatgtagttattccctagtagcttccacccatttttgctaaagggtgtgatctgctaagactcggaccccagtacggggtgtgctggtggtgagccggtggccagggcatctgagccatctctctgacctccaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtgagggctgtgtggtttggtctctctgcgcatggggtgttgaccagtgcaccaccagtagctagtgggttgctccaggtgggctgagggggtctctggtaggccagaggttcctgaggcctctggttgcagttcagactcgggttgtagttcatgctgttcttgctctgctgagggtggcttggggttttctgggcagtggctccattgcttcagtcttcatgattggtaagaattgaataggcccatttgtcagctttggcttgtgtttcctcgggggtggtgctgatgggactgggggacaggagccaagggtccccaccatgggggcctccgagccgcctcttctctcaggtagtggctcggcgctcagacctgaagctcatcgtcacatcagccacgatggatgcggagaagtttgctgccttttttgggaatgtccccatcttccacatccctggccgtaccttccctgttgacatcctcttcagcaaggtattgaggccaccatgttacgaactgacccttccatgccacgcacttctctgatgcgaagccggctggagggtggagggtgggtaggggactgggttggagaagatttcctggggaccatggggcaaatggggcagcctgcagctctgggactcggggacaaaggactctgctctgggtgaggttttgtttcattatttctttgaggctgaagtacagggcccagggaggcactgtgccctcttgtagaggcctcgcagtcaggcccatgtggaggtgtggtggccctcaaagtccatggctccattccagagcagtgcctgggccactgggctcccaggagatgcccggcctgcgcttctagtacctccctctgactgtgtccccactgctgttgcagaccccacaggaggattacgtggaggctgcagtgaagcagtccttgcaggtgcacctgtcgggggcccctggagacatccttatcttcatgcctggccaagaggacattgaggtgcgtgccttggtcacgactgtgatgagcgggtgtgtcttgcatatgagaggttagggttccagtgtctcacagctcctccctgggctctcaggtgacctcagaccagattgtggagcatctggaggaactggagaacgcgcctgccctggctgtgctgcccatctactctcagctgccttctgacctccaggccaaaatcttccagaaggtgtgtcagcaggaatgtccaggagtggctcttggagttctctaaaggaagcgagaggggatgtgactgtcctggcagggggtgggctaggaggtaggcttttccccctcgcggagcctttcctgtctcgagggactcatttttcccttcctgtatgtcctgctctaggctccagatggcgttcggaagtgcatcgttgccaccaatattgccgagacgtctctcactgttgacggcatcatgtttgttatcgattctggttattgcaaattaaaggtaagagaagacatgggaggcaaggcctgggtgttcaccagaagctaacttagctgcggggtgggaagccagggcctcgctcctggccctgggatgtggggagcgcgtggaagtggtggtggtggtgggaggctcacattgactcactgtgcttggtttgtttaacccttgtaatactcgatgaggtagataatttaacagtagagctcagagagctggtgtttgtggggaagacttcttcaggtgttcatgagaacatttctagagcctcctggctcttcctctgccatgtgtagcaaccagggcttgcctttgtctcaggcctacttccactttcccctcactctgtccttcgtcagctctttgccgtcccctcctaggtcttcaaccccaggattggcatggatgctctgcagatctatcccattagccaggccaatgccaaccagcggtcagggcgagccggcaggacgggcccaggtcagtgtttcaggtaggagccctgtgctagcctgctttctggggcagcgctggggttgctgagcgtggagcccgggcgggggcgggcaggatgctggctctagagctggtccccaaggctggaagctgctggcagggctgccacttgttagtcctttcatcctatgctactgagtggaaggaaggagtggctttccagggatttcagaggtctgaggccaacctacgtggatgtaggtacacatgcaggtaattacagcctgcctcccttcagagggtaggtctggacagatgatgccattggttctttttatttctattgttctctttccccattttctttctttcttttttccaattagagacagggtcttgctctgtcaccccaggctggagtgtggtggtgcaatcacagctcactgcagccttgatctcctgcactcaagtgaacctcccacctcagactcccaaggggctgagattgcaggcaggcaccaccacacctggctaatttgttcatattttgtagagatggggtcttgctatgttgcccaggctggtattgtgaactcctggcttcaagcgattcttctgtcttggcctcccaaactgttggcattataggtgtgagccactctgcctggctctcttccccttttttgttccaattaaaaaaattaatgtattcactatagagcgttagtgaatatagaaaaatatcaagaaaataaaacccagccatgattctagtcccaggcccattggttctagaaatgaaacagatggctgggtgtggtggctcatgcctgtaatcctggcactttgggaggccgaggcgggccgatcacaaggtcaggagtttgagaccaccatggccaatatggtgaaaccccatctctactaaaaatacaaaaatcagctgggcgtggtggcggatgcctgtagtcccagctactcgggaggctgaggcaggagaatcgcttaaatccgggaggcagaggttgggcaacagagtgagactctgtctaaaaaaaaaagaaatgaaacatgtaagaggctccagaagaagggctaaattggcagattggagttttgaataggtggaagtcagtgattcactgaagtagtgggtggggagaagaaatgagaatttcctccctccctgtgggatttcatctgtactggctgctgtggggtttccttgtggtgagaagatggggtcttctccccggcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtgaggcggccccgggagcctcatgggtgctggcgcttgacttccttctttcctctactgtcccgtcaaatatccgggtttgctcatctctcctaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaaggtggggcagcggctggctcccctctccccggagggctcgaggaagtgttggggaggggaatggcttctctctgtattactgaaatggaacagagggcagaatcagagtttctgaagaatgattttgctgttctcggttaagcaggttggggtaggggaaaggaagggctgggccagtggttctcagggaatgctttggaaatttgcaagagcattttttatcttctagtatggttgctcttgagccctcatgttttagagtagacctttttaaaaattattttaatttttctcaaattgtcagggcaacctattgacatgtttgaagttctatgtgtgggtaggtggtagtgttagaacctctgggatgtgctcagtgggcctggacccccctgtacttagagtgaaggttctttttcccttcctagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtagagtggtggatgagcaggatgttgggatgaggggagggtcgagaggaaaggagggctccctcctggtgcctccgtctcctgccctaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaaggtgaacccaggagcccagtgagcccctcccagcctgatacctgtataagggcaaagttcttcctttgtcctggtgtggttctgcagatctgggcttccgccaaaggctgtgtcaagagtgttaagggatggggtcgctgcccaaatgggtgttgttttcctgatgtggctgcctgttgtgtctcctccctagggaatcggggagtacgtgaacatccgcacagggatgccctgccacttgcaccccaccagctccctttttggaatgggctacaccccagattacatagtgtatcacgagttggtcatgaccaccaaggtgagtcttttccaaggcacttgcataatgcaggccccctgtctggccaggctttgaaacccttcactgcgttctggcatgagcttttagcctgggagccttgaggccacatgcattgttttgcggggcatgtgaggttggttttcatttggggacttggggaagctctgcacagggttgacctctagactgcattgacctcagctgcatgggcacgattgttccccacttgctgcttgggatgagcaacccctcttggtgtcattagaaggattttcggaggggttgggccttttcttttagatactgggggcattttctcaagtgtggaggagtttggatgggagtatctggggtttttcctttccttttttcagccttgcagggccagggattgggcccttcccatgtggctcctaattgtggaaccactctgggagggacattggccctcctgtgaccctcgcctccctgcccttctgcccgcaggagtatatgcagtgtgtgaccgctgtggacggggagtggctggcggagctgggccccatgttctatagcgtgaaacaggcgggcaagtcacggcaggtgaggattctgtgctcttcgcaggggtgctgtttgcctgtggggtcggtgttccctccgcttggtattgaagacttgcggtcatccaacccacttacttctctctgcaaacataaaggctgtgatccagcaggctgggtctgtctgattccccaccacccactccagttgtttggtaggctgagcctttaaaaacaaaaccaaaaaactcattattgaaaagtccaaatattcatgaaagtgggaaaaacagtacaacaggccaccatgaattcgttgccttgcctctataattgtcaacgtttgttcaatttcactattcctaccccactccacacacatccattttttttttctggaatattttaaagcttatctcatacattattcatccataaatacttgagtatgtgtctctgactaaaaggacttaaaattttaaatataacctctgtgccgttatcactcataaaaaaatgaatacttaatgtcacctaagtctccagtccgcatttggatttctccatttatctcaaagataacttcttatgatcgatttgcttgaattaggatccaggcattgcaactgcttatgtgtgttaactgtttcattctagaacaggctccaccccacgctttttttcatgacattgatttattggagcagccaggtcatttgtcctgtcgaatagtccatatgatgtatttgcctcattgcttgctcacagcggtgtttaacctgtgcctgtgtttcgtgcacttgctgtaagctggcgatgagtccaaccgctcaattagatcccggctgagctgcgtgtggcagagatgcctgcatgtggcactgtgaacctcctcttagatgccttcaggaggcatgtgaggtctggtggccccacctttgctgatgggaggatggatgaggggccccagtggtggcagcctgcctcttccctgataggtttccactgctcctccatcttgaggttttagcgtctgttgatggccattgcctagatccatatttagggttgcaaaatggtgctgggctttggcttaccccttttcgtagcataattctccccataccaggctcccttgcatcttatgcctgtctcttccagccagcaggtaatcacatcttccctgtttttctgtacttcctagcatagttgtgaacttgatttttcaaaaaagaaggaaatgtaagtacttcctggactgagggatgactgagttaggactgattgtccagtgtcttgagtcagtgaaaaaagcaggcctcagctgcagaagagaaggcggctttggtactggggcaggcagccatgtggagcactggcctggtggatgcagcacctggtttgtggcagggacttgggtgccgacgaggcctccttccttagtggtccccagtaggctcagccaggtctgtccctcttcaataggagaaccgtcgtcgggccaaagaggaagcctctgccatggaggaggagatggcgctggccgaggagcagctgcgagcccggcggcaggagcaggagaagcgcagccccctgggcagtgtcaggtgagctccggccttcgggctctggctggggtggcacccatcccaggaggctgccagagaccaggccctgatgcagggtcaggatttatgggaaggtgcatgtgtgaaggcaaactggtgacagaagttgcttgtgcatttggtggtcacatggatgtgtgggaggagttcctgacagctttaaaggagcgacagtacacctgcagggattcagggcctgaggcagcctggagtagcaggatgggtttcacagctttactcatgagcgagggggttggaaaccccagtgcagtggtgagaagtgcgccttgggcttctgcgtctgtgctggtccctggagttaggccagacttgacaggtcgcaggcacaggcctccgtgagaacgccctcacttcagataccagctgcaggtgtagacaccatccttactggtgtccccatggacccctgcaggttcagtatttgctagaatgactttcagaactccggagagtgccgtacttaccattatagctttattataccaaaaaggtacaaattagaaccagccaaaaggagagatgcatagagcaaggtctgggagggtctcaaatgcgaagcctcgtttgtcctcaggaccacgtccccccgtggcacactgatgcatgacagtatgacaggttattgctagccaggaagctcacctgaacttcagtgtccagagttcttatcattggggttctgttacttaggcatgaatgactgaatcattgtcatgtggtagagctcagcctccagtcccccctcctccccagaggtgaggctgatagcacgtggctcagagcaccagtgctaaccccggggcagagaggccagcctgccttgagtcatgttgttagataaactcaaggggttcaccaagagtcacctcattagcataatctctcaaacgagggctgaggggcccccatgaatagcagacactccagtcacttgggaaattccaagggtttagagttggctcctaggcactggggacaaaggcaggctgctacacagttggagtggcgcacgtgaggtggagggaagctgcttttgtagctcccctagggactgtgggaggagttgttaaaatccgatctaaagcatatcggaatgagtgagcttccttgattacatcgccagtcgaacatggggacggcagaggagtgagaatgtgccggggaggagatccctcggcccagagctccccaccatgggttaggaacagtaagtcctggggctctgcatcctcctgccctcctggctgtgggtgagggcacggtgtttcctgatctctcctgctgtgtctccaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatgactgcatgtctgactttttccttcaccctcttaaatcatgtaataaaggtggggggtgcagaagcctgccctgacttcctttgcatgggtcgtcctggaactctgcccttatttctgcacaaggcagaccaagctctgagggtgcccagctgctcctgaggctggggggcactggcaggtctgccttgatggccaggtcatgggagggaagtgcgcaggagtccaccccagccttccctggggtggtttggctgcttgaaagaggtccatgtgattgctctggatggcagagggtaagggttgtccattgactgaaaaacagtgtaaaatgttgcttattgattttcacgtaaaaggtgacccttacaccagaatcaccagtcttttctctttttaagcagtctcttaagtctgctgaggtggctttttgggtgtttggccctttccactaaccatggtgtatatgttgtgattcctccaggctgggcttctgccaggtgtgctggttggcaggttctgtgttggggttgagtcacagacaggattggggctcggaagcaccttgataccaggccagtgccggcgtgagccctgtggtgcgtggcctgctgtgctgttctgatccctttctccctctgttcctgggatttgcctttccatgttttataactcaataaatgttaaaatgtaagtcaattttgtgggtgagctcagaagcctagctttgccagccagcaccagctaccacctctgcctccattcttccctctagcccccttgggggaatgcaggtggaaatgggcttctcagggctctgtagtgaagagagggctgccagcactttgcctaggaagcattctaatcttggccctaggttggaggactagaagttggctgatgtgtgacctatttacagaatcaggcaatggagtaggaaaaagattgaggttctacttaacagttattattaataagctgtgaccttggtcacaaactcactaagtcccttagataaaaaaataaggtcagagaggctattaaaacaatgggtccaactcaaccatcgtatttacaagcaaggaacacctggtaaaggatacttggtacatgtgggtgctacaagaggaatggaggggtcccctgcccacagcagctccccctgaatttgccacggtactggagcttctgctcaaggctctgtctcttcctgtgtttccagtgtttttttaaattacagatcctttccattccgatcttccttaaagttccttcgagctttaatattctgattctcactgtcttttcttcagatggcaactgattgtttttctagaggtacaaaagcatacctatgacatggtctctagcaccatggccccgttgtggactcctgagtctggctgacccttgttattgtctgtatttttttagtgtaaccatcctaatggctggtatctcattgcagttttgatttgcatttccctagtatttagtggtgttgagcatcttttcatgtgcttattattggtcatttgtttatcttctttggagaaatgtctcaagtcctcttcccccccgcttttttttttttgcattagtaactttttaaaaatttttaaatttcaacttttattttagatactgagggtacatgtgcaggttcattatatgggtatactgtgtgatgtggtaggtttggggtatggatcccatcaccgaggtagtaagcatagtacccaacaggtatgttttcaacccatttccctctctctattcctcccaaccaagtagtccacagtgtttattgttcctatatttatgtccctgtgtgctcaatgtttagctcccacttataagtgagaagaagtagtatttgattttctgttcctgcaagaattagcttaggattatggcctccagctgcatccatgttgttgcaagggacatgatttcattcttttctatagctgtgtagtaccccatggtgtgtatgtacatttcctttatccagtccaccattgctgggcacctaggttgattccatgtctttgctattgtgaatagtgcagcgatgaacatgcgagtgcatgtgtctttttggtagaatgatttattttcctttgggtatacgcccactcatgggattgctgggtcaaatggtaggtcgattttaagttctttgagaaaccttcaaacctttgttcacagtggctggactaatttacattctcaccagcagtatataagtgtcgccttttctcaccagccttgccggcatctgttattttttgactttttagtaataaccattctgactggtgtgagatagtatttcattgtggttttgatttgcatttctctggtgattagtgatcatgagcattttttcatatgtttgttggctgcttgtatgtcttcttttgagaagtgtctgttcatgtcctttgcccatttttttaatggggttatttgttttttgcttgatttgtttaagttccttatagattctagatattaggcctttgtcagctgtgtagtttgtgactgttttctcccactctgtaggttgtttattctgctgatagtttcttttgctgtgtagaagcgctttagtttattaggtccctcctagcaatttttgttttcgttgcaattgtttttgctgacttagccaaaaattcttggccaaagccgatgttgagaacgatttctttttttttttttttttgagacagagtcttgctctgttgccaggctggagtgcagtggtttgatcttggctcactgcaacctccgcctcctgggtttaagcgattctcctgcctcagcctcccaagtagctgggactacagatgtgtgtcaccacgcccagctaatttttgtatttttagtagagacggggtttcactatgttggccaggatggtctcgatctgttgactttgtgatccacttgccttggcctcccaaagtgctgggattacaggtgtgagccaccacacctggcctgataatgatttctttctttctttcttttttttttttttgagtagtactctcactctgttgccaggctggagtgcagtggtgcgatctcggctcaatgcaagctccgcttcccgggttcatgccattctcctgcctcagcctccctagtagctgggactacaggcgcccaccaccatgcccagctaattttttttcttttttttagtagagacggggtttcaccgtgttagccaggatggtcttgatctcctgtcctcgtgatccacccgcctcggcttcccaaagtgctgggattacaggcgataacaatttctatagtctgaggtctgacatttaaatctttaatccatctggagttaatttttatatatggtgaaagataggggtccagtttcattctttggcatatgctctgcccatttttgaactgggttgtttgttttcttgagttttaggagttctctatatattctggatattaacatcagagatatgatttggaaatattttctcctattctgtgggttgcctttttactctgttgatgttgcttttgatgcacaaaagtttaaaagtttcaggatgtctaatttgtctattatttcttttcgtgcctgtgcctttggtgaactaatcactgccaaatccagtgccatgaagggtttgttccatgttttcttctatgagttttatagtttcagtggctacatttaggtctttgatccattttgagttaatttttgtataaggtattaggtaagggcacagctttattcttttgcatgcaaatattcagttttcccagcaccatttgttggaaaactaaaacaaaaactatcctttccccatttcatagtcttggcatcgttgtcaaaattatttgaccatatatgtgagggtttatttctgggattctttctagtctattccattggtttgtatgtctgtcttttgatttatatggcagtaccacactattttgattactgtaggtttgtagtaagttttgaagtcagtaagttcttcagctttgttcttcttttttgagactgttttggctgttgggatcccttaagattccatgtgagttttaggttgagttttcctatttctgcaaaaaaaaaaaaaaaaaaaattgggattttgacagagattacattgaatctgtagatcactttgtgtatactgacatcttaatattaagtctttcaatccatgaacatgggatgtgtttctgtttatgtcttctttaatttctctcagtaatgttttatagttttcattgtacaagtcttttactgccttggttaattcccaggtatttgtttattttttttgctattataaatgaaatgaaattatttttataatttccttttcagattattaattgttgttatataaacctgcaactcatttttgtgtgttgactttgtatcctgttactttgctgaattcactattagttctaccaggctcttttttggggtggggtggtctgtagagtctttagggttttttacatataagatctgtgaacagagataattttacttcttcctttccagtttgaatcccttttatttctttttcctaattgctctgcctagagctgccagtacgatgctgaatagaagtggcaaagcaggtgttcttgccttattcctgatcttagaggaaaagcttttagtctttcaccattgagtataatgtttgttctgggtttttcatatgtggttttattttgctgaggtagtttccttctaatcctcatttgttgaatgctttttaaaaaattcataaaagagtgttgttgtaaccatttctttttaatatcagctgttcgaactactttttaggagctcaattccttggttatttcttaacaaattataggcaggcaacactcagtttccctgcccttcctcctgtctttagagaaactgcacttctctaagtccatcccctgtactcagccaggtcttctgcctagctgggctgtcacagtcggatggctgggtaatatgtcgatgtttttctggctctgctaccaattagctctccataactgactacctgctttgctctggtgtaatcactccacaggaagtgaaagataactttggaaagatgtacaacattcaaagaaaccagagattgtcattttggccaacgtatatgaaatattttggtaaattatagagataaaatccctttttagtagactaggctggggattttaatggcattgaactttagtttgaataaagcaagccacaggctagatgagtactagatttttcaatctttgttttctctagaaaacaaacccatattctaaaccacatgggggaacgtagttcaaagagcttaaacagacaacaactatcataacagaaactaccagagatgcctgtcactcctagctcacactgcatttctggaactgcccttcccaagttctgtcaggggcatcctatgtaatatgttagtgttcctattagcagtgaattttcttggcctttattaggcccaggaagaatattgaagaatcattgctaaccagtgggtttcttccttcacttttactgcccccctcagaagtgtaagatctttcatttctttcccttatattaatattaccctagtagtgagttgtctccacttcctatagactagaaatataaattctagacatgtactcagtttaacaaaatcctaccagaataaaatattagctgtccttagagtttgtcataatggaatttcacttgtattgaggtggctggggaggaaaataaaattgttagaaggaggaatggaatgtggagcccggtggtgggcgggggggcaggtggcgtgctcttgctcccccacttggaaaatacagcccttattgctcttcctttctttggggtctcaggattacttcctctttggagtttttagactttctctttttaagtttcagatagtaatggaaagaaaaaaaaaggagctacttatcacttttgttggtttaaaaacgaatccagaagcttgcattgggtattatggcttccctgtatatggaagagaccaatatctcttagaattcagagaaaacaggatgaacatgttgctgggggattgcggggcagaaatgtctgctagacgccaacagctcaccacaactgctgtgctcatgctcatgtctttatttcagagtttgggcctggagatggtagtatggttctaaagctcactccatggcaggaagtggacaaaactcaacaaaagttagtgtcttgcaaaataggctgggaccgtgatatactcctgtaagagctgatccaggtcaagagagagggagggctgggaactcactgtcctctgaagaaacacccgtggaaatgctgctcagggctagatgtggattctagcagtatgaggaacctgagggaacagggaggaaatgagagttttgattcgaggagaaattaacgaggtgattcctcaagggctggccgcatggccaggcagctctgctgcagggtgacttcttgcctctggggtaacatggagtttacaggtggcaggaaaggcggctgtggacccaggctgggtaggtggctggggtgctcttacggggtttccagacgtagaaggaagatgcctcttctacctgttccctaaaatgggtctgggtcaggggagggggcaggtctgagatgtgaggcacttgggtatgcttcagatgttcttagatcagaaggggtcttaatttgcctcctccctttacagatgtgaaaacaacgatctttggtccaaagtcgctaagaaaatgacttgaggccacaaaaggcctattttcttcttcctacttgaattctcaatccagtgatttaaagaaaaaaatcacacttatttttttgacaaatggcagacgtacccgggcagtggggcatcccgatgtacttggtgaggtccattctttgacccatatcctggggcaaccccttccagcccaaggtgccgcacactttctccctctgtgtggactccgttctgctcgggcctagggctttggtgcatagccttgtgttctcggctttcatcttcttctcttctatctccttcttcagcttcttgttttcctgctgcaagtggaccattacactgtggaggtggctgtgggaaggagaggaaggacgggttgtgttggggctgctggctctggttggttccctgctagaaaggacagataaaggtgtcacagggaagacagcacagatgcccaggtctgttcagagccggcctgttacacatgctctgtagaaatggaagcctacgtgtgtcctgtgaaagaagcccaggcctggggtctgagtggaccaggagctggtactcctgcccaactctgccagctctgggcctgttttcttatctgtcagacggggacagtcaggcctggcctgactgatgggattcatacgaggatctggtttgataaatgatagaaatttgacttgaagagccagaaggctggtagggacaactgtgatcatgtgtcctcgggttctcatggccgtgccttggaaacactctcacccagcaccaatgccaaagcccgcattctctccgctcccctttgctgaagagtcgggagcacaggagatcccagctctgtcaagaacttgggtgagttactcatccccattttacagattaggaaatggaggctgccacgtagaggagaggaaagataatttagcgcattccccgtggctcaataaatagcaacttttattatcactgttgtgtgtctccaaactaatgttgagggcagtgggtgaaggtgggctctgaaaccagacttcccacgttggaattgtgactctgccacttattagttttgagaccaggggcaagttacttagtttcccaggtcctctctttcctcatccataaatggggatcatgactatactgaacacaggaggtcttatgaagatgaaatgagctcatatgtgtcaacgcttagtacctcacacacagcaaataatatgtattagttgagctactatcatcattaaaagttggttttctttcaaataagaacaggagaactcaagagtgagttctttgtgaaagagaacttcctggacttggcacaatagaagaaaaagactgaagttatctgttaccttgagaatctgacaacttttcttttacttacaccctagtaaaaagtttcgtggtcttttctagaggaaatcaagtagagaattcatcctcaacctcttctgtgggcatatgctctacccttttgctctctacaaagctggccaaccttgaggtcgcctcttcccccgcccagtagcccctcactcccagtgctggtgggtctggagagggggtctcagcagtgccctcctttcccggctctctggctccctcctgtcagcatccccaaagccttcaatatcccatacagctcatccacatcctgacttctcaattcattggcctccttattccaaaggtctcatccttctcttcaactcagccatgtacctaaggccaaagcctagaatagggctttccacctggggtgccacgaatggattccaggtgtttggagatgcctgcctgcccttgggggcaggctctgaggcagccactgcttggtcagctttgtcacaagtatgccaaacaaatgtggttactttcatcgttttttagagacagggtctcattctgtcacccaggccagagtgcagtggtgtgaacataggtcactgtagcctcaacctcttgggctcaagcaatcctcccaccccagcctcccaattagctgggactgtacgtgtgcaccaccatgcctggttaggctcatttttaaattttttatacagacagggccttgctgtcgtccaggctagtcttaaactcctgggctcaagtgatcctaaactgtggtcattttctttttcacttttattttattttcacttttagtttagattcaggggtacatgttacatcggtaaactcatgtcacaggattttgttgtacattttatttcatcacccaggaattaagcccagtacccaatagttatcttgtttgctcctctccctcctcccaccctccaccctctgacagaccccattgtctgttgtttccttctttgtgttcctaagttctcatcatttagctcccacttacaagtgagaacatgtggtacttggttttctattcctgtgtcagtttgctaaggataatagcctctagctccatccatattcccacaaagaaatgatctcattctttttgatagctgcatagtatccatggtgttacgtaaggcatggttgttttctaagtgttccctaagaaaaggttgggaagcgctgtcctaaggcttgttgttacttgttactttgccacctccaaaatctcagttttaggccttcataccttcacctccattctcaaactggtaacactcctcgcatacctccctcttagtggacccagctttgaccatgaggggaagcaagaccacaggcccccagatgagcaggtggaacagaagggctcctccaacctggcctgctcacctgatgatttcatgaagagatgttccttgtttgttccttcacttgggatctgttagagcatctcagcccctgccctaaataatccagtctgcctttcagtgcctgttccctgcttagcacccttgacctctgagaaccatgagagcaggaaggagcaaaaagactactaaactccctttggatttttggtgagagaactaaggccctgagaggtcaagtgatatacccaaggtcacatagatgcagattcgagacctgggggtctttccaaagcaccaggcctttcctgggctgatccccctatcaagggctaaagccagccctggctccctgctgacccttcttgtcagctcccaggaagcagccagggtggtttaagatgactta

SEQ ID NO: 425 - DNA, 63348 bp, Homo sapiens
gcagccaaaaaacatgaaaaaatgctcaccatcactggccatcagagaaatgctaatcaaaaccacaatgagataccatctcataccagttagaatggcaatcattaaaaagtcaggaaacaacaagtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaaggattataaatcatgctgctataaagacacatgcacacgtatgtttatcgcggctctattcacaatagcaaagacttggaaccaacccaaatgtccaacaatgatagactggattaagaaaatgtggcgcatatacaccatggaatactatgcagccataaaaaatgatgagttcatgtcctttgtagggacatggatgaaattggaaatgatcattctcagtaaactatcgcaagaacaaaaaaccaaacaccgcatattctcactcataggtgggaactgaacaatgagaacacgtggacacaggaaggggaacctcacactctggggactgctgtggggtggggggaggggggactaatagcattaggagatatacctaatgctaaatgacgagttaatgggtgcagcaccccagcatggcacatgtatacacatgtaactaacctgcacattgtgcacatgtaccctgaaacttaaagtataataataaaaaacaaaacaaaacaaaacaagggaagtggtgtcctctctgagcgttttctttggaaaacttgtcattgtaaatcttcctctgcccctttgaggggcatgcaatgctttttgacaactaaataagcctcttgccagctttgcaacccaggactgtgttcctgaaggacctgggagcccgtctttgaaacgtcatcatcagagcagccagggccctatctgccagtctctgtgggatggtgggggcctaacatctgctgtgagtagtaaatctacctcctgtcacgaaggtaagagtttattttcctttgtaacaaggtaattagcaaacgcaggtggtcaggtaaattgaggttgaatctccaataaatgggtgtggccaaaggtgctgggaagtccactgatctgaggactaggcattactcttcttgagaatgcgtgcagtgaacaatgggttggacccactggctagataagcgtgagatttctgtctttgcagcatcttagcggatcattgtctgtgatgcacatctcactctgagttaatgcctcttcaatgatgaaagtgttttcttcctcttctacctctgcagagaggcttgctgggatagattttgtttgtaattctatttccccaccgccagaggccggactttgggggtcaggcagctgagaaggagtttagaacccatgcctaggccttccacactctacaggcacccagttcatccatcagtagcagaacttagagtcttcctgggactccatactgcctggagagaggaattcgttctctttcattgctgacattcctgggtgaatgcctgtggcagttatactttacccatcccattttgtacctccttccactccaggggaccccaaggggcctggctccacttgcccagtgcacctccgaagaagggagactgggaaatgaggatcctgccagggggccaggtgttggacaaggtgcatgtgaatgtggaggaggaagacggagccctcccaagaacctgacagggtcagggatgaggtgagagtgctcagaagagtgctgaggcaggacccaggctggggccacggacctgcctcagcagctggggtctgacctcttggggttgtgttctgactccccttcccccatggctctttgccctctggaagccaaggggcaatggcaggttcacagtggcactgcaagggtacagttgttgggggttcttgggagcaggggcaccagttctgctgtggccctggttgcctccccttgcccaggctccatgtgcaccctcagagtccccctggcacaacctttcttcttctcacgaggaacacccccacttccacttgggcctctgccaggaagaagggtgggagctctgccgaggtgtccctctgagtgaccaccctcagctggagccgccaggcctctgcacagtagctgcccctgggccttgtgtgtaaaatgggggtaataacagtatctacctcataaggttgctgcaagaactaaatgagttcctagaagtgaaagacacttagaaccaggatccagaggcttgcgaagggtgagctggagtagccatggtaagtatggagagggaggtgaactgaggatataaaatcaccaaggcaaaaaatttaaaaacagaaacaataaccagctgggctcagtggctcatgcctgtaattccagcgctttgggaggcgcagcagaagcatcacttgagtccaggattttgagaccaatctgggcaacatagtgagaccacatctctacaaaaaaaaaaaaaaaaatcactaaggcaagaacctagtacactgtaggcattccataagtgtttgcaatttttattctaattatataaaaataaaatatatttgaatagaaacagaactctagaaggcaataacaagtaatagtaactgattatcttttaaaatacaacgaggtaggactacaagtggtttttttgttttttttttttttggtttttttttttgagacggagtctcgctcagctgcccaggctggagtgctatggcacgatctcagctcactgcaacctgtgcctcccaggttcatgcgattctcctgtctcagcctcccgaatagctgggattacaggcacctgccatcatgcccagctaatttttgtattttagtagagatggggtttcaccatgttagccaggctggtcttgaactcctgacctcaggtgatccacctgccttggcctcccaaattgctgggatttcaggcgtgagccaccgtgcctggccttttttttttttttttaataccattctgtgatttaaacttttctataatgcacaattagttttatagtcaggaaaggaaaatcaatgttttctttaatgctgagaatttttgttaatatttctgacatttcataaaacatcttttgttgacattctacaaatgatagcatccaataatgtcccaatactttcttcttgtgaagagagtttatatatctgtaaaaatgaaagacaaattatgacttgctgatatcgtcattcactactaattgtcattatacaaacatgtgtaagtgaaattattcctcattcaattattgggttcatggtataacaaacaacaaatgtgattaaaatattcaaagtagagggcaattcattacttgtatcccctttaaattgctgctatgggagtaactctcaagaacataaaaaccaaatttctatccattttaaaagcatactaaatttattttacattttaaatatactatgtaagtttgatatttaaaggtattctctttcttaatgtggagaatggttatgtcagctgagtttgtaattatattttacataaaccatcacacctcccagttctttgtatctgtaatttttaagtaatttttaaaattagattaactttctcaaaagttcaaaaaacaaggagctctggtgatcaataggcaaacggcatcagcattattgctcatctatcacactctttctaaaaatatggactggcaaacctttttgacttctgtaatattcattatttcaggaagatttttcagagaaacctgatgaccttctacttgagatattaggtattcttgatttatttgtttttctccctcttcaatgtaaacaattagaattgaagtgtcatttgctgagataccaaattttttcaaagcctctgaaatctaagagaaaaaaaatgaaaaaaaaaacacaagatcattaaccattgtttcctacgtctgaaacatttcctgatctgccttcttccttggtcaggctcttatttttcatgtcctaacagttctcactgcctactttttcactttaatgattcctttccaacatccattggcacttcctcaaaagcactccctgcttaaaggtacgccttgttcctatggaatcaagcccagcctcttggcgctgcacaaaaacacctcctccctctggtgccaagtggccctccagccaggcgcttctgccttctggccagtccagcctgcctggggatccagtcacatttcatgcccttctgcctgtgctcaagctttgtcctctgctcgcatgtcccttctcctcatggcttggctgctgaacacatgcttcagggtccacagttctgatgccactccccaccacaccctcctccctccaaaatgaatggcttcattgctgtacccctagatttgaattcattttcccattatatcatttatcttagggcattttaacttgtcttgtttatctgcctctcctcaggaacatatttgcctcttctgcccctagaactgtaaatggaacggggaaaaagttcaacagatgtttactgaattcaagagttttctgaattatgtctaatgatctcaaggaaaccataattagtaaattttattccaggtactgggaatctctattaccatgctgagataactgcattttataaacttgtcaatcatctgtattttaacctatgctacaggtttcctgtagatgacattagtacctggttgttattaacagcagcagtaatactaaaacttcatcagcaaaattgcagtcatttttttcatgtgctacatgtgtgatgtctttagcttgataactttcattgaaaaagcattactataagtatttcaaaccacaaactctacctatgtactgggtgtgtgagtgaggctgtgttaaggactgttataggtacaagcaagttcctggtatatgaaaaagacatggatcccaccctcaaggagtttacgggaagagagaatgatatgcaggctagcacacaaaatatccacgcctaatgttttatcatttagatttctgtcagcttctcaagcaaaaatacttgaggggtcttcctgaccctatatggtaagaacagataaaattaacctcgcttaatttagctaaatttttgtttactcatatgtaaactgtcttagtaagaggcagggttaaacctcaactctctgtccagagctctcttcactattatttgggtttattactaaccactggcttgcaggaatttagcctccaacccaacactgaggaacacatatgttattatgacacggtcaacagaaataggaaagtgcacattacattgttatttggggaaaggttgaaaataatttcagtagatagagttcttgtcttcatttttcccagtttgtagaggtgaactgctttgtttgctgccacaagtatctgaaatggatcaacaatctaccaaagcaaggaaaaagaattaattacacatggagaatctgcagtgcctgaaaacacatggtaactcatggttaactccagtgtcaagctgttttacttcatcacaattcttacggtctgtattttcaaaactattatcccggctgggcacggtggctcacacctgtaatcctagcactttgggaggccaaggtgggtagatcacctgacgtcagggttcaagaccagcctggccaacacggcgaaaccctctctactaaaaatacaaaaattagtcaggcgtggtggcacgcacctgtaatcccagcaactcaggaggctgaggcaggacaattgcttgaacccgggaggcagaggttgccgtgagccaagatcgcgccattgcactccagcctgggcaacaagagtgaaactgtctcaaaaaaaaaaaaaacaaaaaacaactattatcccaagggcctgggtagtcaggaaatcacagaattttaaagctgcaaggaacttatgcaaatagtaaaatttttttaaataacattaattgagggctaatattatgggcatgatcatattgcaaacattttacttgtaatattttctttaatcctcaaaactaccctatgaaattgacactattattagtagtagtagcagtagtagtagtatgtaattgatgaggaaattgaggcaaagaatgtctgggtttgaatcccatctctgtcacctatcacctaggaaacttatgcaagttcattagcattttatttgttagagaccgatgaaacagtattcactccataggctgttgtgaagattaagcaagttagtatacgtaaagcacttggaacaatgctaggaatgcagtaagcactatataaaggttggttatgtcttgttcaaaggcctaagtagtaggtctgggattaattcccggtaacatgatcgcactgcgtgtgccctgtttttttgtttttttttttttttggagacagacagagtctctcgctccattgcccaggctggaatgcagtggctcaatctcaattcactgtaacctccgcctcccaggttcaaatgattcttgtgcctcagcctcccgagtagctgggactaccagcacacaccaccacacccagctactttttgtatttttagtagagacacggtttcactatgtaggccaggctggtctcaaactccgggcctcaagcaatccacccaccttggcctctgtgtgtactcttaaccactacactattcctcctctacagactgtcttgttaggaacccccattttaaagatgagaagctggagatccaggcatttcccatattagacccagaccacaacctttcctatttcctagggcaggacctggcacttctgcctctattcactgttatagtcaaagttggctgcatctgacttggacaagaattttttccctaaccgtgacagatttttaggctaccctataacatcacaaatattaatgtatacttaaatgccctgtatggctcattcattctttttttttttttttttttttgaggcggattcttggtctgttgcccaggctggagtgcagtggcacaatctcggctcactgcaacctctgcctcccaggctcaagcgattctcctgcctcagtctcctgagtacaggtgcccaccaccatgctcagctaatttttgtatttttagtagagacagggtttcaccatattggccaggctggtctcaaactcctgacctcatgatctgcctgcctcggcctcccaaagggctgggattacaggcgtgagctaccatgcctggccattttttttttccagacagagttttgctcgtcgcccaggctggagtgcaatggcgcaatcttggctcactgcaacctctgcctccagggttcaaatgattttcctgcctcagcctcccgagtagctgggattataggcgcccgccaccacgcccagctaatttttgtatttttagttgagacagggtttcaccatgttggccaggctggtcttcaactcctgacctcagatgatccacccgcctcggcctcctaaagtgctggcattacaggcgtgagccaccgcacccagcaggctcattcattcttaaaatttatatttaccactgtaggatttatcagtgatccatcgatggtgccttccatggcctttcttctcaagtctcccgcattttttacatctttaaataacagaagggttaccctgcattcgggaaataggtccagctgatgtgttaactgcatttcacagataagcaggattctactgcacacaaaatgaaaagaccaaaagatttcatttaaaagttaacatcagaactcatttcttaataaatattcaaaaactttgaaagtaacttgataaaagtgttaaactagaaaaatccatcgccaaagcccatttggcatcctcatgagatgttgtcttcctaacccttctgagttgttctgttgtcatccccagggaaacgccaaggggcccagctggttgctgtttgttcagatgaggcaggctcaggtgcatggttgaagggctgcttccccagcagacaagtaggagcagaatgtcaggaattttttaaaccagaggttgcttacggtattaatgaagtcttactctatcttagtctttttaacttcctgatctcatcattttatttatattttaggaaggcctagacataaatattaaggaagaaaataattttaaagaataaagtaggctgggtgcagtggctcatgcctgtaatctcagcactctgggaggccgaggcgagcagatcacctgaggttgggagttcgagaccagcctgaccaacatggagaaaccccgtctctactaaaaatgccaaaaaaattagccaggcatggtggcgcatgcctgtaatcccagctactcaggaggctgaggcagaagaatcgcttgaacctgggaggcagaggttgcagtgagccgagatcataccattgcaccccagcctgggcaacaagagtgaaactccgtctcaaaaaaaaaaaagaatagggggaagggatagcattaggagatatacctaatgtaaacgatgagttaatgggtgcagcatacaaacatggcacatgtatacagatgtaacaaacctgcacgttgtgcacatgtaccctagaacttaaagtataaaaataaaaaaaaaggataaagtatcccacttgacccaaagatattcattccacgcatggaaattaagcagagagggtacaattattaaataatcaatgtcgctcctttcttggacataagcttaacaagaaaaggataggttattatatataaagacataaaagaaacataaaagacaacttgaataaccagaaagacatgaccatatctttgaatggaaaaactatgtattgcaaaaatttctttaaaacaatttctatcaaattcttaataaaatattttggtggggcaatttgagactcattttatccttttacctggcagattatatttctagaactctttctgatggaagtcattaggaatccaataattatataagatgttcctctcattattttaacagtaaaaagttgcaaataacctatctagctaatgatgggattagttgttatttaacaaccattaaaacatgtggtcttgacggtgtgtaaaaacggcaataaataacattaagtaagtaaaaacatctgaatggaaaacaaaacacaaactggccaaaatgtgggttttttaaaaggcttttaaacaaatattaaaaagaaaatacaccaaaaagttaatgttatctcttatttagaattaatttgactttttctgttacaaacagaaaaaaatatatttgtgaacgatatcctggcacacagttcaatcattagtcatgctaaggtggaaaaaatggatacagaaagacataatcagtaggatcccaattatataaaaagatacacatatttttttaaaatacatgaaagaaacactaaaatatgaccatcttgggtagtgaggttatgaggtgatttttattgtcctttatataaaagaaaatattttgttatgtatgttctgaattttctacagtaagcacacaaaacatgagtacacataataagaaaggaaaaaaacgtgctttttaacactgagtggggggaagaacccttagaaaacttcaaaatagtttgttcttgtttagcgtaatttactcactcaggtcagaaacttggaatcatcgttgagacccaacctgtcactcaaatcctatatctaatccgtaaagtcctgaattttcacctgctaaatatacttttgattcgtccacttctctcccatacgctaggtcacatcgctcatctacagcagtagccttctgagtggtttctcacaattcctgccctcctataatccagtcgtcaccagcagttacagtgatcctttcaaaatgtacatcagatcttgtcattctgctgctcttatgataaagccccaactttgtgtcacggtgttccacactctacgatctggtccctgcctctcctcttctgctaccgccgcaatggccttctctaagctcaagtcaccaacctttctccccgattctgccctatcggacaggtagttccctctctcctttcatctccgcctgacgcactcctccctcccttcaactccatttggagtccatttactacagcgcccagaaccccggcactacggctctttttagtctgaggactagctcctttttgggcccaatcacaactctgaagaatcctgcgcctatccgctgcatgtctcctcactaaactatttcttgaggggacagcctgactctatcattctcgtgctgcattcccaggggctggcctcgttgccgcttgagaaataccaaccgcagccgttgtcccaaagacactactaaaactgcccggaccctcccgctcccgagcctgcccgttagagcgcaaggaaaactcaccatccggcccccagtgcgtctcggaagagctcccgctccgaaacaaagctcacaacttccggaagcgatggccaatccccgtcttcttcgagccagtttccggataggccggctcggggtggccatctgtttccgggtcctggtaggaggggtgcttccgcccatggtcccgcccattcttccgcctccccaacctgggtcccgtcaacggacgcgaaggagaacaggggctgtatatcacttccggcgaaggaaatggaagaatctatgggctgggaccggaagctggggtctggttttgagtctcggctttgtcttaacctgtgttgggcgttgcaccgggcgacctcagtttcttcctgtacaaggaaaagtactgaccaaaatgagttctacatacatttccgctgctggagatttctttggtttttgagacagagtcttgctctgttactcaggctggagtgctgtggtgcaatctcggctcactgcaacctccgcgtcccggttcaagccattctcctgcctcagcctcccgagcagctgggactacaggcacccgccaccacgccccgctaattttttgtatttttagtagagacggggtttcaccgtgttagctaggatggtctggatcacctgacctcgtgatccacccgccttggcctcccaaggagctgggattagttctttttctgggccatgtctcctgtgacactttggacttttgagtttaatgctggaacaagttaaaattttggtaggtgattgggaaggcatgattatgttttgcaatgtcagaaggacatgagatttgggggtccagggatggattgaatatatgtccctgccaaatctcatgttgaattgtccccatttttggaggtgggacctgatgggaggtgtttgggtcatggaagtggatctctcatggcttggtgtctttgcaatagtgagtgagtgccaggaagatgtggttatttagaagtgtgtggcaccctccaacacagtctcttggtccagttctcaccatgtgatgtgcctgctctctcttctccttctgccaatagtaaaagctccctggggcctcctcagaggccaaacagatggtggtactatgcttcctgtacagcctgcagaaacatgagccaatttaacctcgtttctatataaattacccagtctcaggtatttctttgtggcaatgcaacagcctaattgcagggggcaggggcagggggaagaggtggggaggcatgacacactgggctaaaacatgaagaacattcggccaggtgcggtggctcacgcctgtaatcccaacactttgggaggccgaggcaggcagatcacctgaagtcgggagttcgagaccagcttgaccaacgtggagaaaccccgtctctactaaaaaataaaaaattagccaggcatggtggctcatgcctgtaatgccagctactcaagagactgaggcaggagaatcacgtgatctggggaggcagaggttgccatgagctgagatcgcgccattgcactccagcctgggcaacaagagtgaaactccctctcaaaaaaaaataaataaataaaaattaaaattaaaaaaaatatatatatatatatatacatatatatatgaaggacattctatttctgggagacactggaacagggccctggctggtctggttagtctctctctatcacaggatgctacattcccagcacattctacagttatcctagagaaccacaagtgagaaaggagagagaactaaattggtccaaggccacctggagaactgtcctgcagtctatgcccttaacccagattataccctttagcaaagctagtccgtttcatatgcccaccaacctcctagtatctggaggcggaagtttgtcttatcagatcgatgtaacaccttcacagacacaatgtcagtacaacattgttgagccatagccagaatacattttactaggcccaggaggactacatcacaaacaggttgatcaggtctgtctggagcatcaacctagtccaggatccagtgatccaggtaagaacataataggtcaaaggtgccagcccaccaagatcttattagttgtcatgatgttttgccaccttaggccaattaagtctacctccctcccatgtggcagatgttagatcctcactcagtaagccagggctcaggttctgttgatattcactgtgccactataatactggtagagtttactactggcaggacgagaaggttgctgtagcctgtgacataatggggtctgggatgacagatccagcactttcctatggtagccacagcttgggagagcctaacaaacgcgttatgcttctaggcctctgcagtcacgtccttgtggaaaaagcagactgacaggttagtgccctgccccttacacttcctgcatcctcgggtattccctacctatgtgatagaggttgagctgagtgtagtgtcccagtctgactgctgcagtcccgagagtacccattccgcttgttgcatgacccaggccttttggcttcagtcgtccagtccgggaaggtttgtcttgtacaaactcgacatgtctgataaggttacctacctgaatggaaggatcaggtgttcctggtgccactaagcctagcaccctgatactccttggtcctgtcctgtatccctgtggatttcatagaagagaggcacccgggggacgtatcacctctagatcagagtcagaggggcctgtcgggtgctctggcagcttgaaccaccggccacctacaggatgtgcactctaaatggaaaaagaaaagacaatggttgggaacactgagattggaatttcacaggtgcagcctcatcaggcagtcacctggtccacctctatccacatcaagctcagcgtttttcaagatgtgtgcagtgctgtgtttcccttgattggagaacagtgcttagtgtccacactgccctagtcaggttgaggtgccaccccactaacaggctgtcctgatgtcctttattcagttgctttgtgagttgactggtccatcattcaatggctccattggcctgtggatgacagagtgcatggaaaacccactgtattgcatgagtgtgcccactgtcatgttgcttgggcagtgaggattttccttggtcagagtgaagtcccatggggtatccaaaaacataagtcctctcaagggcagctgtggtagtcagagcatccacatgagtggcatatagagtcccttccaacagcaagctgttgccatagcccttgtccccacacatggaatcttttaatagtccaatcactgctgccattcccctgaccagatggctaggctgttggcaatggcccatgagtcagtaaaaatgtggcaagatatggtggtaggtgggaggggatgtgccccactgttatggctcaaatccttagctgttaggggtcatagcccctctggtggcagtgacattctgtgccacaagccaccaaaatgtcaatgcctataaagcactcagtggtgggaaccatggtcactgacacctgaaatggcccaaaggcctccacccacaagcagataagcaccacaagcagataaacactatgtgtcaccgagttcatccccaaacttcctggtgtcaccagcttaatttttcccctaaaggaacctggaaattctgtcatgtggccttcagtatccaagaactcgaaagaaatcagaatttccatctttccccattttatttatttattttttttttgagacaggatctctctccattgtccatgttggagtgcagcctcaacctcccaggttcagacaatcctccagcctcagcctcccacatagctgggattacagaagcacaccaccacacctaattatttttaaattttctgtagagacgaggtctcactttgttgctttggctggtctctaagtcttgggctcaagggatcctcctgccttggccccacaaagtactggaattataggtatgagccactgcacctggccccattttatcttaataggagtatagagccattggcctctggtggggatccagagaccttgggccccattcctacccgtgccatacagcccaagacatttgggtttgcaatgtccctttatcaaatatattcatcaaccaggatgcatgtgacttccttggcctttctccatgtctaagactgtggtcctttagacttgagtctccctttctgtgacgggccacgttgtgcatgtgggttcctctcagatgcttcagggaccatgtgagtacctcatccctcttctttctcttaagtgccttagggtatgtttgggtccccaatcatcagccctggaaatgagcaatcacataagtggctaacaaccaagggatcctgtgtggcatttcagctccaccttactttctctctgcttccacccattcagccagctcagtcacatccacagggtgtgtttgcacgtgacctaatgtctcacgtatcacccctcctttcccataaaatgtccagttgcaagtccagcctctgcacccacaggttgacatcaccacctcctttcaccaggaaaacatggttctgttagactgaaccctgtttgttgtgtcaattttgtgaagcaggctcattgtgcactggttatcaacttgcctgagtccaatgagatggtaagatggaatgcccacacacaagttacatgaagtgggtttattacttacagattggccctgaggcacaacagaagcccggaattcattgtgagccaatctcccaaggctcaagaaagctaccgagggtggatggattctcacaagtggggcatgtgtcccacttgcactgcagctgagggacactagaaagcatcccacactggatttaataccctggggaccacatgacacgctgggcaaaagtgttgatggacatcttgtttctcagaggcagacaggaacagagagagcctgtgagctgttcttgtcagtccctctttatcgcaggatgttgcattcccagcacattctacagttattgttgagaacacacgtgagaaagagggaagaactgggcgagtctaaggtgacctggagaattgtcctgcagcttgttcttgaatgttcatatcaactttactcataatagccaaaaactggaaataaccaatgcccaacaatacattgataaacacattgtggcaaattcatacagtgagataccactcagtaatgaacaggaatgaactgcagatacttccaacaatacttgcaacatggatgagtctttagaatgtgctcagcaaaatgacaatctaaaattaattactaggctgggaacggtggctcaagcctgtaatcccagcactttgggaggctgaggcaggaagatcacctgaggtcaggagttcgagaccagcctgtccaacatggtgaaaccctgtctctaccaaaaagtacaaaaattagccgggtgtggtagcaagcatcggtaatcccagctactcgggaggctgagacaggagaatcgcttcaacctgggaggcagaggttgcagtgagccaagattgtgccactgcactccagccttggcgacagaggaagattctgtctcaaaaataaataaataaaataaaataaattaccatatgatttcatttctacaaaatgctagagattacagatttattatggagtgactgaaagcaaatcagtggttgcttgggatagggaagtgggagacactgactggaaaggacccaaagggaatctttagggtgaagccaatgttctatatcttgatgtggtgtcagttacaaggaagtatgaatttgttacaattcatcaaattaggtatactttagaagagtatattatatataatatatatttaatatattttaaaaaatatatatatataatttttttttttctgaaacagagtcttgctttatcacccaggctggagtgcggtggcacgatcttggctcactgcaacctccgcctcccaggttcaagcgattttcctgcctcagcctcccgagtagctgggattacaggtgcgccaccacgccaggctaatttttgtatttttagtagagatggggcttcaccatgctggcaggctggtctcgaactcctgaccttgtgatccgcccatcttggcctcccaaagtgctgggattacaggcatgagccaccatgcccagcctagaagagcatattttataaactacaaattatgcctcaataaagttgattcgaaaacagacataaaaattgttgtctcatatcaagcagagtcccatggaataaaaaaattgtcttggccgggcatggtggctcatgcctgtaatcccagcactttgggaggcccaggcaggtggatcacctgaggtcaggagttcaagatcagcctggctaacatggtgaaaccccatctctactaaaaatacaaaattagctgggcatggtggcgcacgcctgtaatcccagctactcgggaggctaaggcaggagaatcgcttgaaaccagcaggcagaggttgcagtgagccagaattgcaccctgcaccccagcctgggtgacagagtaagactccatctccaaaaaaaaaaaaaaaaaagttgtctcagttcatagcagcttgtttctaactattaaaagctggaaacaacccacaacccaaatgttcgagtgaatggataaacaaagtgtcacacatccatacaatgactgcaactcagcaataaaaagaagtcagctattgctatatacagcaacatggatgaatctcaaaataattatgccaaatcaaagaagccagacataaaaagagtgcatactatatgattccgtttatgtaaaactactctatggtgacagcagatcagtggtcgcttgagtaggggttctaggatgcaaagggaggattacaaaggagtgtgggggaactgtggagtaatagatgtgttctaccttgattatggtaatggcttcatggatgtgtatatgtcatgtgaatctaattgtatgcttataaaaatatacagcatattgcatgtcaattatctctctaacgctgtttaagaaacatgagacactacatctttttgttggaacagctaaaattagaaaaaactaacaacactaagtattggtgaggatgtgagcaactggagctctcatagcttattcacggggatgctgtgtaatacagacattttgcaaaagtttggcagttccttataaaattaaatatacacttaccccacaacagcaatcccagtacaagggaaataaaaacaattcacccaaaaatctctatgcaaatgtttatggcagctttgttcaaaattcgaatattggtaaataacccaaatatccttcaactagtagatggaaaacaaattgtggtatatccacagcatactcagcaacaaaagggaatgaactgttgatctactcagcaacatggaggaagctcaaaagcattatgctaaatgaaagaagccacatttgaaaggctacatactctgttattccatttatacaacattctagaaaaagcaaaactatagggacagaaaataggtcagcatttgccaaagtctggggttggtgagaatggattgctacaaaatgccatgagggaattttaggggatgatggaatggttgtatattttgattgtggtggtggtggtgatggttataaaactacgcatttgtcaaaatttgtagaactgtacactaaaagaggtgaattttactatttgactattttttaagtcatctcagaggtaaaaatgatcccttatgacttgcaagggttatgtaccataaaattagttcaaaagatctaatttgataaggtgttagatgagagctttcaaaacaatatcaactttattcttctctgcaatatatagacttgtataaatatgcataactgttaccatgtgttaaaatgaatctaaccttggaaatgttatctgaacaaatgggtcaggtaagatacccagactccaaacacaatccccatgtcttgtgaaaataacttcgaaaatgaaacttgtaattcttgatcaattgttatgttggatgtaactgacatttctatattcttaaaaggtataaatatttgtaggacttcaatgtcaaatcagtgagagatgtggtacttccagctgtcatacacatgtctgaatgattaaacacttatgactgtcagatttttaaacaaatatctgggtgtcttaacctaggccctctagaaagcagagcccaaggcaaggattaaagcactggtattttatttattatttatttttattatactttaagttctagggtacacgtgcacaatgtgcaggtttgttacatatgtaacaacccaaatgtccatcaatgatagactggattaagaaaatgtggcacatatacaccacggaatactatgcagccataaaaattgatgagttcatgtcctttgtagggacatggatgaagctggaaaccatcattctaagcaaactatcacaaggacagaaaaccaaacactgcatgttctcactcataggtgggaattgaacaatgagaacacttggacacacggcggggaacatcattcaccggggcctgtcatgaggtggggggatgggggagggatagcattaggagaaatacctaatgtaaatgacgagttaatgggtgcagcacaccaacacggcacatgtaagcactggtattttatttgggatatgtaagaacagagaggtgagggcgaggaaaaaggtaaatgaagcaaggaacgatgcatagcaatgtgatgtaatgcattacctcaccgcaggcttcacagtgagccaggaggacacacggagtgtttgccaagtgcatttacttagccgaacacatttgccagacaacctgtgtgtcttctctggaaggcatgcaaggcaaaaccatggctgagaggagttcacaggagggagacaggagggggcgcttgcctgccaggctccctcctgtcctctgcatttcactaatcaaggccctccagagggagctgactcctccatacttctggatcattgccttaaacctgtcagcagaagctcaaggggttgatggggttgatggaatctgagacagtgctctagaatctgtgtttcatacaggatgagatataaatgaaacaaatgctaaataatgacacaaggtaccttgccgagagaggaatcatccacctggaagggtaggctgtttgtgaataatgtagggtgggagagaaggctttactaaggagatgggcttaaagaatgtgaacgatgtgctcacagaggccacagaagagaaattatagccaggagaacaacctgaaagacaaaggacacggtggcataagcacatgtaacacaatgtactcaggaaatggctggcatcctgagatatggagtggaatacagtacagggctttgtaaactcagcttggagtcagatcacagaaagccttgacaaggaactgaaaatgggttctgaaggccagaagccattcaagattcccaaagggaaaaacacaaatcagcttgttttcaggacgtaattctggggcagttgctagaattacatcagaaaggaggttcacacaggatactagaagggtcctcccttccatagtagaagtgtttgtggtgaacaaaaattaaaatttcaaagatggtaactgtcagaatggagaaaaataaaacttaaatgtgtgcggcaggaggaaagtaaacaaaaaccaagctgactaaccaccttattacaaggccaccatgacaagactagagcgtccatcatcagcttttagtgcctcaatgttaagtatggacaaatgagcagtaaacatggtcatgaggtatttcaagaacacttctaagagcagagacagaggtataaacaagtagcggacgggaaagaaagaaaaaaaaagttgattcagggaacagaagaaatgtagaaataattgacattagagagataatgaattcattttctaatagcatttttttccagaaaaaaaatgagctagctcttggaaattaaaatcatagagcagaaaaaatatatatagcagaaaatgtagatagccaacagaaaggtagaaaataaagctgagaaaatcatcctaaattttaaaaaaaggcaaaaggttaaaaatggaaaacaagagaaaaaaaaacttagaggtacatttcagaaaatcccacattcaactaataaaactcccccctcccgcaaaaaaaatgtgattaaaattgaaatatcccagaactgaagcacataacttgccagattgaaaaagctcactaagtatttagcattatgaattaaaaagcacccacactggctgggctcggtgactcacacctgtgatttcagcactttaggaggctgaggcggatggatcacttgaggtcaggagtttgagaccagcctggccaatgtggtgaaaccccgtctctaccaaaaatacaaaaattagtcaggcattgtggcatgtgcctgtagtcccagctacttgggaggttgaggcaagagaatcgcttgaacctgggagacggaagttgcagtgagccaagatcatgctactacactccagcctgggcgacagagtgagactgtatcaaaaaaaaaaaaaaaaaaaaaaaaaaaaaaaaaaaaaaaaaaaaaaaaaagcacccactaagtcataacatgaaatttcagaacacctgagataaagatcctaaagctgccagagaggaaaattacaggtcacaaataaaagctctgcagtcaggatagcacaggatttcaacagcagagatgaaatctagaacaacaatgaattaatgcatttaaaactgcttacctacaattccacgatcaaactatcaaaggagtgaaagagtaaaataaacccatttcactcaggcaaaggtcttgaaaagtttatatcccaatgaccttccctgggatgctgaaagatatactccacccaacaggaaagtaaaccaaaaagcagcagctatgggatccaggagacaggagaggaagaaatgaccagggtgaaggtaaagagaaatcccagggcagaagctatgcctgaggtctagagaataaccaacgtgcagtggctcacgcctgtaatcccagcactttgggaggccaaggcgggcagatcacttgaggtcaggatttcgagatcagcctggccaacatggtgaaacccactctctaccaaaaatttaaaaattagctgggtgtggtggtgcatgcctgtaatcctagctactcaggaggctgaggtgggaggatcgcttgaactcaggaggcggaggctgcagtgagccaagatcacaccactgcactcaagcctgggcaacagagtgagaccttgtcttcaaaaaaaaaaaaaaaaaaaaaaaaaaagaataaccaaagtgcctgttctgggctgagttgtgtcactccaaaagtcatgttaaagttctaaccacagtatctcagtatgtgactgtatttggaaatgggcctttaaacaggtaaataagtaaaagtgaagtcactagagtgggccccaatccaatatgaccagcgtcctttttctttttcttttcttttaaattgaggtcccattccaattagcatctttttaaggtaaggaaatttagacacagagagacacaaagggaagaccatgtgaagacacaggaagacggccatttacaagacaagaagagaggcctctgaagaaaccaaccctgctgacaccttgctctttccatctccagaattgtgagaaaattaatttctcttatttaagccacccagtctgtggtactttgctatggcagccctagtaaacgaatatagcactgaacccagaacaagggaaccaggaaagattaagaaaaaaaaaaagaatttgatgtatatacaagattacataatgctatcagagatttgggggatgaattcatcatcaatccataggaaaagaggcaaacaaatgaagtaaaagtgaggggggaaaagtggtctgagaaacacaatcatggtacactatggctcatgatgaatatttagctagtaaataacatgaacttagatcgctgacttaaccaaaggttgagaaacaactgtggtgtggtgtgggtggatattatgaaagagctaaattcttatctaccataggaggaaatcaacaggtaataacactaatggaaaaatcaagaagtggcgatataagcacattatttaaatatggaggcaaatgccaataaataatgcaaaaatacttaaagtggctgcctttgggaaatgatatccaggagtaaggtggaagaccgccccttttcatgataatctcagtggagctatttgaattgtaaacaactcataggtgtttatgaataatgaaagaattttaaaacctaagcagaccactaaagacctttttattaaattgtatatatatatatatatatatatatatatatatatatatatatatatatataattttgagacagagtctcactccgtggcccaggctggagtgtggtggggtgatcttggctcactgcaacatccgcctcccaggttcaagcaattctcctgcctcagcctcccaagtagctgggattataggtgagcgccatcacacccagctaatttttgtatttttagtacagatggggttttgccatgttgggcaggctggtctcgaactcctgagctcaggtgatcttggcctcccaaagtgttgggattacaggcgtaagccactgcatccggcctaaagacatttttaaacaaaagacttgctagtcctcttagccagacacagaacaagtgtgttaaataaataagacatgaaacatctaatggtgacaagattttttaacaggccatgttaactgaaatgaggaggacacagaggggacaatagggtcaggaaacttttttgaaggtgtagtgtttatatgatggcacttctgctgacagcgtcctcctcagaagttgcctgcccaggggctctttaaaacagactaggtggatttccatgtctgcccctgcttgttctttttgcctcgccagttgtcttgctccgatttcttcccaagtgggctttcatgatgtattcatgatgagccttcatgacgtactctacaagactagccttttagcaagaacttttatatctctgttaaatgtgacaagcagagaaaaactgtatagccatcacttagatgaaatatagcaatgtgaccaagcctatgttacaaaaatcatgtaggttttacttattttcctttctctttgtccttaacttcctccaggcaggactgcttgcatgtagtcattttggtagagggtagtcactaataagtgattaacttcatatcctaacccccaggggcggcttgcaagattgatgaacttgtttttcttgtaaagaacaatgatccctgggtcatgctgacctccttgatggcacccagaagtttgattggccaagggatgcaagcagctttgataatcaggggatctcacttcccatatacctaccttactcataaaagccactggttacgtgcaaagggaggctgaatttgagaatttgcctctcccaccctcatgctttggtcaaattgaataaacctttctctgctctgaagcaccgatgtgtcagtgtttggcttactgcgcatcaggtacttgaacctaacttttggggttctgcaacagattttggcaaccatgccaggtctagcatggcaataggccctggccaggttaggcgaacgagtgtcccagcagctgcccaagtgtgttggtcagggggccctaaagtcgctcttctaggtcagtgtaggctgctgttggtactctagaagcttagagcagagaaacatctcagactgctatctggacttctggttttggtttgaagggtaagtcactgcggtgcacacagccatatctcactctctctgcttgcattgtgaagagggcccttttgggggagtaatagaatggtggactatgcccattttcttgtttgctttcctgtagggagtttggttttctgtttgtgattttgttttgttgttgttgttgtttggtttggggggtgtgtgtgtgtgtatctgtgtgtgtgtgtgtgtgtggtgtgtgtgttatgtgaaaagactgaacagggcaaatttggaattgatcccagagagtagcatcattggctgcattctccagaattgggccactttcagctatgagcccatgaagaaaaataaaatttttttaactgtaacgctgcttggcctcaatatgccttagaatttgggaaaaaatggctgacaaacagttctttaagttatgctactataatacaactgcaactattctgtaagagcagagaaaataggatgcaatcctgtatgtccaggcttttatactcttttatcagaatgaacctactcaaaagaggtataatttgatgctgcaaaaggaaaaacagcccaaacctaaggttttagactcccaccattaggtggggaagacagggcactgcttggtgctttgaatcccctgaataatcatcctgatcctctgccccccagtcagctatggctccagcacctccacctccttatgggattgtctggagcaggaggggaacactcccaaacctgtcctccccatggaattaggacaggttgtggtctcgccttcctgcaactgacaggaaacccaatttggcctgggacccactggtcccttagtagggcagtttcctctgtgtcaattccccactgtgggacttgaatggacaacagtttggcatgatgtggttacatttccttttcccactttggagctgttcagtgggaaaacaatatctttggaaaaacaataatcccccctatcccaacccaagcaaatggctgggctattcttgtctatatttctgacctaccacccgacaagggcagatactcactttgttaaagtgctgctcacagcagaagaaaggcatgtagtcacagaaaaggctagggaagaagcaaatcggctccatctggaggcaggaaacaatcacccctggccaatagactcagtccctaacacagagaccaggtgcgatgtaaatggtggggcctttcccacttaggacactatgagaaccacatccttgaaggtttgaggaaaggggttactcaggttaagagcctcaataaggtacaggaagtacagcggcaagcatatgaggaccctttgtaattcccagaaagactccatcagacatgtggaaagtaggttgacgctaactaaccctgaggcaccggacaatcagagaatggtcaatgtgacctttatcagccacagtgccctgatattcaaagaaaactgcaaaaggtaaatgggatccttgggttgccaatctcacatttagtggacttagcttttaaagtgtactatgctcaggatgaggctcaggaaagtgcaaattgaagcaacaagtaactcactggcagctgtgcttgactaccaacctaggggaaaaggaagaaatcaaagagcggctcacgcccccttcagaaaaaaaaccaatatgcctattgtaagaaggagggacactggaaaaagggctgtcccaaattgaccaaagcagctagcaagtgcagtgtccctcaaaatcagatgaggagagagaataatatttagatgaagactgatgtgtcccagggactcccttagacttggagcaaccagtggctatatccccacaggattcctagatacaactgacagtggggaacagaatgattgactttttacttgacacagtgccacatattaattaattaacaattgtctctctccagctttgggaaaaaccattactgttacacggatattgggagacaccattatccctttctacaatcttcaggttaccatttacgagagaccggcctagggcatagtttcttgtacatgcttaatgcccagtgcccctcctgggctgggatttgcttgccaaattgtatgctcaacttgtctttccccccagatgcctagatataatgattccttctgaacaagtttgcaggtttcaaatactcctgctgcaaccagaaaacgaagaggttcaggacattccagaagaaattctcacacaggtaaggagagatgtttgggcccaagggaagccagggagagtggtcacagccaaacccataaaaattaaaagagagacacagaatacccattaaaggaagtggcatgaaagggtattcaaccactcttggaaggcttttttggcacaaggactgatttggtcctgtaattctccctttaacattcctgttctacggtgggcagcaagccacccaggtgctgaggcaagagaccgagggcacaagttgttccagtataataaaatatataaaacaacaagagttatactagatctaaatcatagacatgattatatatgaatatcattaatcattagtttgtagcaattactctttattccaatactgtaataatcctcgctctataatcataacctaggaaaaaccaggccatacagagataggaaccgaagggacatagtgagtgagaagtgatcagaagacaagagtgcaagccttctgttatgcccggacagggccaccagagggctccttggtctagtggtaatgccagcgtctgggaagacgcccattgccaagcagaccgtggtctagcagtagcatcagtgtcaaggaaaaacacccgctacttagcagaccgggaaagggagtctccctttccctgggggagtttagaggagattctactcctccacctcttatggagggcctgacatcagtcaggcccgcccgcagttatccggaggcctgaccctgtctccctgtgatgctgtgcttcagtggtcacgctcctagtctgctttcaagttccatcctgtacacctggctctgccttttagataacagtagcaaaattaatgaaagtactaaaagtctctgatatgcagaaataatggcgtaagctgtctctctctcgctctccctctctctgcctcggctgccaggcagggaagggccccctgtccagtggacacgtgactcacgtgaccttatcaatcactagagatgactcacactctttaccctgccccttttgccttgtatccaataaataacagtgcagccaggcattcggggctactactggtctctgcatcttggtggtagtggtcccccaggcccagctgtcttttatctctttgtcttgtgtctttatttctacaatctctcgtctccacacatggggagaaaaacccactgaccctgtggggctggtccctacatcttaccatcatgcaagtcccattaagacaactacagtttcggctgggcgtggtggctcacgcctgtaatcccagcactttgggaggccgaggcgggcggatcacgaggtcaggagatcaagaccatcctggctaacatggtaaaccccatctctactaaaaatacaaaaaagttagccaggcgtggtggcaggcacctgtagtcccagctactcaggaggctgaggcaggagaatggcttgaacctgggaggcggagcttgcagtgagccgaaatcgtgccactgcactccaggctgggtgacagagcgagattcgtctcaaaaaaaaaaaagacaactacagtttgtacaagacttagggccagtaatgaaacagtctaggacatacaccctatggtaactaacccctatagcttgctgatcactttgtcaggagaactaggttggtttacagatttggactgtaaagatgccttattttgcattagacaaggagacacaagagatctttgaatttgaatctctgaggctgggacacaggtcaatcagcagtactgttatctcaaggatttaaaaattcccccacaatctttgggaaatttttggcatggaacttaacggacatctggctgacagaaggaacgcttttacaatatgtggatgaaatctgtgttgcaagaccttcagagctttccttgaaaataccattcaaatactgaatttcctagtggtaacaggctactgggtttccaaaaagaaagcccagatctgccaaaagatagtaaaatacttagggtttgaactgaataaggggcatagaaaccttcccccaggccacctggaggcaatcgtctgggtagctgtccccatctcctgtaaacaactgcaacggtttctaggaatgatgggattctgttgaatttggattttgaattttggacttacggtaaaactcctttatgaggccctaaaaggaaaaaattctgagcccctgatctggacttcagaatgccaaaattaaaagtcaaagaggctgagcacggtggctcatgcttgtaatcccagcactttgggaggccgaggcagtcagatcacttgaggtcaggagttcgagacctgcctggcctacacggcaaaaccctgtctctactaaaaaatacaaaaattagctgggcatcgtggtgggtgcctgtaatcccagctgctcaggaggttgaggctggagaatccaggaggcaaaggttgcagtgagctgagatcgtgtcactgcactccagcctaagtgacaagaacaaaactccatgtcaaaaaaaataaataagtaaataaaataaagtcaaagaaaagttaaagactgcctctttgctgggccttccagatttaagaaagccctctaatttagttgtgcacaaaaaacaagccatgggcttgggtgtcctaactcaaagcttgggaactgactgaagactgattgcctatttctctgaacagtttgaccaggtggtgagggttggtccccctgcctccgagcagtggctgcaacttgcaacctcttctaggaggctgaaaagctaactctagctcagctcatcactgtccacacactgcatcacatctcctgtctcttagatcaaaaaggtggatactggctgacctctgagaggttgggaaaataccaagccatccaccctccttgacaatccagaggtgaagttaaaggtgttctcggttcttaactctgctaccttaatacctccagagaaggagccagggcccatacaaaattgccttccaattaatgagcaggtctttccaaggcaaccagacctggcagatcagcccctgctgtgctccaaactaggactgttcacagatgcaagcagcttcatggaccatggacatcatcatgctgaatttgaggtcattaccttacaaggaattaaggaagccaaagccttattgctaggcacctcagctcagtgggccaaggtgcccttatgcatgccctccaattgggtaagaaaaaaaattatgaatatttacatagactcccaatatgatttcttggtggcacatgcccacagagctatgtagagagaggtcttttgactagcaaaaataaagaaatcaaatatacttctgatattttggccttattagaatctgtaaaaggccaggcatggtggctcatgcctataatcccagcactttgggaggctgaggcgggtgaatcacctaaggtcaggagttcaagaccagcctggccaacatggtgaaacctcgtctctactaaaaaatataaaaattagccaggcacggtgacacatgcctgtagtcccagctacttgggaggctgaggcaggagaatcacttgaacccgggaggcagaagttgcagtgagccgagattgtgccactgcaccctagcctgagcaacagagtgagactctatctaaaaaaaaaaaaaaaaaaaaaaaaaaaaaaaaaaaaatcagtaaatgccccctctaatagtggctatcatccactgtcccagccatcaaaaaggagactcccgaatagtcaaaggaaattagcttgccgacctggcagccaagcaagccacaaaaacattggactctgaggctttcttagccccactaatacctcacaatgatctgaccaagttccaaccttgctataccaaaggagatttaaagtgagccaaggaatggggattcacatcccagccctggcccatccaggctggaaatgtaatctggaaggtatcgtattggttcccagtgccctccttaaagatatagtgagctagtttcatcaaagcatccattacagaaaagatgcaacccttcaatggcatgtgagttcttgattgaccccgacatgcaatggggtcattcaaaatgtgatctatcaatgcatgctttgtgcccaaactgccctaaaactgaccccacccctgttcaagggtacaacattgaggagactctccatgcaaggactggcaagttaatttcaccacaatgccacgggtgcctggaggctacagggcatctttttgtacaaaaaacatctttttgttttttgtagacacatttacaggatgggtagaggcataccctatccgaacagaaagggagctgaagtggcccacactatactaaagagataattccccagtatgaactccctttgacgattcagagtgaccatggtgcggtgttcatctctcaggtagtacaggaagtgtctcaagtcctagacattgaatggaaacttcatgcagcacagccacagcccaccggaaagactaaaaaactgaatcaaactatttaaagaacaattaggccaggtgtggtggcttatacctgtaatcccagcactttgggaggccaaggcaggtggattatttgagcccaggagtttgagaccagcctggccaacatggcaaaccccatctctactaaaaatacaaaaaaattagctggacgtggaggcgcatgcccttagtcccagctgcttgggaggctgaggcacacgaattgcttgaagccgggaggtagagattgcagtgagccgtgatcatgccactccactccagcctgggcgacagagtgagactgtctcaaaaacaaaaaaaacaaaaaaacaaaaaaaaaaaactgctgctaaagtgtgccaggaaactaatctaacttgggacaaagtactaccttctctcctgctgaggatttgggtcattccctgaaacaggctctagttgagccctttagaaattatgtatgagagacccttcctagccacattggggctagatcaggctataaaatcttagaaagggaaggagctattagacattatttaaaattgctaaatgaaataccgacttctgttcatgagtttgcttcttccccatggacaggccacctcaccctttctaggctagagaccaagttctacttaaaacctggagggagactggactgaatcaccaactagcccctcaaagggtaagaccctatgaggtccttctgaccacgcattcatcaattgggcaggagttaaaccgtgggtacattatacctggataaaaattgcccccgcctcagcccgacctatcaggttaatagacctgaaaggacatgtgaaccaactaaaaacctgaagctgcttttgaagaaaacatccacagataagtaaagccttcttgctaagcaccacagtactatatggcttacggtgtctgctgaaaccaatcttttcctacaatgggcacattatgcagatagcctacagaagctcgtagggtttgagggctgttacctatctctagcatgttggtattaccttggtcggtcttgctcttacaaggaaacaactgagtacagtaacaaacttttatgaaaaactattccaaagaaaatcaggtctctggtgtgctaacacgaggaaatgtaaggctatggcctggcattaatataacccttcacaacccaggtcacagaaaatcttttactatatatcagactgttcaacgaacttttgaatacactgctcctcctctcctgaaggaatttcccttggcagccccccaaattttggctattaatagccactatactgaggaaggtttttatcaagcttgggatgattatctttgaatgactgtgttcccctacccttatcctgccaccggccacataaatcaaattgcccctttatgttgggaacaacaacaaaaaaaaaaacagcattcttatgataactggccaaatatcactaagaatatgggctggatgctccccccaccagtgtgaacatactccagggctgcaacaaactgactggtttgctaccaattggacacaggccaggaattcaattggctagcttcatacggagtgcaatggctatgtgggactaatctttggccctgattacccattggctagataggacaatatgctctgggattctcacaggtccagggccatttggcaaaaaccaacggacaacctggaaatttcccaaatgtgttgcatcaacggaccaagtcagttttccactggtatgaccatcccctctccatttttgttccccaagttagtttaaaaaatgttatctgacatgttgagatcctaacaaattatacccagcatgtgctgaaggatgcattcaaaggcatctctttagtcacctctcagatgactatgatgaaaaaagcagttttgtagaaccacatggcccttgatgtcttcacagctacacaaggagaacttgtgccataatgaaaactgaatgctatgtgtacattccagacaattcaggaaacatcaccctggcccttcaagatatgtacaaactgatgctgtgtccaacctcatgatgtcactaaaccaatgattatcttaatacttccggtcagtaccctcttggtggaaaaaattactggtaattctagctatgactataggaacaggaatactccttggctgtggattatactgctgtggcactatatatgtgggattgcaagatcgcccttctcaagctcctgacaccctgttcaacaatgttacaacaaaattgcctaagtcccgggacatgtgaatattttcaactgcaggtaagtaagttccattcctcagccccctaggaatgccccttgccagcgggaagtagttagactgagtcaacaccccaactgaagattgaggaaaggaacagtgtcagtggggatactgtaacccagcctatattagaaaaatcatcaggtgtttattttacttatttttctttctctgtccttagcttcctccaggcaggatcgctcgcacgtagtcattttggtagagagcagtcactaacaagtgattaactttatatcctaacccccaggggctgcttgcaagattaacgtacttgtttttcttttaaagaacaatgatccttaggtcatactgacctccctgatggcatccagaaatttgactggccaagggacacgagcagctttgatcatcagggaaagcccccaattacatgcaaaggaaggtcatatttgagaatctgcttctcccaccctcatactttggccaaattgaataaacctttctaagcattaatgtgtcagtgtttggcttactgtgcaccgggtacatgaacctaacttttggggttctacaacagcaacctgactgagctaatcacgtacagccaagaacagctgagctacagtagctccttaaaatcagggtccagatgttgttcatagatgagagaagagaaaataactatcacatgcagcatcagacattcaatgacacaaatcctcaaaatcagatgctttaaaaaatgaagccaatggctgggcatggtggctcatgcctgtaatcccagcactttgggaggccaaggcaggaggatcgcttgagctcaggagttcaagaccaacctgggcaacaaagtgagaccttatctctatcaaaaatttaaaaataaattaattaaaataatttaaaaatgaagccaggttgctcaagtattcatcaagtatttactgaggcttactatgtgttatgatgatgagacacttctttgagccatcaaaggtttctggcttcctctgcaactaaaaataattaccctccccaatgaagggtctgtgtgttccacaggtatagcagcagaagagacaacttggaaaaagtgaaggtaggccaggcacagtggctcatggctataatcctaacactttgggaggctgaggtgagtggattcgcttgagctaaggagtttgagaccagcctgggcaacatggcaaaacctggtctctattaaaaaaaatacaaaaaattggccaggcattgtagtccacacctgtagtctcagctactagggaggctgaggtgggaggatcacttcagccaggaggcagaggctgcagtgagcctagatggcaccactgcactccagcctgggtgacagagcaagaccctgtctcaaaaaaaaaaaaaaaaaaaaaggtaagccacaactccacttaagaggagaggcaactggagaaagatcccaggaggttatattcaacaacggagcaataacacagtagtcttgctagacatccacagcctttaaatggacatattctactctgtttatcacctttataaaagttttcaagttttctggatagttctactcagttgatggcaattaccctgccaggtaacttactcactataattgaataaaccagcaatctggtttatcagtcagtctctcttgctcaattgacaatccctaaaagttcatccattcctgtgtgagaccgtatatctgacaattcagtcaaaggaagttggtcaaatcccacaactgactgccaaagaaagtaatatctaatcacaaaaataccacaattaattacaggtagtaactaggttctaaagaaattatctcctaagtagattttaatataaattttgaacagttatagaaaataaagatggcctttgggtcaataacagaacataacaaaaacactaaaaatttctgtacataaacacacgcatatcacaagtctagtcagaaagaaatacatagaaaaacaagatagaattttaaaaataatttgcaagggaagttctcaatgcttcagttctaaaatattgtcttcttttagaaaaatttaagactggaataacagattgtttttcctgcaatgctgtaattactgcaaatttatcagcaaagaggtaaacagcaatgcaatttttccttaagcttgaatacataagggaacaataaagaaacctgattagacctgaactaattaaaagtcacaccagtaattttcaggccagctctggtctccaggtagaattccaggacaggtttgtatcactgggtccattcccaacaggctggataggagagtctggagtaattataaggataccaccttcttctatcctgggctgcccgactggcattgggcttcacattccaagaatacctcctgtgtgaatagtcctctccagggggaccaggaggagggagatggtgtctctggtaaacatgtggattctctgaaaattttcttaaagcaaaacaaaaagtaataagccattactaggattaatacaataatttttatttattttaaatttatattttcataaaatattttaaatttataaatttacaaaataatatatattctactgtttcctacctgtgtgacctaagcagataaaatacttaattgttatttccctaagttctttataaaatggggctaataatacttttcaccttcacgagctgttatgaagctaaattaaaaaaatacatttcaattacctacaatgccctggcacaccgtggattcccagaagcctttccacctttccctacagagataaatgcatgcccatactattctaatcaaatactttctctcccaaagtctggcagggttgacataagacagaataagctagttagtactgagaacagatatctgcttccactttataaacgaacatacataaattaattatgaagtgtgaaaaactttaagcatggtatatgcaacaaatttgaaaaattaggatttaaattaacttgtttcaaaagcaagaccagaaaatctcatataattatacaaaagaaaatttggggctgggcgtggtggctcgcacttgtaatcccagcactttgggaggccaaggcgggcggatcacctgaagtcgggagttcaagaccagcctgactaacatggagaaaccccatctctattaaaaatacaaagttagccaggtgtggtggtgggagcctgtaatcccagctactggggaggctgaggcaggagaatcatttgaaaccgggaggtggaggttgcggtgagctgagatcacaccattacactccagcccgggcaacaagagcaaaactccatcttacaaaaaaaaataaagaaactttggaaatatgagaaaagaaaaaccccccactgcagagccctcaatcccacttactataattcaattagttagtatttccttttgttcttttccccagcatctttttctgactgttgaatcacagcctattagtttcacttatcataaatgagctaacacttccaatggctttataaaatgttatagtatggatataattatttagctacattctccactgttagaaatatagcagctacaagtttttccacaaccacaaataatgctgggattaacactgcaaaacatatactactgtatcctgagctagcccagcatctgacacatggaagggagtttgagaaatgtgctgaatgattaagtaaatatagctttttctgtactttgaagtatttccttaagtctcagaatgaaattactaggtaaagtatttttatggctcttgaaattgtgcttcaaaaggcttataccaattttcaatgccgcaagtgacatgttttttgaaatgtttgtttacatcttttaaaaatgtcaatttttttaaagtttcttttttctttttttaataaaaacaggattccagcatgttgcccagggtggtctcaaattcctgggcccaagcagtcctcccaccttggcctccctaagtgctgggattacaggtgtgagccaatgcacctggcctaaaaatggcaatgtatttttgaaagtgtttacaacgtgctaaactgtttaaattcatgttaactgtcaataacaaccactatggggtatgtattattaaaatatctatctgactaatgggaaaaatgaaatgtagataggctaagtatcttatccaagatcacaaagcaggtgagtaacaaagccaacatgcaaatccaggtccagcctgacaaccactacaatggagtgcttatcaaaaactgttgctaaactggctgggcgaggtggttcatgcctgtaatcccagcactttgggaggccgaggcaggcagatcacctgaggtcaggagttcaagaccagcctggccaacatggtgaaacccccatctctactaaaatacaaaagttagctgggcgtggtggcagtgcctgtaatcccagctactcgggaggctgaagcaggagaactgcttgaacctgggaggtggaggttgcagtgagccaagactgcaccactgcactccagtctgggcgacagggtgagactctgtcaccaaaaaaaaagcaaacaaaactgttgctaaattaataggcaagaataatagcttgctatttgtgatagttaattttaggtgtcaagttgactgggttaagagatatctagatagctggtaaagtattatttctgggagtgtctgtgagggtgtgtccaaaggatactggtgtgtgagtgggtggactgagtgggaggatccaccctcagtttgcgtaggtaccatccaataggctgggggcctggatacaacaaaaaggcagaggaaaggcaaattgtgttctctcctggagctggaataccttaccttcttctcctactcttggacattagaactccaggcttcatggcctctggacttgaggactcataccagtgtcctccaacccttaccagattcccaggccttcagccttggattgagagttactccactggcttccgtggttctgaggctttctgagttggactgaatgctaccagcttccctggttctccagtttgcagacagcctactatgaaacttctcagctttcacaagtgcataagctgataccccgaataaaaaagctcctcctcccatccacccacccatccacccatccatctatccatccatccatccatccatccatccatccatcctactggttctatcattctggagaactcatactaatgtaccactttaaccatactgaggtcttccccattttccaagtgaaaatacttttgtcgttttatctgttcagatcctttgctatttctctattaggattttattatttttcttataattcatatcaactccttaaataacaatcttccttattctaaaaactatactacattaatgtagcctaagaatataagatcctttttgatagccacatcaaactcttggcttaagtttaaaatcaatcaaaatttctaagtccctttccgaattgcctctgaaaagtcacatattccctgtcctgtaactgattttccagtgctaaatgcaaaatacagagcagaataatatctcctggttcaaactgaacagcaagaattccttatcggccaggcgcggtggctcacgcctataatcccagcactttgggaggctgaggcgggtagatcacagggtcaggagatcaagaccatcctgtctaacatggtgaaaccccatctctactaaaaatacaaaaaattagctgggcatggtggcgggtgcctgtagtcccagctactcaggaggctgaggcaggagaattgcttgaacctgggaggtggaggttgcagtgagccgagatcgcgccattgtactccagcctggatgacagagcgagactctgtctccaaaaaaaaaaaaaacgaagaattcctcatcagtatcataatgtgttttcattaactatagtattaatttctatctcaattctagaaaagggaaaacagagagaggtacctgactgattgttgcaaactttgggtctgggtgtggaaatgtcgaggagctgagtgaccctggatctgatgtagattatacctaggtccttgtttaacaggcttattgtggactggttgcatgagatgtgctgagtcttcaaaatcacttgacctgggtacactggaattccaattccttaaagagaatattttccacacaatattactggtttccaaatttagtagtcaatttagtgactatattttggcatatgaaaataacaatttcttccttctcccattcctatttgtttacatctccccccaacaaacaaacaagctaccagaagaatgaacatatgcaacttaaattacataaacagagatctccctgacccacaaatctcacatatataacataagacttactttctgataggaccattctgaaggtcttcaatgtagttttgtctttctaagcaatgtccccggcacctattgaatactgaggagaggataaactgttagaaataactgtacaaaaagcagatctttccagaaaaagcaaattaagctgaaattcactattcaagctgttatatctcactacttccacatacatctatagacttttggcaagactatcttatattggaacaaacgaattacaaacttctttttttccaaaatttgataaattcttctacatttccacctttaactttaataaaagggaaaaatagtgtcaaccctcatacttacattcaattgcatcatctggcctcacgccttctacatcaatcaaatatctaacaaaacaacataatttgggtcatttatatacgaaaagaaaaaaatcaagttttttcaaaaaaggtccaatttcaacttatagacatagatataaaaatcctaagaaaatatcagcacatcaaatccagcagttattaaagaatgacataccatgaccacaaaaagacgtttttcaagaatgcaaggatgacccaactccagaaaatctatttatatatttatttacattaatgtaatttaataaacaaaaggaaagaaaatgcagaatcattttttatcaaaatgctttatacactaaaaatagagacttccttaatatgacagagtatttatcagaaaccaacaatgaacaaaagacaaattgggaaaaatattaacattatatctaaaaaatactgtataaccaacagaatgggccagaaacttgggagtcaccatcactgtcagccatttcttccaaactctcatattcaattcaccaccaactcctgacaacaatattacctaaatatctctatagagtatatctgtatctttctaccaaaatgaccaccatgccctggtccaatccaccattatgcctcagttcctacaaacacctcccaacttgtctccttgcttctacctctttccctctgcagtgtattctccactcagcagcaaaatgataggttgaaaatacaaatttgaatgtgttccccacactcatccccaacaaaaaaaattcaatggttttctattgctcttaaggtagtgactaaaaccttaaacatagctctgcatggtttcagctcctattcatatttccagctccattttaacgccatactacccccatggcccagtctccctagccagttcctccaacacagtatatattttcctgttaatatggtctctgctgatccttacgttcagaattctctccacaacatccctacctggttaacacctacttatacttcagatatttgctcagacctccccacagaaacctctagtcctcttgttgaagtcaaatcctccctattctatgctctcattgtaccatgtcactccccttctcagcacttgttggaattgtaattgtataggcatttgtgtgattctttaatatctactccctccctagactgttaggacgcacaaagggcagctaaagtctctttgctaacacgcagcacactgcttacacataatagatgctcaggagatattttctgaatgaacaaacataactcagtacagtgtggcaacatccataaaaagcataacgacacatactatttgattaagaaattctattttgagtgaaattacctccggggctatgagatatgcattcaaaaatatttacatagaaatgttcactacttcaatgttttataatatcaaaaacttctgacttttgtgttcatcggtgtgcaaagaacaacgcaggccttaaaaagaataaggagtctggccaggcgcggtggctcactcctgtaataccagcactttgggaggccgaggcgggtggatcacaaggtcaggagatcaagaccatcctggctaacacggtgaaaccacatctctactaaaaatacaaaaaattagccgggcgtggtggcgggcacctgtagtcccagctacttgggaggctgaggcaggagaacggcgtgaacctgggaagcagaacttggagtgagtcgagatggtgccactgcactccagcctgggtgacagagcaagactccgtctcaataaaaaaaaaaaaaaaaagaataaggagtccaagtattttcaaagaaagatgtctatcacatattaaattaaaaaacagaatgtctaactattataccattcaataacatgtatgcttgtatctgcatttttagagtctgaaaagatgtgtactaaattattaatggtggtaatctctgggtggggagcaagactgccttctacttcatgtatttctataccagttccattttttacaaccttacattaccattgtaaacagacaaaaacaatttaaaatggtctgcctctggggttggcaacttacctgcaaatgaggtagccagtcctgtttaaaccatgggtacagtggacaccaataagtttatctataaaaagaaaatacagggttaagtaactgaagtagatacacaagtatataacattatcactgccctgaaaatgaataactcttaagaggaattgttttttctaggaacatactataaagaatcatctaacagaaagccaaaactcactgcttctgggaaactttgcatagtcccaattagactcagtgatgtaaactgcaagcctggtcagacactaacagctaaaactgcaatgagacaaacccgtctatcttaaaacagaatgcccatcagcaactgatttaattatacaaaaagggagtgaaagcaacaacaggctaagagaagaatgaaatttgtttctgaatcaaacaaataaaaggccttcactcttgatactgaatattaaggacagtttccatagtactcttgagttcccgaagagcttctattccttctcttgttcggtgctccacacataccacaggtctacctgccctgtgaagtactcaggtaaatagcactattcacattttacaatgaaaaggcaaggcttggagatgtaagtcaaagcaggcaaatagtacaagactagaatcaagtctaagatttttcccattacaccacagtatttcttagtccatctttttaaaaaattacatgaggaattaaataaaaaaaagtgtagtttatctttgcaaaatctgtgtccatgactaggtagtgtctggtaaagaaggcactcatcagccaggtgtggtggctcacgcctgtaatcccagcactttccaacctggccaacatggcgaaaccacgtctctactaaaagtacaaaaaattagctgggtattgtggcgggagcctataatcccagctactcaaaaaaaaaaaaaagaaagaaagaaaagaaaaaaagaaggcactctgccgggcatggtggctcacgcctgtaatcccagccctttgggaggcggaggtgggtggatcatctgaggtcaggagttcgagaccagcctggccaatatggtgaaaccccatctctactaaaaatacaaaaactagccaggtgtggtggtgggtgcctgtaatcccagctactcgggaggctgaggcagcagaattgcttgaacccaggagacggaggttgcagtgtgccaaaatggtgccactgcgctccagctttggcgacagagtgagactccatctcaaaaaaaaaaaaaagaaagaaaaaagaaggcactcatcatcgccagcctggattactacaacaaactaatctccctacttctatctcaactgatcctccatatggcagatgttatctttctaaaacataagcctggctgggttgtttttgcttaaaaatctcaatttagcatagcatgaagcccaaatttagcatggcatttagaatccttcataaactggtatcaatctgtctttccaaccgatctaagtccacaatgatcctaactatgatttacaagggctgatatgatccacctcccttctgcccagccccaacctctctgatcccgtttctcctgctcttaccctcactcactccactccagccacactcggctctgtaacattcctcaaacatgcctagcatagtcatgcctcagggactttgcacctgctgttccctctgccttaggacattcctccccagacacccaatggcttggttcattacttcctttaaggttctgctcaaatgacatcttcataaagaggccttcctgatcactcacctcttccctcatccctttatcatgttttgttattctccaaagcacttatcaccatatatattccatgtatttatttgcttatttctctccccgactagaatgtaaagtatataagggcaaggactttgttctatttccactttctagaaaagtgacttcaacataggttatataattatttgttgcaaatgaacatatgaattccatgccttttcacattatcttctagtcacacaagaggctgcctctccatggctttaggccctgtgccttttgtgcctaatccccaaaactgggctgcccttttctcatactggcaaaattctcatccctgcagctcgaatgttgtctcctgtcaggccttcctcaatctctcctctatattctcactgcacttaatttattcttttattatgatgaactgtcttttttgttctttttttttttgagatggagtctcgctctgtcgcccaggctggagtgcagtggcgcaatctcggctcactgcaagttccgcctcccaggttcacgccattcccctgcctcagcctcccgagtagctgggactacaggcgcccgccaccatgcctgggttatttttttttttttttgtatttttagtagagatggggtttcaccatgttagtcaggatggtctcgatctcctgacctcatgatctgcccacctcggcctcctaaagtgccgggattacaggcatgagccatcgcgcccggcttttttgttctataattaacccacatctttttttttttgagacagggtcttgctctgtcccccaggctggagtgcagtggcgccatctccgctcactgaaagctccgcctcccgggttcacgccattctcctgcctcagccccccgagtagcttggactacagatgcctgccaccacgcctggctaattttttgtatttttagtagagatggggtttcaccgtgttagccaggatggtctcgatctcctgacctcgtgatccgcccacctcggcctcccaaagtgctgggattacaggcatgagccaccgcgcccagcctaacccacatcttaaaccacatgcactacatatttattttcctagataactgtgaactgctataacaaaaaacaaagactgctatcatctctgtgtcttcatgctctaacaacaaatctaaaaggatctcagtgtttactgaatcaatttattttctcagtccctactagttctagaagcgagtggagagtgtagtgtcctctttttatcagtgagcctgttatctgtgggaagggattatagcagaggtagccaaaactgattataaacaaggtcccaagcctgctatggcagtgagtactgcaagacttagacagtcagcaccactcaggcagaagaccaacatggagttcagtctatccaactgactacaatcagtataacgtgaacaactaagatttaaaaatgtgttctcatgtattcataaggacctcctagccctcacagaacagatgaagtgctatataaaaatttcacagaaaagagcctggaagcagtgaataggccatcagctgtaccctcatatcttaaaaggtagtatttctgtgacaacagcttatacaaatgggaaagccaaacctctcaagttttaaagttaaagtacaggggaagatctgtgaacaaggtttaacataattaaaagctagtgtccacattaagtgagcgactaggttacaatttgaaattttatcttcaaacccactgatccagtctctatctctcaccttccattccctatcttcccacctctgtctctattctttctccactactccatcacattttttaaaaaggagtatttactgtcagatttatgtaacaaagtgtacactcctcaagctaaatttggaaagaaggcaaatgaagcctctgtcctgtgggtgtcagtggctttccaaagataaaagcttcttcagtcttaaaatatgacaaatatcatgttctttctggcagagagatgccagaaaaaggcaactggatccttaagataaagaagctgttaagttctattttcaaaagagtaaggtaaatcttaaagcaggaacaagaaagcaccagcctttggcttaagttctcccatgtgaagaataagaggtggtggtatccttccccatctgtactcaaagcggaaaaacagcagaaatatcttttttttaattatactttaagttttagggtacatgtgcacaacgtgcaggtttgttacatatgtatacatgtgtcttaaatacatatgacaaaggggcaattccactggtgcactctttcttgttttgcttctaggggtccgtcccattcttaatctttgccctttcttgtctctttcacataactctaagactcagagttttttaatcttttcttctacttctcacttcttaaccaatatagaagacaaaaataacattttaattttatatatttctcattcaaattaaaaaagaaagatgagccagttcagttcatattttgcactaaaactaatttaacattccaaagttaaattatttgtgatcaacaaaaggaaaaacatcttaccctattagcaccatctgacattttcatcaccttagcatcattaaatacaacaggtctgaggttggaactataaaaaaataccaaaaatccccaaccccattcataatgcacaccacagttcaggtaagaacaaaaactcaccattatctttattttctttcaaaaacccattaacagcgtgtttgaatttaaaaatagtctcatcatcaggcacttgatgtccaactgtaaaaatttttaagtaaggaacagtttctggcaaatcctataaagcaaaaccataaaagatgtgtattatttcacttgtagagaaataattaaagagtaattaggggacccagaatataagccaagagattataacaaacttaatatgccaatatcagtatacacaattctgataaaagagccattttttccaacactgcttcaaccaggaagtatcacttgattttcaataaaactacataatagatagtcactaggtatacaaaactgaaagcaaattccatgtgaatgaatgcatatttaactataaattatataaacagttccatttaatattttataattcaagggccagtgccttcataaagcagctatgatttaagtagaagagtagagaatagagtcagaagaacttggatttgaattgtgagatagagggaattccaggcactattgagaaccgatattcttggggtgggagaaaagtagatacagataaaagacagaagaggctaagtcaaaatcattttaaccatccacaagtgtatagttcagtggcattacattcacagtattgtgtaaccatcaccactgtctatacccaaaactttttcatcatccccgacaaaaagactctgaccactaaaccataattcccttttctccccacctcatagatcctttagtctgctttctgtctctgtgaatttgtctattctaggtacttcatacaagtggaatcatatatttgtccttctgtgtctggtttatttcactaagcatgtttttaaggttcatccatattgtagcacgtattaaatctattcttttttatggctgaataatattccatttaagacagcaattaaaaacatgtaattagagaaatcacttggttctcttttaaacttactacccatcaaagaaggccaagcttcacattagcacaagatgattactgaattactataaattattttaggatcagaaggaagaaagttcttttcattgaagggttccacttacctctggtttataatagcgttgagtatatgttaaatcaataatcagtccaagttcttcattttgttctcggattttgttaaaaagatccaaaggggaaaagcattcttctggagcaagtttcttttcaaaactctgtcacagagaatgaaataagagcaaatatgtgcttaaaatcctgtactacattaggcatttattcaagtcctgtgatgctaacatacaacgagattcaaaggaaagtttccattctcctggaacatagaaggtatattacaacaatcctttcttccagagtggtcagaaagaaaaaaataagcccacttctatatatgtatttctgtatttgtttcatgttggtctcctaatcagactgtaatctcccagattttattcaccactgtatctccagctccaggtggagtgcttatcatatttagtgcttataaatatttcttttctttttttttttttttttttgaaacagggtgttgctctgtcatccgtcatccaggctggagtgcagtgacacaaacatggctcactgcagcctccacctcctgggctcaagcaatactcccacctcaacctcacaagtagctgggactacaggcatgaaccaccacacctggccttttttttttttttttaaagagatagggtcagctgggcgcagtggttcacacctgtaatcccagcactttgggaggccaaggcgggaggatcacaaggtcaggagatcgagaccatcctggctaacactgtgaaaccccgtctctactaaaaatacaaaaaattagccaggggtggtggcaggcgcctgtagtcccagctaccgggaggctgaggcaggagaatggcgtgaacccgggaggcagagcttgcagtgagccgagatcacaccactgcactccagcctgggtgacagagtgactccatctcaaaaaaaaaatttaaaaaaaaaaaaaaaaaaaaaaaagagatagggtcttgccgtcttgccatgtagcccaggctgatctcaaactcctgagctcaagcaaccctcctgtctcggcctcacaaataaatatttctcacatgtctacatatatgaaggatggctttcattgctgaatattcttttatgtatgtggcttatttttgaactttatgctctgttccttcaatctgtctggctactcaggtgccagcaatgtactttttaaaaaatagactagtttggctgggtgcggtggctcaagcctgtaatcccagcactttgggaggccgaggcaggaggatcacgaggtcaggagatcgagaccatcctggctaacacggtgaaaccccatctctactaaaaacacaaaaaaattagccaggcgtggtggcaggcgccggtagttccagctactcaggaggcagaggcaggagaatggcgtgaacccaggaggcagagcttgcagtgaaccaagatcacaccactgcactccagcctgggcgacaagcgagacaccatctcaaaaaaaaaaaaaaaaaaatagactagttttcagagcagttttaggttcacagcaaaactgagccaaaaggacagatagttcccacatgtactttgccttccccaacccacccagactcccccactatccacattccataccagtgtggtccatttgttacaaatgaagaaccaactctgacacatcgttatcaccaaagtctagaggttaggtatgcgtgattcattctatgttatgcattgtatgtacatattatgttatatatattttgccacaaaaaaaatgagagaaagaactaagttcaagttttgattcttccttttctgagcctgtttgattatctacaaaattatttattagatgtaaccatctattctctgagcttagtgcagaataagcactcagtaagagatattagtactactgctacttcatcagcacaggattgttgtgaaatgtgttaatatacgtgaagcccttttataggttttgatcaatatataacatgtatccacccttagagtatcacacagaatagtttcacttccctaaaaattccctgtgtctccaacaccttctttttggagacagggtcttgctctgttgcccaggctggagtacagtggcatgatcatggctcactgcagccttgacctcctgggttcaatcgatcctcccacttcagcctcctgagcagctgagactacaagcacacgccaccgcgcctggttaatttttgtattttttgtagagacacggtttcagtgttgcccaggctggtctaaaactcctggactcaagcgatacacccaccttgcctcccaaagtactggattacaaacatgatccaacaggcctggcctgaaatgactcatttttaagcccagacatgcagagaagctgacacagcagttgaaaaaggaaatctgatctataagtcacaaattaagtaaattcccaaaacgtttcaagtaggcttctcctgatactaatctgagctatgctggggaagtctaataagaaagacatggaatctagaaaacaattatttgtcttcaccttctcatcttttttatggctgtcaaaagctttcccctcctatccctcctattcctttcctagtttaaacaaaaatacaatcttcagattttccccactgaaatcctgaccttgatgatccgggggatatttctgattgtgaccatggaaggaaaggagtcccactggcattcagtgggtaagggttacaaattctaaacaacttgccaaattcaggacagtcctacaaatgtgtcccacatcctgaatggcttttggatgtcctattcaagattaatatagataaaaagctgttcatatttagcttggcctcagaacctaactccatttcacaaataaacacaaagtattttttgtacaatactaatatatattgaattttccaggataataatcaccttatcaaccaaatgaagattatactttgttatatttggaaatctattacagaaactcctaccactaaagcaatacaacccacctagatcagtctacatttgtaattcttgaattcatggcgcaggcaactattactctatgtcttttaatgtagtcatgtccaaacatttatatattgaaataaatattattttattataaattacttttattttattttttatattatagttagggtgttaattggtatttttgtttaaaatatgaagtaggttgtatgtacctatgaacttcatttcaggatagtaaaggggtcattacaaagtatttgctataaaaagagaaaatggaatgtgatagagtggagagcagtgttctgcatggtgaactcagatgcctgaaagaatactgaattaacttttgcttaccttttgcaaaggaactttgaaagcaatgaaacgagtcccaggcatccgctgtccaactgggagatagtctttccacctattagatatattttttgttagccaaattgtatgttagccttgtttccttgcacaaaataagactttttgaaaatgggaatcatagcccgcacaacatgtcctctctcctctctgctttgcatttcgccactccacttattaaaccccaccaagtaacgacctataccgtccttctctcctgtttccccatcataaaaacgaacacaagccaacacaacagtacaactcaaataaggcctatataaaaccggagatacccagaacttctgtatccctgttaaacttggcccagtaccagatactaaagtgccattaatacaaacatattcactgaaataatttaaattcaattatttcacttcacgcttttagttttcatacgactgatgccataaagttcaattagtaggaaacttcaagttcatattttaagagaaaacctgctagaagagggactgtgaacttcacttaataatgctaggaactggccgggcgcggtggctcacgtctgttaatcccggcaatttgggaggctgaggcaggtggatcacctgaggtcaggagttcgagaccagcctgacccacatggtgaaaccccatctctactaaaaatacaaaaaaaattagccgggtgtggtggcgggcgcctgtaatcccagcaacttgggcggctgagggaggagaatcgcttgaatccgggaggcggaggttgcagtgagccgagattggaccattgcactccagcctggcggagaagagcaaaaatccatcccaaaaacaaaaacaaaaaaacggattggaagaaaacaaacaggagattcactaattagaaccccactgcaataagtcaggcaagacctgtattagggtactgacagaaagtgacagtcaaaagatagtagataaaatgaagaggatttattgaggtatgagatggtggaggatggtctcaaggagtaaaaacagttcaatgcacctacgtgcaaagtctcaaaattaatcatttgtacgtataaaggagttatctttcaaatgaggcctgttaggaagtaacaaagtatgctctttgtgatttctggaaacaatacaaaccaactttccatgtgagatctcagggcgctactactgctgggttcctaactcaaaccattacactttccgtgccaacgtaacaaggaattgaggaggttccattttgggaattaaggagtgtccccaacagtaacagtcccaccttaaagcaatccttccgtattttacctaagagcaatggccagaacctcccttttacaagaatatggagaaatcacaggacatcacagacatcgcccctttcagctacagcgggtggcgcagagggtcaaagcctcaaagcaagcggcggacaagtcaagcttgcgatggcaacggcgagaggcagagaccacaaacgatgaagcccagacccagaagccacgagctggaaaggccacgccaagggaccaagacatactacctttcggggatgtggtttccgcccttcttcttggctgaggagcgtcctgaaaagtcgcgtctccggccccagccactgcggggatgatgccactggctcatgtgggtcccaagaagccgcccacccaatgccaagtcggccaaaagcgccagtccggcgccctcaatgccaggataagaccctaaacaggaaaagactcggcagccacctacgccgcgctccagcgtctcgctattgcgcatgtgccaccgccggtcgtgatggcgtagccacgctggcttactgagactcctgatctgtaaacaggactttggtggctacagcgccctctttagccagaggccagtagcacaggtcaataagggcgtgtatgcacccttcagaattcaaacagtgaggcacagggaagtccctctgcccgatccgccccacgccccggttccttgtgtgttcttctagatatttaccagcgcttacattcacattttgcatattttgtatacatatttactttcacatatatgtatatcctctatttttatacaaaaggagtaactgtacatattctacagtataccttaaacactgattatcccagtcaatttatgcatacatagattctatttttaatggctataggcaatttacttgcttatgagtaacataattaaaagtaccataacgtatttagccagttcaatattaatggacctttagttgttttcaggttcttttcaaatcttgttacagacaatgctgcaatgtgaacatccttatacatatatacaactatatctaaattcctagaagtagaatgtctggaatgaaacacatacaaacttaaaatttggaaagatactacctaattaccctccaaaaataatgtagaaacatacactcccatcaaagccaaacttttattgggttcctatcacataccaggtatcatgctagaggtggacagaatgtatttaagttttagcaaatacaaaaaataactgagagtggagctcaagtccaaggtttccacacagtctcaagcataaagatctgtacccgttagaaaaacgttcaattctgctaaaagtggaactacaaaggacagcataccctatagcagctttgaaaatagaatagagtactaaattccagattaaactgtaagtaattatgattgcagactttttttttttttttttgagacccagtctcactctgccaccaggctggagtgcagtggtgccatctcagctcactgcaacctccgcctcccgggttcaagcaattctccctgcctcaacctcctgagtagctgggactacaggtgcatgccacgactcccagccaattttttgtattttagtagagacagggtttctccatgttggccaggatggtctcgatgtcttgacctcatgatcagcactcctcgacctccgaaagtgctgggattacaggcttgagccaccgcacctggccaatggcagatttttgaaagtaatttttacttcttagtttctaatttatgaaagtaacttacatatatttttagtaatctttgcaaccatttcagagctgggtaaaccaaggataagaaaggtcagagctattgaataaatgaatattaataaagctagactgctagctttattaacatttttgagacagtacttttccaaccagttttaaatacataaacatttacaattctgaaaatttccacatcattaaaaatgtgtcaatattcataaattgttcattggaaaaagaaaaagacaggatagcagaacataacaaacctacaattaggaacatttaattatttgttgttgttgttgttgagatggagtctctctctgtcacccaggctagagtgcagtggcgcgatctcagctcactgcaacctctgcctcctgggttcaagcaattctcctgcctcagcctcttgagtagctgcgactacaggcgtgtgccaccatgcccggctaatttttgtatttttagtaaagacaaggtttcaccaagttggccaggctggtcttgaactcctgacctcaagtcatctgctctcttcggcctcccaaagtgctgggatgacaggcgtgagcccctgcgcccagcccacattcaaatttgacattaaattgtaaaatattgtggccgggcatggtggctcatgcctgtaattccagcactttgggaggccgaggcgggcaggtcacttgaggtcaggagttagagatcaacctggccaacatggtaaaatcctatctctactaaaaatacagaaattagctgggcgtggtggctcatacctgtagtccagggtacttgggaggctgaggcaggagaatggcttgaacatgggaggcggaggttgcagtgagccaagattgtgccattgcactccagcctgggcaacagagcgagactctgtatcacgaaataaataaataaataatacaatgtttttctgaaatgcatgaaaaattccaataggtgtatagtagcccaaaactacaaatgttacaaatgtctatagacatgacaagatacaaaacgtgacataaatctttcagaagctagaaaagctgtattgggcttacactttcaatttgctaaaagacacaacattggggtgagaacaaactcagttatagttgacacaagaaaatccagacctaggcggaatagggttcctagaaagtaaccagacatactaatgaataacataaatgaggtaatatgacataaaacataatggaaaaagaatattatgattattttcttcagtgtacagaagtaatggaagttctggactagctacataaaaaatattaaattctatgttctattaatacaaaataagtgtgtcgaattgtttgtcacataaaccaaaaaatccacacaaatctctttttccctgtaccctcaacttgcctgtttcctattctccactaaatgcttaaattcttcattttgcctagcccttgcacccaagcatggctgacaggatatcccaaaggcccaagattctatagtggctgtttgcaagagagaggaggctaaaagtaactgccatactggatccccttatgtgagaagaaagaaagtatcctgaatgcttctcacgtataaaagagcaggatggcagggtgtctgtgtggcccaaggagccagaggtagcaaaccatgggcaaaagaaatgtgaccaaaggctagaagagggaaggtctgcagtcagccttgtcttctacctctctggtgtttgcttctcataagcagagtccgtattccaaacatccggacactgaaaagaagactcctgctctggaagttgacaagaaggaatatccacaaatgtaaaaatgcaagatcaaggcttggcccagaaacgatgcctaaaatcaaggggttaaaaaaaggagagcagaagagagatccaagtccaacctggcccagcccaaagaaggtaggattcaaggagaagaaactaaaagagaagagccttggaccacatcctttcctacaatgggcagtcaacgaactttgccgttcaaccaagttacaaaagaaggctctttaatcccttctttggcccttaaaagcggcagcagggccgggcgccgtggctcccgcctgtaatcccagcactttgggaggcaggggaagaccgatcacgaggtcaggtgatcgagatcatcctggctaacagggtgaaaccccgtctctaccaaaaatacaaaaaattagccaggcgaagtggcaggactcaggaggctgagtcaggagaatggcatgaacctgggaggtggagcttgcagtgagccgaggtcacgccactgcactccagcctgggcgacagagccagactccatctcacaaaaaatacaataaaattaaaaagcagcagtaaattcattaatcagattcactgaaatagttttagaacaactgtaattgctcaacttaaacatccctttcctttctccccaaggatattgtgtatgtactatataattataaatgcatactattacatattatgaaatgtaacatataaaatataaatgttagttaattatattagtgaacatttatgagaaacattgagatgatctccctaacatgagagcctgggggaaagtgggactatcatgtctgtcttgcagatttcacctccccagagctcagccacttagtgctgttacacctttcctaccacctctgccagccaatcctgtcttgtggggaatctgacctccctattggctatcgcagacctttaaactgcctgctttgtgacatcattctcccaccaaaccgaccaccacctggtagcatcttggggtttcctgggcgtggcctgtaaatttgtatcatcacaaggggccagtgaccagtaaccagtgaccagtggccttcatactggacacatgcactggttggcttcagccacccagacatccgctagtatcgtctcttcttcccttctatctgcagttgatgtttcttcttctctgaccatgtcaggtaaagagagaaactttttaaaaaggttttcatgagatttctttgccactaaatttagatttctttccccctatattcccaaacagcttggaataacagggaaagtattgaagtagaaatccagagacctcatttcagttttggctttgacatttactagctgtgtgactttagataacttttattctctcacaaaatctgtttcctcatctattacactaggataatagactggttattccccctggcccttttcttttctaatactgagtcttaaagggtatacgtatagaaaatgaaatcagagactttctgagagtgttcatttcaacagaaacagagaaaaaaccaaagtggtctagaaaactagcaatatattctgagatgtttcatgtgtaatagcctccctccactaatatttcaactttcgtattttaaatttagtgatgtttagtgatgttttaaataatattcagccaggcacggtggctcacacctgtaatctcagcactttgggaggccatctccctcactaatatttcaactttcctattttaaatttagtgatgtttactgatgtgtagtgatgtttttaatattcagttgggcgtggtagctcatgcctgcaatgtcaatgctttgggagcctgaggtgggaggatcgctttgggcctaggagttcccggccagtctgggcaacatggcaagaccccatctctacaaaaactttttaagactcagccagggttgggtgtatgccagctacgcaggaggctgaggtgggaggatcagaggactgcttgagcccaggaggctgagactgcagtgagccatgttcataccactggacttcagcctgggtgacaaagtgagaccctgtcacaaacaaacaaacaaacaaacaaacaaaaaagaaaagtagtattcacgttttggacattcctatctaaactaggtggaaagagaaaatggagagtactgggttctaaggaggcaggtattctagggtaagtaatttggtattttaatttaagcagaaagacatggtcccctacttttccccttgggatatgccctggagaatgacaaaatgattttaaaagaaaaaaatatattttaaatttgaaaaaaaaaagcagaaggacaacagagtgaaatgtattcagagtagggcaaaatgaagttgattttagcaaatgcttagatcaatggacgaggaaggaaacaggctacattacatatccctaggaaaagcagcttatcagaagtcatattcagtcacttttttctgttgcctttttgaacatagatgacacttgacagtttgtaatataaacattttggaaatatgttttagaggccaggctcggtggcttacacctgtaatcccagcactttgggaggccgaggtgggctgatcacctgaggtcaggagtgtgagacaagcctgaccaacaaggagaaaccccacctctactaaaaataccaaattagccgggcatggtggcacatgcgtgtaatcccagctacttgggaggctgaggcaggacaatcacttgaacccgagaggcaaaggttgtggtgagccaagatcgcgccattgcactccagcctgggcaataagagggaaactccgcttcaaaaagaaaaaaaaagaaagagagaaatatgttttagaaatgaggcttccaggcagggtgcggtggctcacacctgtaatcacagcactttgcaaggctgacgcaggcggattgcctgaggtcagaagttggagaccagcctaggcaacatggtgaaaccccatttctcctgaaaatataagaattagctgggtgtggtggcgtgcacctgtaatcctcctacttgggaggctcaggcatcagaattgcttgaaccagggaggcgcatgatgcagtgagccgagatcgtgccactgccctccagcctaggcgacagagcgagactccatctaaaaacaaacaaacaaataaacaaacaaatgatcaatgcaggtatctctaaaagcttaccaccaaggaaaatgattatatccatagatttcctcccccaaaccagcttagtccacacgtaaatcattagcaactcagccctaactcattttatcacagttacaagagaagttagtgagaaaagcactaactaggaaaatgaaaaccaaggcaatccaagtcaacttgggctcactgcagacatctgttccttatgcttgggcacacagcacaactcacaacagtgcctttttcacagacccctctttaatttcctccacaaaacccatcaggtcaccatagttcatgatgtttcaaaataaacaaccatcatgagaaaaacatgcagtatgtcttacaatcttgtattccttaaaaatatgacaaggaaaaaacatgtagaaaaaccagaggatttaaaagcaatctacaggccacgcacggtggctcacacctgtaatcccagcactttgcgaggctgaggcaggaagatcaaccgaggtcaggagtttgagaccagcctggacaacatggtgaaaccttgtccttaataaaaatacaaaaattagccagggatagtggcggcacccgttatcccagccacttgggaggctgaggcaggagaatcacttggaccaaggaggcagaggttgcagtgagccaagaccgtgccactgcactccagcctgggcaaaagagtgaaattctgtctcactcttataaataaaataaagttaataaaacaaaagcaatttacattctacagacatactaatgaatgacataaatgaggtaatacggtataaaacaaaatggaaaaaatacattatgattattttcttcagtgtacagaagtcatggaagttctggactatctagctacataaaaaatattgggccaggcgcagtggcacacgcctgtaatcccagcactttgggaggctgaggtgggcagatcccaaggtcaggagaccatcctggctgacacggtgaaaccccgtctctacaaaaaaatacaaaaaattagccgggcatggtggcgagtacctgtaatcccagctactcgggaggctgaggcacgagaatggtgtgaacctgggaggcagagcttgaagctagcagagatcggccactgccctccagcctgggtgacagagagagactctgtctcaaaaaaaaaaaaaaaaagaattgtctattttgttaatacaaaataggtatgttgaattgtttgtcacagaaaccaaaaaatccacataaatctcttttttcctgtaccctcaccttgcctgtttcctattctccactaaatgcttcaactcttcattttgcctggcccttgcacccaagcatggctgacagaaaatcctaaaggcccaagattctatagtggctgtttgcaagggagacgaggctataagtaactgccacactggatcctcttatgtgagaagaaagaaagtatccagaatgcctctcacatataaaagagcaggatggcagggtgtctgtgtggcccaaggagccagaggtagcaaactgtgggcaaaagaattgtgaccaaaggctagaagagagaaggtctgcagtcagccttgtcttctacctctctgctgtttgcttctcatgaggagagtccgttttccacacatcgggacactgaaaagaagactcctgctctggaagttgacaagaaggaatattcacgaatgtaaaaatgcaagatcaaggcttggcccagaaacaatgcctaaaatcaaggggttaaaaaagggagagcagaagagagatccaagtccaacctggcccagcccaaagaaggtggaattcaaggagaagaaactaaaagagaagagccttggaccacatcatttcctacaaggggcagtcaacgaactttgctgttcaagttacgaaagggggttctttaatcccttcctctggccattaaaagcggcagtggggccaggcgcggtggctcccgcctgtaatcccagcactctgggaggcagatgcgggcggatcacgaggtcaggtgatcgagaccatcctggctaacagggtgaaaccctgtccctactaaaaatacaaaaaattagccggctgaagtggcaggcgcctgtagtcccagctactcaggaggctgaggcagtagaatagcgtgaacctgggaggtggtgcttgcagtgagccaagatcacgccactgcactccagcctgggtgacagagccagactccatctcacaaaaaatacaataaaattaaaaagcagcagtaaattcattaatcagattcactgaaatagttttagaacaactgtaattgctcaacttagacatccccttcctttctccccaaggatattgtgtatgtactgtataattataaatgcatactattacatattatgaaatgtaacatataaaatataaatgttaattatattagtgaacatttatgagaaacattgagatgatctccctaacatgagagcctgggggaaagtgggactatcatgtctgtcttgcagatttcacctccccagagctcagccacttagtgctgttacacctttcctaccacctctgccagccaatcctgtcttgtggggaatctgacctccctattggctatcgcagacctttaaactgcctgctttgtgacatcattctcccaccaaaccgaccgccacctggtagcatcttggggtttcctgggcgtggcctgtaaatttgtatcatcacaaggggccagtgaccagtaaccagtgaccagtggccttcatactggacacatgcactggttggcttcagccacccagacatccgctagtatcgtctcttcttcccttctatctgcagttgatgtttcttcttctctgaccatgtcaggtaaagaaagaaacttcttaaaaaggttttcatgagatttctttgccactaaatttaggtttcttcccccctatattcccaaacagcttggaataacagggaaattattgaagtagaaatccagagacctcatttcagttttggctttgacatttactagctgtgtgactttagataacgtttattctctcataaaatctgtttcctcatctattacactaggataatagactggttattccccctggcccttttcttttctaatactgagtcttaaagggtatatgtatagaaaatgaaatcagagactttctgagagtgttcatttcaacagaaacagagaaaaaaccaaagtggtctagaaaactagcaatatattctgagatgtttcatgtgtaatagtctccctctactaatatttcaactttcgtattttaaatttagtgatgcttagtgatgttttaaataatattcagccaggcacggtggctcatacctgtaatctcagcactttgggaggccatctccctcactaatatttcaactttcctattttaaatttagtgatgtttactgatgtgtagtgatgtttttaatattcagttgggcgtggtagctcatgcctgcaatatcaatgctttgggagcctgaggtgggaggatcgctttgggcctaggagttcccggccagtctgggcaacatggcaagaccccatctctacaaaaactttttaagactcagccagggttgggtgtatgccagctacgcaggaggctgaggtgggaggatc

SEQ ID NO: 426 - DNA, 33863 bp, Homo sapiens
cgcgatcccagaggctgggcaggggtcgacatccgtggctcggcagctcgaaaaggctcccgcgtagagctgctcctgctggagatcgcggacccagagacccgccctctccgcgtcagtctctttgaccgagcggctctaccgttgagacggcactcaccccacgaatatcccagtacccgagaaccatagacgactcgcacgacatggtgacgggcttccgagccttcgaggactagggaaactgtgagcgggaggggctttatacccgacataagggggcggggcccacgcgcgggcgccctgactccgcctccgccccgttctccgtcccttgcctccgcggctccacagggccgtgcgcaggcgcgactaatgccggcgttggggttcagggcctggcgaccccgaggcgggacccgggcaggagtgctgcaggagagcaaaggacccgaggttgaggctcctcccttccccgcgggtgggagccagacttcattcattaatggtgccagtgaagacgcgaaaagcaccactagccaggcagtggggaccctagttacccagggagagcgagattcgcgccgtttttaccgagccagccggggctggatgaaggataggaagactggggcaaggccggagagtcagaccagcctctgaccacacagagcagaagattccccacagaccaagctcccctctctgtcagtcaaggacctctgcaacctgaccccaacgtgcttttccagtcctgtctctccctcagcccgtcacaacttcataagccagcccaacccaacaatacttgctgttccttctacacacacttgcatttcccaccttggagtgtttgctctgtgatcctcctacctgcatcctaatttccacagcctatccttcctcagcagccttgctgaaatgtctgcctattccttgaagccttctcagaaccaacctctatcctggccagaagaggtctcttatcttgaatgtttcctacctttgttttatgggcttaagtaatttatggattccttattataatttcctcctccaatccctcccacttcctaatgctcacgcatttagggaaattaatcttgcctctttgtgtaggatggactggaggaggaaaggtactaccatttttcattcactcattcatctgtccaacaatgtttaacatgcctgttatggacaggcactgttttaggtgctggggatacagaactgaactcaacagacaaaatccctgccctcaggaagtttacattctaatggggaagaaataaactaatatatagtaaatagctagtaagtcaggtggtgatacacatcctatggagagaaataaaatcgagaagagagatagggggtctcagggtgggaactgggggagtcccagtaggaaggggatttatgtttttaaaggttatgttcatagaaggcctcatggagaagttaatctttaaacaaagacctgaaggaggtgagagatcaagccactctgctgtgggggccaccatgggctgatataaatataaaacagaataattgctgttccttttacaagcatgtttgctctgctcctgcctgcaccctaatgtccatggcctagccttcctcaagtagccgtgctcaaatgctcacttcttccttgaagccttctcagaatcaccctctatcctggccagaagagttctctccctctcttatctcgaatcacttcctacctgcaggaggcagagagaactccaggaaaagggaaacagcaagtacaggagtgatcactctgtgtttgaaaccagagactagatgagatcaccatgggagcacgagtagcagagatgaggtctaagggtttgaggtgctctggcatatcaacatgtaaaggttagggaaaaatgagagcaaaccagcaaaggagtctgaaaaggagtggccagggaggtaggaggaaaacaaaaggtcccagaagccatgtgaagatgtttaaagggagaagtgatcaactatgtcaagtgtggctgatcaagtaagatgaagatggagaatcaatggttgaatttaggaaagtaggggttttgaccttgacagagcaagagacctgcccgaggcccctatagtcatgggaagaactaagcttctgaatttcggcagggcccatgcaaatgaaaaggggcacagatttgcaacagggtcaactcgggagacataggattctagttgaatgtggaggagtgacagaggaaggagtccggagctgctctgagggttctggccaggcctctgcagcacagctctcagggcagtctgagagcctagatcccctagctcaggtgtgggaaatcacatttgcccatcagttcaactgaagcaaggttgggactttttaaaagggcattttgctaaacagaagaaaggaagagtacaaaccacatggacaggtgaaatttataatgcctgtgtctctcctcccaagaaagcaaaaggccagtcacaaattcacctgaggtataagattaacatttattgagcacctatcatatgccaggcaatatctaagtgtttacgtatgttagctaatttattccaatttaagcttcacaacaactttaggaagtaggtgttatgcccattttcttttctttttctttttttttttttgcagtttttgcattactttcttttttttaaattttattattattacactttaagtttcagggtatatgtgcacaatgtgcaggtttgttacatatgtatacatgtgccatgttggtgtgctgcacccattaactcctcatttaacactaggtatatctcctaatgctatccctcccccctccccccaccccacaacagtccctggagtgtgatgttccccttcctgtgtccatgtgttctcattgttcagttcccacctatgagtgagaacatgcggtgtttggttttttgtccttgcgatagtttgctgagaatgatggtttccagtttcatccatgtccctacaaaggacatgaactcatcattttttatggctggatagtattccatggtgtatatgtgccatgttttcttaatccagtctatcgttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatgttgaactagtttacagtcccaccaaaagtgtaaaagtgttcctatttctccacatcctctccagcacctcgtttcctgactttttaatgattgccattctaactggtgtgagatggtaactcattgtggttttgatttgcatttctctgatggccagtgatggtgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgtgaaaattttctcccattttgtaggttgcgtgttcactctgatggtagtttcttttgctgtggagaagctctttagtttaattagatcccatttgtcaattttggcttttgttgccattgcttttggtgttttagacatgaagtctttgcccatgcctatgtccagaatggtattgcctaggttttcttctagggtttttatggttttaggtctaacatgtaagtctttaatccatcttgaattaatttttgtataaggtgtaaggaagggatccagtttcagctttctacatatggctagccagttttcccagtaccatttattaaatagggaatcctttccccattgcttgtttttgtcaggtttgtcaaagatcagatggttgtacatatgtggcattatttctgagggctctgttctgttccattgatctatatctctgttttggtaccagtaccatgctgctttggttactgtagccttgtagtatagtttgaagtcaggtagcatgatgcctctggcgttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgatgttgtatcctgagactttgctgaagttgcttatcagcttaaggagattttgggctgagacaatggggttttctagatatacaatcatgtcatctgcaaacagggacaatttgacttcctcttttcctaattgaatacccttcatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatacgtcccatgaatacctaatttattgagagtttttagcatgaagtgttgttgaattttgttagaggctgtttctgcatctattgagataatcatttggtttttgtctttggttctgtttatatgctgggttacatttattgatttgcgaatgttgaaccaaccttgcatcccagggatgaagcccacttgatcatggtggataagctttttgatgtgctgctggattctgtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtgccagctcctccttgtacctctggtagaattcggctgtgaatgcatctggtcctggactttttttgactggtaagctattgatcgttgccacaatttcagagcctgtcattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctcttttcttctttattagtcttgctagcggtctatcaattttgttgatcttttaaaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgtcgtgtctttgttctcgttggtttcaaagaacatctttatttctgccttcatttcattatgtacccagtagtcattcaggagcaggttgttcagtttccatgtagttgagcggttttgagtgagtttcttaatcctgagttctagtttggttgcactgtggtctgagagacagtttgttataatttctgttcttttacatttgctgaggagtgctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgttaactttctgtctcgttgatctgtctaatgttgacagtggggtgttaaagtctcccattattattgtgtgggagtctaagtctctttgtaggtcactcaagacttgctttatgatctgggtgctcctgtattgggtgcatttatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttgttttgagcctatgtgtgtctctgcatgtaagatgggtttcctgaatacagcacactgatgggtcttgactctttatccaatttgccagtctgtgtcttttaattggagcatttagcccatttacatttaaagttgatattgttatgtgtgaatttggtcctgtcattatgatgttagctggttattttgctcgttagttgatgcagtttcctcctagacttgatggtctttacattttggcatgtttttgcagtggctggaaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatgttggcccccactctcttctggcttgtagagtttctgcggagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataacatcctgcagagtgttttccaacttggttccattctccccctcactttcaggtacactaatcagacgtagatttggtcttttcacatagtcccatatttcttggaggctttgttcgtttctttttattcttttttctctaaactttccttctcgcttcatttcattcatttcatcttccatcgctgataccctttcttccagttgatcgcatcggctcctgaggcttctgcattcttcacgtagttctcgagccttagctttcagctccatcagccccttttaggacttctctgcattggttattctagttatccattcatctaattttttttcaaagtttctaacttctttgccattggtttgaatttcctcctgtagctcggagtagtttgatcgtctgaagccttcttctctcaactcgtcaaagtcattgtccgtccagctttgttccgttgctggtgaggagctgcgttcctttggaggaggagtggtgctctgctttttagagtttccagtttttcagctctgttttttccctatctttgtggttttatctacttttggtctttgatggtggtgacgtacagatgggtttttggtgtggatgtcctttctgtttgttagttttccttctaacagacaggaccctcagctgcaggtctgttggagtttgctagaggtccactccagaccctctttgcctgggtgtcagcagcagtggctgcagaagagcggtagctgtagaacagcggattttggccacccacaaatgctgctgcctgatcgttcctctggaagttctgtttcagaggagtacccggccgtgtgaggtgtcagtctgtccctactggggggtgcctcccagttaggctgctcaggggtcagggacccacttgaggaggcagtctgcccgttctcagatctccagctgcgtgctgggagaaccactactctcctcaaagctgtcagacagggacatttaagtctgcagaggttactgctgtctttttgtttgtctgtgccctgcccccagaggtggagcctacagaggcaggcaggcctccttgagctgtggtgggctctacccagttcgagcttcccgcctgctttgtttacctaatcaagcctgggcaatggcaggcgcccctccccaagcctggctgccgccttgcagtttgatgtcagaccgctgtgctagcaatcagtgagactctgtgggcgtagaaccctctgagccaggtgtgggatataatctcctggtgtgccgttttttaagcccgttggaaaagcgcagtattagggtgggagtgacccgattttccaggtgccatctgtcacccctttctttgactaggaaagggaactccccgaccccttgtgcttcccgagtgaggcagtgcctcgccctgctttggcttgcgcacggtgcgctgcacccactgtcctgcacccactgtctggcactccctagtgagatgaacctggtacctcagatggaaatgcagaaatcacccgtcttctgcgttgctcacgatgggagctgtagaccagagctcttcctattcggccatcttggctcctgtgttatgcccattttctagaagaagaaacaggcctggagcagttaggggagttgctcctctaagcttcaggtcccacagatggtctgggattcaaacctagatctgtctaataatgcagttggtgctggttttcctgcacttggccatctgaacagcctcttgccacatggcagtcttcttgggaagtctggggaacaccaggtgaaaacacttttttcggatcctggacggtttctctgtttctaggctcctttagctctgggaggcaacagagggtgatgggttaatacctcctcccccatcccaagaaattaacttttctgggtaacttttgcccttgacaagtcacacccaaaaagggtctcaccttttctctcttttgtgagggaaaattgttgctttcctattctgttaacagctatgagagatgattttctgaggccaggaacttaagggaatgacataggctgtctaaaaatagggcagtctggggcccagacaatgttagggtcatggacacattcaggtaagagagatttaagggaacatcttaagaaccctcaaatccataagtacattgggccttatctgttgactaaatcaataaaagtatagctactggtatgtagagaggggactccactgagattaaagaaagctacttttactgaaaaatgtaagaagctatggacagtccaaactctttgcttaacccttgagaaaacagggacccaaagagtggaatgacttgctggagttcacccagccaactggtgcaactgaccaaagcctacagctgtcggtcctagtgcactttgctactgtgaagtggtgtgcctgcagctgtgctgggtgccttggaatgtactgagagacatgtgtgtgcaaaaaagatggtgagcatagctttattttgcagtttgtttagaaagagagtcaggagagcttggaccttaattctcaaattctgattcccagctccaggttgctgtgtgaatgtccactcacattcaaacaatctggctcagtgatggatataggcttgctgctgttttcatgccaaatgtcccagcccttcctgcctccctgcctttggtctccctcaggcccagaagaagctgcgagggaggcacatgacaagcttgaagatgcttttattgagaaggagagggactgaacagattcttgacaagcctaggcataaatgctccaggtttgggaaagaggtaaaataaataggtggttactggggaggctccaacacagccagaagggacactgtttgcttcagcctctgggcctgtccattgtttttgctgtgtgagctggggtgtggggtttgctgcaaactgggatccagaagaggaattctcggggctctaatgggtatcagatctgccatcttgcatcagcggggcctggttcttggaggtgtctaagctggtgcctaagggcttatctgaggaaagacaaagattcagatgaggctgatggcaggtgagggatctgcagagcttatgccaccaataagcttggagcctcaaggtaagcctgaatgcatgaagctaagcccctgggggaatatcctgtgcccagcacccgccacactcagttctgccccagggctgggcctgcaggcttttccaactggccctctctctcacccaggagcaccagacactcccaatggttgtcaggaccccagggtgtcctcacccccagcatccttctgacagcctccagccgggacaggattcgtggggcctcctgtggacatagcatctgtagctccccaggtcttatgcgaagtagctggctccccgtcagggacccaagtgtcctcaccgtgctgtgaacaaaacagcaaaagccatccgtggtgggctggaaggaccctgggcctgagcgtttgggcagagacagggctctttgggctcggaggttggggttacagaaaaattcatggagtaggctatctgagattgaaggagtaaagtcagcatttggcttcagccaatttcagaacttccagatttgaaagaagtgctctgggagagaatcttctggctggggaggggcggctaagctggcagctggggttcttcccgagtccactcccctgatccttgctgcctttgccacagcagagctccccacttaatctctaatctaggcttggacacgcctctgctctgtcctctaactcagcagagacggtgctggatcggggtcatgtacaatgtaggccaggttgtatgttctgggtctctgggtttccttggttagccctttacaaagtttctccctccatatcctgtagggccaggcactcacgcagtggagaagttctctgcctgcagccagtctgtgacctcttcaggcctcgagctaagtcgaagcattggaacctagaatcagggggaaccagggatcagagtccatctcatctcacagccaaccacagcccctaacatctgggtcccttctccaggttcccatcaaatcacttctcttactctgtggctttctggtctggcagggagctggtcttgttctctgctctggccccatgataaagttggcacactaagcatgcaataatacggtccgaatcaaaccaagactatctcctctgcttgccactgaatcctccccaccccgacctccaactcaagacttagggctctggatagtccaggctgggtagtacccgagagggtgactggccctgggtcccaggggtccccggctgtaggggctccaggatgttgcttggaatgtagccgctccgtcccgcctcattcttcaccagccaccaccgcttgctgtggtccagaacctgccaagagtcaccacctcagtcccctgagcctctttccagccagccttccctccccacacaaggctttctccctccagctctttcctaccctccttctccctctctaggccacccaccttggcagctccatccctggaccatccacccttggctgcctgtagctcccaccaaccaccacctccttttctagcctatggcccaagcctcacctccagcttctctccctggaccacagtcagttcccgtgggttcctagcttcaaactcgtacaagacttgcattttcagggctggctgggcaggtttggggctggagggcctggagttggggtccccaggctgagggtcatggttgtgtgtcttctcctgaggaaagtgtgaggtgctccctaacctatgacttccccgcctaagaaacagagtcaggatggctggagaatggggcctcagaaattaagcctatgtcccagccctgagattcccctcaggtatctccggcctgcagtctgatggtgacttttgggtttctttagagtttgctggcaggtcagtgttaggtggggctttctgcaggcaggaggggtctgaaatgtcattgatttctgaagacatttccgggagtggaattttctacatctgagttctgccctaagcactttatacttgagtatgggaaatcagaagcatgtgtgggtagtatcatgagaagaagcaatgggagcctaggagggtagaacactgtttttcacccaaggtaggagagggatgtccttgtacatgtttttctggctaaaagagaccctcttggctctcttaagatgtagagagccagagatccaaaggaacagccctgtccctccctccccaggaccacgcagtccctattaagctcagagcataccgaagggaaacagggtcctggtatcctaagggtgcctgtaagggacagaacagagagtgagtaagagcaggaggcagccagcatggtgggagggagctggggtatccgaccacaggcataagcagctcacacacagctgcctcctatcccctttcctgcctcccccagtttacagatacaggtacccacatgcacccacccacccactacttggagatggggcctcagaaattgagcctatgtcccagccctgagagtcccccagaatatctcctgtttgcagtctggtggtgacttttgggtttccatggaatttgctggcttgccagtgttaggtcacactagttgtgtgaccatggtttggatggggagggcagaaactagccagggactagggctgtgggtagggctctatgccaagctccccttacttggctggagggctctggaagttgccagtcatctgagaatgtgggttggtagggcaggggctcatcgcctgtccagtcggccctgaagagggaaacaaagctgagttcacatccactctgtgaactctgatgccaggctgtgggacgcggacagggaggggacgacagggcctagcctcaggaatcttttggctaataggtgacatggtccatgtgcacagatgaaaggccccaggacacccacaaaggagcaagcagttaagcctggacacatcccacggtgcaggtgtctgggggtcaacctcacctctgcccatgaggtaaagatacaccacctccgtaagaacatgatggacacttcattgccctgattgggcatttggattaaagtagtagaactacaagagcttttgggctggccaacaccccaggggtcttgtgcagtatttttctaggctgtttttagtttcccagcagcagatccttttctttctagctaaattgtctgtggatttccacccagtgaagtagacagcagccgagctgctcctgttgactgactctgggatgggctggtccttgcctctcagcctccccctcgcccattacacagggcccaggaggaccatgctgtttgtggccttcaggcttgccctgcttggaatattttccacttgtctgcccagggaatgcccattcatttccttgaagacgttcccctccttgcttcactggggcagaagtaaatattctgctgaacttggtacatccctaggtattgctcttctcacactgcattgctcatgattcttagctctttgtttcttactatatatagatttccttgggggctgtacccctagtacagtggctgatacataggagggagctattaagtgtttattcaatgggaacaaaggaatgattccctcttctcaattttcttaattgtttccttctgtgccttagaaacatgcttgggtcttgaccctaatactactccgtataagctgtcatcctattactttcttcttaccaaatttcttgagaatgtgcctatatcctctgcctatatattcttgtctctgtttctttcattatttctgcaacctggtttctacctctgccattactttattgaagctagtccatttaaaatcctgattgccaaatccaatggccttgtatggtctctgtccttctggatgaccacaacatttagtgttacttatagctttgggtcaatttgccaaaaatcaagttatctaaatataatttgcttgaaattcaactcttttgagggtttttacatttctttaggtattctattttctatgtttctgtctttcatttatttctggttatgttaagaaactaaaaaacatctaagggcacatctgacaatattacatttaaaagtatttatcaattgtacatcattttatgaatactgaagttgttttgcatcttcgtgggtatttaaaaaataatatgtgctaatctgtttttctaaggactcaaattgtagaagtaaggctgggttttgaaacacaaaatggtgtattcgacctggttattcaatgttaaagtggctgaatgaaagaacttgaggccctcttgtttgagtctattgtagaacctctgttttcctctcctgctagtgctagacagataccagagctattcccacagacagtgggagcccagcacagccctaggaactgtgagactggcttattcaggtactcttagtcccagggttttggacaagggaactctggtatgagatgggaggtccagaactgataagtaatttcattttagtgactgcacagacagtgcataaaaatagattgttatgggtggaaacaacccatctgtccatcaacagatgaatacataaataaaatgtgtcatacccataacaatgggatattatccagctataaaaaggaaggcagttctgatagatgaatgaatcgtgaagacattattttaagtgaacaagccacatacgacaggacaaatattgtatgatttcacttatatgaggttcctagaacaggcaacatattctcatagagacagaaagtagaatagaggtttccaagggttgaggagtgggtaatggggaattattgtttaatgggtacagaatttctgtttgggatgatgaaaaagttcttgaaatactgtagataatggtgttggtggcacacattgttaatgaacgtattgccactgaattatacacttaaaacggttaaaatgataaaagtggttaatttcatgctatgtatattataccataataaaaaatagatagttttgaactataattcatgtcttcagacaaactggacacaaaattttgtaaatggggctgaattgaaaagaactggtcatggcggggtgcggcagctcacggctgtaatctcagcactttgggaagccgaggtgggcggatcccttgagctcaggagttcaagaccagcctgagcaacatggtgaaaccccatctctacaaaaaaaatacaaaaaatagccagacatggtggtggcacacaggtggcacacctgtggtcccagctattcgagaaggtgaggtaggaggatcgctggagccaggaggtggaggctgcagtgaggtgagatcatcatgccactgcactccagactgagtgacagagcgagaccttgtctcaaacaaaacagaagtggttattaggcaaataactccaagaaaagactcatttccctgttggcttttctgcttttctaaagccttctctcttggttttcatccctctgctcttcaggttctccttaactctctggaattattctctgtcttcttaaccctttttgcacttgccatgtagaagtttgccaaggcccttgcctcttctttcatggaatagagcaaactatgcttgtcaaggtacgttcaggggctccctctggagtgctccccagtagctgtgcctctagccatcacatctgggcatcccctctcagctgcctggccaccaggcctctgtggaatgttccaaggatgcctcagctcagcgtgcccaagctggttcctcccactcccctggctctcatccgtttggttttttgttttgttttgttttttgagatggagttttgctcctgttgcacacactggagtgcagtggggcgatctcagctcactacaacctccgcctcccaggttcaagtgattctcctgcctcagcctcccaagtagctgggtttacaggcatgcaccactacacccagctaattttgtatatttagaagagacgggttttcaccatgttggccaggatggtctcgaactcctgacctcaggtgatccgcccacctggcctcccagagtgctgggattacaggcatgagccaccgcactggccctgttaggtttttttgtccagctgcccatctcacagttacccctgcagggagtatctctgtctctcttaacctcaggctcattggttgccaagtcttactgatattacatttgcagcatctcttacgtcagtaattcttaaatctggggctggattgagacaaagttttcactttgtccttgacaaaaatgagaaaatattttagtagaaggttgccatctcccttttcttgggaaaaactgttcttttttctgagataacatgtttcagtagtgggtgatggcaagtgtgcacttttcttttgttaataaactgttggcacttagacaaataaaaagttgggaactctctgtagagtcccccaagtagctctgaaatatttctggtttgtgacaacatagagcctggccacctctgatgtcctgcctgatgcctccatgcccctcacccccgattcagttcaggctttgtcttcactcaccggctagtggtccaggctgggcccaaccccatccaaaggttactctcaggtgggcttagacaggactgtagcaggttgatagctttaggggtgaggaggggtgagatcacttgggctgctaggccagcctcagggcacctggccaggatctaggggagagatggaaggtgtcaggaagcctaggctcccacagggcccagtgagggtgggaaaggcccagagtccctggcttcccacttttgcaatggtaggatgttacctcctgcaaggggccccatctgccttgggcctgctgctccttcctgtctcccttagagccttggcgtccttggctctgaccccagctcatctggttccaccctggcccctgctcccccatccccctccaccagctcctttcctctctctactccttcttgacttcagcctgtccgtcttcaccaccctgtcgtcccttgactcacgaagttcagggacttgaagaggatgtgtacgagctcaggggcacttgtctccttcagccaggtggccagccttccctggggacacagagcaatgcctgtcaccacccttcaccccaccccatcttcaccaggtcaccataattgttttatgccttggctggaaggctggcacttcccaaaagtcccaagaggggaggggaggttctagggggagtagatgaagaagaaaaaggcttgggatggttgagtccagacagcagaggattactggggaggaaggggaagaggagaggcctggtgaacttgtggggagccacctaccaggaggttgaagctgtgcttgatcttctggaagcagtcaatgtactgtgcctgggtgagacctgggagaaggggccaagacggtgggccagagatcaccctgagacacccctactcctcttccctggccctcagtactcacctccctggtccttgttttttttcccaaatttcttcttcctgctggtctttgcctgggccttctccagctttcccatgaacagctcaatgtcccttaggacatggttcagcacttcctgggccccaaacaacccatggccttgaacgggcagttgggcccaccctggaactccccacactgccccccgcacccctccccaccacaagccccagcctcaggcccagcctggagtataaacaagcctctctggcctcctggcccaggccctggccatcctgggaccctggcctcctagaaaaagagggagggttggtgtccttccttttcccaggcccagaaagcctcagcaaactcaagaccatccgcagttacctcgtccctctctgggtcctcgggggaagaggaccgccttggaggaggcagagtaaaggcacttggttctcgggcactggtgtggcgtggcaggggccttggggatggtgggaggcctgcagtgtaaggggaccatggacctagatcttagatctttgacttttcatcgaaaccctctccttcacctgcccccatgccccaaacttactgtgctctagggtcctctggtggggctgttctggagggatccccggctccagatagcgtgcctgctccatagggagcggcctttccatagcaggccccctccatctgtcctggcctggctgaaggcctccaagtcgaggtctgctgaggacatggtaggggccacatctttgacaaggttctttggagagaggccctccccacaattctgctccaggacccaggggcaccaccacctctctccaggagtcccaccccctgctccctggtctccttctggacccacccctgactccaccctgcctcatctgcctaccctctgggccctcttgggtcccatctcagtctctgaggacagtctctagtgccctctgggcccagccccttgcctatgcccacctctgtcctggctcctcctcagtccaggcccaggttggttgggccacaacctcctgggtgccccaagatatggggtcagggtctggcccccgaggctgagctgggaggccccataggtgggctgggcagaggctgcctacctttgctccagctcttcctccagagccttctgcaggctggtcttcagtcgctctgcctgggaagcagcagtcaggcaggctaagtgtgtgtgtgtgtgtgtgtgtgtgtgtgtgtgtgtgtggtggggtgatggtcgatgaaccccacccctgaccaatcacccccgaccactcacccccacttcctggcactggaagagcagagtgctagtgcctggcaggcccggctcctgcacggtgatggacaggatggagttgtaggaacatgtgttgagcgccacattcatggcctggatgctgtctaggcggtaagagtccagctcctcctgggccaggtggagaggtcaactgtgaggccaccagagctaggtgtggcttctgggagctcctgaccagctcatcctagccctttggtggcctagggctgaggtgtcatctacctgactcttgtgcctctgtccccagcctctgtcccctgtctcttcctaggcttgggtgtgtgttgtatgtggggagagtggctgccctttggggcatggagggtggagttcaagagctagtgcttgcttccccacagcccaggctggctatcactgggtttgctgggaaggctgaccttggtctcaatgtccagcagctgcagccagccgtccctgacctgcaggatcaagtcttggctccacacccggccctgtgcatccatctcgaacagcttctgcaaggcatcctcgggcccctggactctctgactcccctgcttgcatgtcatcaagtgctgcagggagagggggagtcctaggactgggagaaagctcagagaggtggaccacaggcgtgctgggtagagaaaagcagaagaggaagaagacgtgtcctcggcccccttgaggtaggaggttccaggcttcagataaagcaactttccagggccaatgtgagggacggtgtcgaagcactggggccagggatagggcctccaagtctgagtctgaggggctgcaggaggggtttgaggactctggaggaaggacaggcatggcctttactagtccaggccaggtgaggcagctgggtggtggaggatgtgggctccagccacccaacaaataactcctctggaggtgatacaggaccctcagattctgtccctggcttcctttgttccttttgggaactcagtcccagcccagtcttcctcctcactcacccagcattcctgtctccttctccctggttcatgcctggagatatccatcgtgatctcagtctccgctcaagtccttgcctactgctaggctgaccatccaggagttttttgctgttatccactctcctttaggagccccctcccttctcccagccaaacattaccttcacaaggccccttccacccaggcttcttgtggtagggagatgcagcctgcctcctgccctttgaccccacccccctgcccagggcccagctcttctccctgtgttcgcactgccagcatattcaggggactctggcatcatgagcaaactccatcctcctcttgctctgcctgctgggcctaaaagaagcctcttcccagcctccaccctacagagaagctgagtcctcctggcctctcctcggctggctaggggagctctgcctctgctgccctgtgggacctgctgccctgtgggacctgcagaccatcgccccagctccctccctgcttgttctccattggagccactaacaagtggtggccaggacaggatggcttctaccccagagctccagcctgaccctctgcctgctctccccaccacgcccttgtagcctgtgcttcgccttcaccttggtgtcgacagcccttcaggcacctaaatcttgcagtgcctgcatcatcctccctggtagagccagagactccattctagccttggagcagcctcggagctgctcacagtcaccctggaggcttgggcccaggtgcctcccctctccaacagtggccctctcaatcccccacagggcccaaagatcccaaagatcccacacactcctgcctccagccatgcaaggtcttgggcaatggagcagtgccctggggactcgggcagcagggggttgggagacaggggagggtaggtgggtgggtggttgtaggtgcttcttatcccatcctgctgctacttcttcctgtctggggacaggacactcacccgctcaacctccagccaggcctgctctgttcaatctgaccacccctccccgtccctgacactgagcagatgctctggcaggcttgttggatctgagtccatgcgacatggttgggacaggctgttggcttctggggcagggacttgtgtgaagtgtccatgttctggcagggcggtgggcacatgggaacacttgggtttagttggacactgcccgggggctgcagaggtactcacctccaccctgtgctgcaggagggtgggctctgaggtgaggttctgggagtactccttccggtgcactacaagggcacagagcaaggggcgggaggtgggcagaagaacgaggtgagactcaggcaactgctgggggcagttggtgtgaggaagggggagtggaggatgggacattctgggggctcagtgggagggcacgggagaggggcctgccaggagcttacagtaaatggctctgctgctgggccttgacatgttgacgctgctgaggacggctccctagaacccaaagtgaaccagaggcagccatcagagctggggaaaggtgtaccaggcacagcagggcaggacagttgctattgctctgactgggggcctctgggaccagacccaaagcccctggctccaggggccctttccggagccatctgcagccagcgtcctccactgaggagccctccatcctggctgggcctggaggccccgggctgagggaagggagggtcagggaggccacagcatggctgggcctcagggaaggctccaggcctcccatggtttggctgataaagctcatgccaaggagcccaggaaacctggatggacagggacctgcgttcagatcctatcttgggcctgggtatgaaagatgctggatgagcagagggttctgtagccgaccccgccagaggaggccctcttgttcgaccctgtttcagttctgcaaactgagaggacgctgatgctggctcttcagctgtagaccctctgggaagactgcatgcatgtgtgtgtgtacttatggtggcactgcaggactcgccagtgagctgacctcccccaagtgtctccctaggcctcctggctctttgctttttgtactctgtatcctctgcccaggtcccctcctgaccccaaccctttaaattctagctcaaagatcaccctcttggtgaagccctcctggaccatccaaccccaccctgcccagggtaccctcctaatgctgcactggaccttgtacatttatctccagcaacaatagtcacaatagccaccacggtgctgtgagcctggtgctgagccccttaccaacatcctatcagtttctcctcactgccgtccacttgtacttacttggcgccacgtgcctagcactgttctaacggcgttaccttcagtcactctaatcctcaaaacaacctcacaaggcaggtactggtattgtccccatttaccatatgaggactctgaggctcaaagacggtaacaggcctgaggtcacaaatgaacgtttaatagagagcaacccagatctgtccgattgcaagcttcgtgttttaatggtttataaacatgcctctgccgctgggctgtgcgcagtcacagagggagtctagagaacatacatgttgaaatggagtggaattaaatgtggtgtgtgtgtcccgggtgggggtggtgttagtctgtgcgggtcaagggtatgtgttatccaaatgaggtttgtgggtatccacatgtctacatggtacacctcagttgtgcagaaatactggactaccccgggtaacatgtgagagagcaacccatacccttgtttattaggactgttgtgaaaatgacgtaggatctgataagatgactcagtgtggaaggaaataaactgccagtgaacaattaagggaatgtggaagggacggctggatctctggtttccttgtttgggaggaccccttttctctccaggggtaaggcggggctagaagcctgttccccttccccagcctcccccaacccccattgtaacacttcctgcttctccatgctctccatgcagaagaggaagtgaggtctgcccctggtcagccccactccccactccctcaacaccagggtgggccctgtggggccctctaggtaggtaggtcaaggtggggaaacagctgcagccaaagattccctaccccagggagggaagagggagctggcttggcctgccttgccccttaggggtaggggagctgtgacagcccatttcccccctttaagccctagatgtaggggtttggagcagggaaggccatcacctcatagaccctggggcaagcatcccagaggcccttccggagcctggacctcgctctgctttccagcccaccagccagctgctgagtcccaagcccctccttgggcttgatcccctgggctgcagctgggaacaggctggagacctggcctgggaagccactgagttgcccccacctgccctgagatcccctgtgactgggctgggccccgatcttccctgggggccaggcccttacctgggtgccagtgaaggccgggtgcctggtccccccaggaggctggtcttggagcaggtggtccggtgctggtggtggaaggacagcagcttctctgctagtggccacaggcagagcctgcctttgatgaggttacagaggcagccacgcctgtgctctttggactctggtgggtggggaggcttcctggtcactaaccgctcaacatcaacctggacctgcggcagtgtctgtgctgactggcgtccccagcttagctagaggcccctgcttccctgtttcccccactgctagccttggggtgtggccccctcttccctctgccttttaggtgcctactctggggaacaggtcagcatcaggcacggggctgggaccagaagaagagagcacacatggcccagagtctgggttctgtggtgagggcacaggtcggctggaggtggactccaggcttgggggaagctgtgggctggcgtgtgtgccatgcctgtgcgtgggtggcacccataggtgtgtgatcctgtgtacctgggtggtgcctgtgagcaggacatggatcttgtcacagaagatggggactgaggcccctggggcattacatggagcgctgagattccctctggcagggccctcattctgtccctactgttgtcccttccagcaggagcccccttaccagccctttctcgctcttccactctctttccttctgtaccccatcttgtgcccagacccctggtggacgcctggccagcttcagcaaagatggaaaacggaggcctgcatctatctctagtcataaacctacccacttcctgcactccatggtatcgaaaaatctttcttggcactcagagtgggccaggctcccctgccctctgggaactcacagtctaaccaacaaggccaggtataaacagaaaccagggagcagggcaggaggggaggcgggggcgggggagtgccagtgagcctcggaccctcgtgggcagaatgcagggtcccggtgctgggccctgtgatggagtgtcctgtggagtctgagggctggagcactcccatctttagcttccctggaactatcccaggatatctcagccttctctcccatcaccacccaaccaacgctgccctggatggcctggagtccatgcgtcagatcctagggaggtgccttccctgtctgggctgtgtgtgtccctgggagagtccagtggacagccagctgctggggcccagggatcaggtgcctgtgaggccagcacccagccacagccccatgggaagcagtcctggggttctttcccctgggtccccatcttgtggcccttcagcttcttttgggatagcacagcctgtcccctcgttgcctcccccaactccgtgaaggccacagtcatatttcaccccagccctggcttggggctcaggcaacacctcatttctgcccagctcaggccaggcccgtccttcccataggaccctccccaagtcagtgtgagcacagcagggactcctgggggggctctggggcaaggtgggcaggggcagagaaacaatgagtggcattcccagcaccttgccctctgcagtgccctttaggggtgcccctgggagcagtgtgtgtctcctcagacataaagcctttgtggccttggtgggtctggggcttggggccaggtattggggacatctgcttctgtggagccccctgagggaagagggaaatcaggaaagagggagaggccaagcttcccatacctggggacttggggccataactgaagcttctgcacaaagctccgggtgccacagcagctcttctgcaagggagttcggctgaggcaccaggagctgggacttaggttggaggggaaggaagcaggactcgaagggcatgtccttgaaattgtggggttaaaaggctgtgggaccacattcgttcattcattccacaacttcctgtagaattgagggcttcctgcctgctaggcactgtgagaggtgctaggatccctctggagggcttacagacaccttggaattcaagctgagttcattatttctcagcaaaccatctcccctctcatgctcccatctcagggaaggcatcagctcccaatcgtgtgttccagcagggaggggagtcctccctcaatcctcacacccaatggactacccttcctgcagtcccagctctgtggcaagtcctaagtggcccccttcctctccaccccactgcgactgtcttcctcagaccccattacacctcctgtcttcgaccctgcggccgtctcctcacccacgccctcgcttcactcttgttctcattgatccttactggttgctggtagggaagctttcttagctggagatttgattgtccactcctctgcctaaaacccctcagtgacttcccgctgctcacgggacaaaacctaaactccttctcagggcagttgaagtccttgatgaactcaagtctcctgcttctgagtctggccttatcttccccccaactccctgccccttgtactttatactcggcttggggcatggcttgtaattccttgaagggtcacaccctggtaccaggctggctgctgttctctgtctggcatgccctgtggacacgctatggctttatgtctccagtagccctccttcagaagccttcccactgcccagggctggtggggctctggcccgtggcttccagacacgttgtacatgtgtccctctgttactgcatgtatcacattgagggggatacccccatgactggggtccctgtggggaaaagaaagagagatcagactgttactgtgtctatgcagaaaaggaagacaaaagaaactccattttgatctgtacaaagaaaaattgttctgctttgagatgctgttaatctgtaactttagcccccaaccctgtgctcacagaaacatgtgctatattgaatcaaggtttaagggatctagggctgtgcaggatgtgccttgttaacaatatgtttgcagacagtatgcttggtaaaagtcatcgccattctccattctctgttaaccagggacacgatgctctgtggaaagccgcagggacctctgcccaagagagcgtgggtatagtccaaggcttccccccactgagacagcctgagatatggcctcatgggaagggaaagacctgaccatccctcagcccgacgcccgtaaagggtctgtgctgaggaggattagtaaaagaggaaggcctctttgcagttgagatgaggaaggcctctgtttcccgcatgtccctgggaacagaatgtctcggtgtaaagccgactgttcgttctattctgagataggagaaaaccgccctgtggctggaggcgagatatgctggcagcaatactgctctgttactctttgctacgctgagatatttgggcaaagagaaacataaatctagcctacgtgcacatccgggcacagtaccctcccttgaacttatttatgaacagattcttttactcacatgttttcctgctgaccttctccccatcatcatcctgttcaccctgttctcctgccacactccctttgccgagataatgaaaatagtaatcaatacatactgaggaaactcagagaccagcaccggtgcaggtcttcgcatactgagtgtgctggtcccctgggcccactgttctttctctatactttgtctctgtgtcttcttttctcagtctctcgtcctacctgacgagaaatacccacaggtgtggaggggcaggcccccttcaggtccctgaggacccagattgttttctgccactgtctagaggagagaagggcttgtaaacaaaagcactgtagtatgcaggcataaagaaccttactcggcttgggggtgtcagggaggacttctcagatgaggaaatgcaagggctggcccttcaatgacacacaggagttcagccaagaggtgaagtgggcagggaattgcaggcagagggattgcagtcctactggatgaagcggcctggggagaagatgggtatggcgtgaactgtgtgtgtgcacgcgtgtgtgtgcatgtgtatgtgtatgtggcggggaggtggtggcagatgacagcatatgtgtgccgtcatcacctggtggtgagtagagccattgaatggttttgcatggagatgcaacaagaaggctactgggtcttctgtcttgtggaagacgctgccgcttgctggttctcagcatataaagagacccaggtgcacaggctttaggctaaggggccaaggagcccctcccaccaccctggcctgggccaagaagcagggtgggttccttggaagctccagagcaggccctggtcagagctgggaaactctggagggctctgaggaaaagagctctgtgttcatggatgaccatgcagggggtagggcagggccctggcattcagaggtgaatgggtgccgcctcacctttagaaccagaccccagagcagggtccagccagcacctcttgctggtggactgcatggatgaggcagcctcaatgtcaatcaggggctgattgacaactcttcttcccaggccgcttcatccagtaggactgcaatccctctgcctgcaattccctgcccacttcaccccttggctgaactcctgtgtgtcctttaagggccagcccttgcattccctgagtcatggtggtcctgtccaggggctgacacctggccctggggctgctggggaatcacagagacagctcccatccctgcccctgctttccccagccctggcacaggggtaagtggcttctacgagccaggtggagacataaacaagagagatgatgtccctccctcgcaactaacctgccaaggtagaagaaacaaatgtatctgaagataatcaaggtcctgacaagtgacaagagagaaatagagtgaagtggatgatggcatgggggtgggagggtgtttggaagcacgacgtcggagaaggcttctctgaggaggggagcttcaagctaagccagggatgggaaggagcctgggagagggggccagcaatgtgaagggcttgcagctgagaaggaacgagctggcggagaggtgaccgaaatggggtggacaggggccagagcacacagggctccgtagaccatggccaggagcctggtttttattccaagggcagttggaagacacggaggggttttaaatggaggagtggcatgattggatttatgttctagtcacaactctggctggggtggggagaatgggctgtggggggagtgggggcggactcagggagaccacaagcagctgctgcagagagggtggtgaggcctggacatggcagggcagtgaggatggagacttaggctgcaggtggaacggatgggacatgctatggattagaatgggggttgagaggggaaaaaggacctattaggactcaggtttttggcttggacaactgggagggttatggtgacatctggtgagatggggaaaccgaagagaagagggattgggaggcagggggatatgaagagttactgttccattctggatggcctcagtttgagaggtgttttgggcctctgggtggaagtagcaggaaggcaggggcaggtgtgagtcagaagctcagcagagcaggatgaccacatgcaggcattcagaagcatgtggagaaagatgattcaatgatgcggggaacgtttgcagtgtagaagacagtagatacttggcagctgtaaatacacgaataacattcagagacctaagactcacgagaccacatgcgggaaagtgtatagataaagagaagggggctcacgactcaacccaggcgctccaacattaagagattgggaaggatgaggggagactaaggggctgccagtgagcagcaaggagagctgggaagagagtgtttcaggaaggaggggtggacacctgggccaggtgctgctgggaggtggaggaaaggctaccatctgtgggtttgcagtgggggctggagccagctggggacggctgaagagtgtgagggtgaggaggtgggctgtgagtgagtcgccgagtgtagacagtgggcatgggaggctttgctggggatgggatggtgggccagggatgacataccagaaacttgttcagatgtgttcagggtggaagacttggcataatggctagtgggaacacactactgcagagacagatgagacaacagagatcctgggcgcatggcaggagggcggtttctgtgggagggcaggggagaaggtgggcttgtctctggagcctctggtcacacctgggctagactctgccatgctgcccacccctccacctgcctgccctcctcgataaaggcagacgaagggcgagtgcgtgatttgaaggcaggggggtgatttgtagccccacaattacaagaggcccagtggcttaagttttcaggaaagaaggccaggcctaacgtgcttccagaagctgctctgtccggggatggactggggttgggatctcagacccgcccccattttcctagctctcctcggtgcctccatttgtttaaaccccaaatctgaagccagtgctcagggctatgaattctcctgccttttcctcattgccctggcagctgatgtcggtccagatgtttctcagttcccgattctgggccttggttctgcaccttcccagccctggatcccctgggtgactcctacacatgccccctccttctttccctctcttctgcatcccatcccatccaggtaggcagtcccaggagcctggattaccctggccccactgccctgacagccctggaggaagggacctcagggacatctggaaagcccttctccagaggccagccttggactgggcttaagaacaggcttctcaggagagctgggctggagaggaggagaggaatccagggccaggctgggaggtggctgctgaggaaagagcagcctccgggaaaggcaagccctaggggatctcaggggaggggcttggttgggtccagctcagtctatgcggcaggtggggagagacagggagaggcggtcccatcaccatgcaggaccatgccctgggcccccttccaggagctggcggcactgaggcttcttcctgggccaggcctggccagcagccacgggtatggaggggagagggcctgaccaatgctgcccgctccctcagacacttctgctcctgcccccactttaaaccactgcccaagaccaacacagtgcggccattcagatccatgtggtgaagggatattcagtgatgtggaaaagctccccattagccttagatgaaaaagacaagttacaaaatgtagatcttagttttgtgaaataagcaaacacacaaacaaataggtaaatagaagtcatataacttgaaacagaaaagtctaaacgaaacctgtaatcatagacatctaaacaggaaacatggcaattatgtaaatacccaaacatagaaacgttcatgatgtagtatatggtgaaaaaagcttcttacaagttggtaatattcaattttgttaagaaaagttgtaatgaaaatctaaacaaaaaatgtcttgaagaagagacacgagaagaaagaatgttagttatctttagatgtgtgtctgtgttgggatgaggggacttctttgtggttttactttctttgtgcttttctatgttttccaactcctccccaaagaacatgttatgttatttttgtaatcagtgcatctccattcccatgtcaccccacacaaaataaatggtaatttttaaagtaagaaaacaagacaaaaatgtcccagaaagggactccttctgcagccctgggactctgtcttgctcccgaggggttgtcaaagggtaagaacagtggccctgggactgggaaggccagtaggagggctcagctcccctctgtctgatgtgtggcccctttgtggtcccagaggctctaggctatgtccctgaggaattcctaggtctcaggccagagccaggcctcatcccagttggcattgagtggtcctagccttcctgagcttcggggaggtgtgtgtctgcgtgtgcatgcgtgtgggtgtgtgtgtgtgcatttatgtgtgtaggtgtgtgcacagagccagcatggaggagtctgggagcccctccttggtttcttggtaccacaccccacacatattcccaggtcagcacaaagcaagacttcccctccaggattcagctgccgaggaaccctgctagggaccagaagctcatcacctccccagcaatgcgggccatggagggggctctccatcgcacagaggaagtggttcagcgtcaggaacactgggtgtgaatcctatctctggctcttagccatgtggccttggaacctgagttctctgaacttcgagttcatcctttgtcaaaagggatgatgatgactgcatggtttatataagacaacttggtcacatgtctggagcaggggaggggctccataaacagcctcctgaaagtcgacctccctgtaaagacttcctctgctgctagccatccctgtgccacccagaatagatctgatccctctgaggcacctcttccccaggcaggctttccccagctcttctgccaccctggatagcaggctgcccaggctcactgcatcttcatctctctagagtagtttctcaaatgcctggctccatgggactgcctgggaagcctggttaagaatgtaaagttctagactctatccatggagagtctgatttaggagttccaggaaggagccccagaatctaaatatttataatctcccagtggttctaatgggagcccgtgctctacccgcttccagttggcaatgtcctgtcttaagtgtcacccagaagtgaccagtgccaggctgccacccgaccagcttgaacctgagaagtcatccctccagctgcccctgctctccccacccagcctcctgggtgccccgggggtgtgctgtgccacagccaggcagtgccactccagagactcttgctctacagtgctctccctgaaagtgggcagcagctggagccaggagccctggcctccccaactctgcccctcagtggattctgtgccaggaatatttgtccatatagacacctatgcagacagaccaaagggctcccagaaggagctggtgagcttggcctgtggctctgcagaccttcccatcaggctgaaggggtcccgccctgcgaagaacataggccaccaaagatcttgccctgagaggcctacccagaattccagaactgtccccagtggatgtaggcagctgtggaacagtgggtaggggaccgcccctccaccagtgatctgagatccagaggccctcagagaaaatgccgggactctccagccccagggcagctgggagaccatggggaggacggtgacctctgtgattcaaggcaggcatccactgtgtctggcccttcagtcctctcagaatgtggccctctggactggacggggccgagagagacccaccatccctcaattcccgactccctgaggccatccctcagacagggtgctcacagccagccaaggcaggccctgtctcaactggccagctctgaccattagaacattcttccttaggccaagctcagacctgcattcctggagcgtccctgcaatgtgcccctctctgacggcaagcccttcagatatttagagatggtatcacgccctcctggagctgcccagagaccatcagagccagagcccctgggttcaaattaaactcttggaacctcagtttcctcatctatgaaatggagacaaccatggcctctatttatggaacgcacgccctggccaggcattgcattaagcatgccacgtgcctagcacatagacatttattaaggcttccagatccttggccagacgagtggcactggttcctggctgtctgcggagaggtgccggctccctctgctggaaatagtgagtcgcagtcaggacgggagaggacaacgtagaactgcactctgggtgggagggacctcagagatgacctg

(The sequence listing continues in the following parts.)

The invention claimed is:

1. A method of determining that a human has an increased risk for deep vein thrombosis (DVT), comprising testing nucleic acid from said human to determine the nucleotide content at a polymorphism in the F11 gene at the position corresponding to position 101 of SEQ ID NO: 710 or the complement of SEQ ID NO:710, wherein the presence of a C at position 101 of SEQ ID NO:710 or a G at position 101 of said complement is detected and indicates that said human has said increased risk for DVT.

2. The method of claim 1, wherein said nucleic acid is a nucleic acid extract from a biological sample from said human.

3. The method of claim 2, wherein said biological sample is blood, saliva, or buccal cells.

4. The method of claim 2, further comprising preparing said nucleic acid extract from said biological sample prior to said testing.

5. The method of claim 4, further comprising obtaining said biological sample from said human prior to said preparing.

6. The method of claim 1, wherein said testing comprises nucleic acid amplification.

7. The method of claim 6, wherein said nucleic acid amplification is carried out by polymerase chain reaction.

8. The method of claim 1, further comprising correlating the presence of said C or said G with said increased risk for DVT.

9. The method of claim 8, wherein said correlating is performed by computer software.

10. The method of claim 1, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

11. The method of claim 1, wherein said testing is performed using an allele-specific method.

12. The method of claim 11, wherein said allele-specific method is allele-specific probe hybridization, allele-specific primer extension, or allele-specific amplification.

13. The method of claim 11, wherein the method is performed using an allele-specific primer comprising SEQ ID NO: 1666 or SEQ ID NO: 1667.

14. The method of claim 1 which is an automated method.

15. The method of claim 1, wherein the DVT is recurrent DVT.

16. The method of claim 1, wherein the VT includes pulmonary embolism (PE).

17. The method of claim 1, further comprising reducing the risk of DVT in said human by administering to said human an effective amount of a therapeutic agent.

18. The method of claim 17, wherein the therapeutic agent comprises an anticoagulant agent.

19. The method of claim 18, wherein the anticoagulant agent is selected from the group consisting of coumarines (vitamin K antagonists) such as warfarin (coumadin), acenocoumarol, phenprocoumon, and phenindione; heparin and derivative substances such as low molecular weight heparin; factor Xa inhibitors such as Fondaparinux, Idraparinux, and other synthetic pentasaccharide inhibitors of factor Xa; and thrombin inhibitors such as argatroban, lepirudin, bivalirudin, and dabigatran.

20. The method of claim 17, wherein the therapeutic agent comprises an antiplatelet agent.

21. The method of claim 20, wherein the antiplatelet agent is selected from the group consisting of cyclooxygenase inhibitors such as aspirin, and ADP receptor inhibitors such as clopidogrel (Plavix) and prasugrel (Effient).

22. The method of claim 1, further comprising at least one of:
a) enrolling said human in a clinical trial of a therapeutic agent; and
b) assigning said human to a group within a clinical trial.

23. The method of claim 22, wherein the therapeutic agent is an anticoagulant agent or an antiplatelet agent.

24. The method of claim 11, wherein said allele-specific method detects said C or said G.

25. The method of claim 1, wherein said human is homozygous for said C or said G.

26. The method of claim 1, wherein said human is heterozygous for said C or said G.

27. A method for determining that a human has an increased risk for DVT, comprising:
a) testing nucleic acid from said human to determine the nucleotide content at a polymorphism in the F11 gene at the position corresponding to position 101 of SEQ ID NO: 710 or the complement of SEQ ID NO:710;
b) detecting the presence of a C at position 101 of SEQ ID NO:710 or a G at position 101 of said complement; and
c) correlating the presence of a C at position 101 of SEQ ID NO:710 or a G at position 101 of said complement with said human having said increased risk for DVT.

28. The method of claim 27, wherein said correlating is performed by computer software.

29. The method of claim 27, wherein said nucleic acid is a nucleic acid extract from a biological sample from said human.

30. The method of claim 29, wherein said biological sample is blood, saliva, or buccal cells.

31. The method of claim 29, further comprising preparing said nucleic acid extract from said biological sample prior to said testing.

32. The method of claim 31, further comprising obtaining said biological sample from said human prior to said preparing.

33. The method of claim 27, wherein said testing comprises nucleic acid amplification.

34. The method of claim 33, wherein said nucleic acid amplification is carried out by polymerase chain reaction.

35. The method of claim 27, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

36. The method of claim 27, wherein said testing is performed using an allele-specific method.

37. The method of claim 36, wherein said allele-specific method is allele-specific probe hybridization, allele-specific primer extension, or allele-specific amplification.

38. The method of claim 36, wherein said allele-specific method detects said C or said G.

39. The method of claim 36, wherein the method is performed using an allele-specific primer comprising SEQ ID NO: 1666 or SEQ ID NO: 1667.

40. The method of claim 27 which is an automated method.

41. The method of claim 27, wherein said human is homozygous for said C or said G.

42. The method of claim 27, wherein said human is heterozygous for said C or said G.

43. The method of claim 27, wherein said DVT is recurrent DVT.

44. The method of claim 27, wherein said DVT includes pulmonary embolism (PE).

* * * * *